United States Patent 7,868,149 (PLANT GENOME SEQUENCE AND USES THEREOF) - sequence listing, part 25

SEQ ID NO: 12365 - DNA, 11344 bp, Oryza sativa
actgccgacgccccgccgacaacagagctcatcgctagggacaacagtgaagaggcggcggcctgaatctgtgcgaacgggaagggcgcgtggcggacgggcgagtaggtggcaatgggaacggtggagcaggcaagcgaggcgggcggcggcggaacgaagcgacagcgggtggagacctcggtgaggcggtgttaacagtgaaatttggtaatcgacaaagacgtcatcggcttagaatcattatcggctgcagcatctcggaatcagccgatgggagttatcaagtcgctaatagtcggattcctgttatattcggttaaggaaatcaatctactaaaggaagcttatccctaagtgaccgagtttaaagaggatgcggcatggcagtttatctattaattaggaatagtttgttagtttccttttatctttaggaaagtgtgtttagtatccgataatgactttatattttccttttatctttaggttagtttctttcttgtccgacaaggacttgtatcaacccatgggtataaatatgtacacccggggtctatgtaatctatctccacgatcaatataattcggcgcatcgccaccttttaccttttctactttattttattgtccagcggaacttggcacccgacgcagggctacatcgtcttcgatctccggcgaagggataagtccaatgttccgtcggcccaggcaattgtatcgtttacgtcggcgtcgttcgaggctgcatcagtacattcgacctcttggattgctctagtttggatgatatatttgcctacctatttatcatatgtctctgttaatctagccttagcatatcaatttagctctatcggttgcttctcgttttagggtttctgccggtatcggctaaatcgtgttgctagattagattagcttagacatctaccaccctgaaaactcagtcaacggcttgattgtctagatattatgtttcttttcatacttagtgctgcatcagttaagtttgatatactaagtcgtgcttagaaccataatctctagcctgcttcttgattgccaataagggtatcatcggggtttcagccggtgagttatctaaacgttgcatcggctcataaggattgcatatacatataagttggatttagccgatggcaacaaaggtttcactgtttaatctaatcttgtggatcttatgacatcggacatccaaccgatgtgtgcttcaaccttcggatcaatatttgttctactatttcatattgttagccgattggtttctactggattatattgctatattatattatcatcagccgattgcctttatatcattatctacattggacatatagccgattgcttaaaccctatcgctatcggctggtatcggcatcggctattatcgactatcggctggaactactccatcggcttgtcagccgatcggctgtttgatctattatttgcaaatcttgccagttgcaggattaaactgactggcacgctcgcatctcattaatctttggacctgcacaagagctaagcagatctcccaggccggtgtgttcgattttttcgtcaacaggcggggagatcgtggctgtcgtgagggcggcgctgcggtggtcggccacaccccagcgtcgccaacggggttggggagtgaggagggccattgagactatggaatgtcgttgtcgcgagcaaccccgctcggtggcccaaccggcgaacatcttccaggagctcgcccatcgctgctccgcccttctccttgtagtgcagggtagagagagggggatagagagaagatggagtgaggatgacatgtggaaccacatgagccccacttttttattattttgtgtgtagctggttatgtgggtcccacggtttttattatttttctaagatcgaattgtcacgcaagcgccacgtcaatgccatgtgggacgaggatctagtcaaaggagccatgtaggtgccacgtccacgtcatccaaaactaggcacaatgctgccgagggacctcatcagcatagttttgtaagttgggatgggttatatccggttttctagattgaggatggaaatcagactaggcaacaaattgagggaccaaatgtgaaattattccaccggaagatggcccaaggacctaattcagcccatcatccctcggaagatggaatattgtactgcattgaattacgtttcagggcatttacatacctctggattaattaatttcaaaacatagtactccactaagtttgaatatcgaaaaacatatggagatgttatacagagtagaataaaaaaagactgagaatgtgttggcatcaaaatctttgctaggccctcaaaagctttaattacaggtttgaaataatctcttcagacctctttggtggttgagaagaccccccctactccctacctaaatcctactccaggaaatatgtatgaaaagaagacacattgtacaacctaaacatgatcaaatatccaggaaatattatattagcatatgataatgttatcaagaagcaaatgaagaaagttagcgcgatgaatagcacagcacgagcagaaaaacgaaaatgactacaggactaaatgcaggagcagtgagcagtccatctatccattcatcagctgattcttgtactggcaggctagtatctatatttctatgttcacaacacagataacttccacaaagttcaagttaaagctggccacaagatcaatccttgctgcaagtttcatgctttccgtagcttagcaggagagtagagtaatgaatatatcaagagatcaccaacataagacacatgtgaactgatggaatagaagaaacgccaaggcttcagagtcgaacatccttcagaaaacatctgcatggcaaaaaagggggtttcatatcaaatgtacagggttactacatcgataatagacaaaggttaagatgattcacaagacattagaaatgctaggcagctgaaggagaagttaaatattttcgaagtagaacataatcaaattccatgccatgttccattgatgtcccagttgtgaagcgatttgaacattgcttggattgcgaaatttggcggtatgtcatgctggcattaaagaatatatcatctaagcaaataaaatgcagcttgcaccagagaagagtaagcagggaggcctaggaattgttgtatgggctttatgtttatacagatagattaaacaatctgctgcaaaaaatatcaaattactcaatatagaattagaactgttgggactaagattaaaagaaacatatatattacaaggacactgacatagacaataatatccagaaacagtatctgaagtgcgagtacggtaggataaatggcagtcagacatactaggttctgcttctagttagcgcttcttatttgatgttgaacaaaataccttgttggctcttgttgtgatgggaatttacaccttgtaaacagaataatgaaaagaatggagcatagtctaaatctgttttttttttccatcaacagtcagaatataacttacgatcataaatagacacaagtccaggacatcaagaaaataagaagatttcatctaatcctggtcagtgctgactaacattgagggaaggggcagaggaggtggtacaatcacaggatgaaataatggacaaatgaaggtgacaaagtgtcataaaaagtgcttgtgtgctgattgatgtttcgatttggtttgaaccgataacctttgttcagttggtgcaagtacaacaccactataataatcatgccttctagtttgtatggaaatgaggcatcttgtattgtcgatcattccagaaacatatccaccagacagttcatcacaaattgagttcacccaacaatattaggaaattctaacctttataggactgatgaatgaggttacttttgcagtataatgtagaagcttctgataaatcaaattcaacaatcccaaaatctaatactaatgtttagaatcagcattattcaatcttaaaaatattatgctatgaatcaatagactatttgaaccatgaagggccaaaggaaccaacctcgtcagaccctgagaagctggaccttgttctcaaaggcaatcgatatccactccgggtaagctgccgcccattgcagttggtttatctctgcaccggcatcatacaccatcacaggatcaatcccctcggccggcactgcgccgggcgtcgctggcagctcccaaatcagcgcttggccgtcgtccccagccgagcaaaggtgcctcgtggcctgtggcgcccaagcgaccgcgttggcgcacgcccggtgtctgtgtagttcggccaccggcaccccgggcgcgcgcatgtcgagcacgacgacggcgctgctgtccatgagcagggtggccatgtagtggaagtcatagcggttccatgccagcctgaggagcggcgtgtccgggcgggggctctcgtagaagatggtggaatgctccttgtcccggaggtcgaagacgcggacggagccgtcggctgagacggaggcgaagatgccgttctccccccaggcgatgtcgtgcacggccttgtcgtgcgcgatgagctgcgtctcgacgacgccgcgctcgatgtcccagatggtgcaggtggtgtcgatggaggcggtcccgatgcggcggggctcggcctcgttccagtcgaaggaggtgaggggggcgcagaactcggaggcggatgtcttgcggttgtcgaggacggagcggagctcgggcgcggcggcggtggcggtggcggcgagatcgtcgagcggggcaagccagagccgcagcgcgtcggaggaggaggcgaggaggtggggcgcggaggcggcgcgcgggtggaactggagcttggtgggcgggtaggggtggtcgaaggagagcgcggggagggcgcggaaggaggcggcggtggggtggacggggtcgaaggagaggagggagacgcggttgtggaggtcctcgaggaagctgccggcggcgaggacgggcgcggagggggagaaggccagcgcgtagatggagtgcggcagctcgcaggtgaaggcgttcgggttctgcgcctccgccgccgaggcggctaccgacggcggcttgggctgctccatgggaaaaatcgttggattcgcttcgctttgcttcctttctttctcgggtggatttggggatgaatggactcacgcgccgcggtggttgatcgggtcggggagttcagagtaaaaaacgcgagcagccaggccgagcaggtaggagggacggcgaaggaggaggcgcgtcaacgcgcgcgtgccacggcaaccggccggtaaacgtcagctcggcacgagggttgaacgggcgacgatgcgggcatgcggccgccgggctgctgcagttggtggccgcctgaagctgattcaacggtggggccagaccgtcagtgacttatagtcaaagctggtttcgactttcgactggaatcagtttaacttaaacaggatgtactcatttactcaaccagcctctcatgagttcttgagcaaccggcaggacaggtcagtcctctcaagcaatgcaaacgatgctactaccatcaggatagggtagtgccccatggggaacaaaagaaacaaacagttaagagaaactgcaaggcagaatttgcggcttttaacagctgaaaaccagcttagctaatagttgccacttaattaatataaaggttgctctctttctcacagattagaaaggcaaaaataacgagtctaggaaaaacatttttccccaattctgatttaagcagcaactgaaggctacacatcgtcgctcagcgtgtggaactgaacagagctcggctgacaataccagttgcctcaatgtaacgatcaacacagcgtgatatgcaactgctctcgctcccgctcaagcttgatcctggctttgtcacgcacttggcaaagcacttgtttccaacagtctgtaacaacaaaacaagagagaattacaaccatgtcatgtgtttaacaaagaagcaatgcctggaattggcatgttttatttcaaacactaccctttttctcatgtaatctgtattacatatatgtcatgtaaaccaacagtggcagaatcacttgatcagcaagactaagggtgagtttgaggagaaggtgattgaggagattgggaagatacgtaaaacgaggtgagccattagctcatgattaattgagtattaattattttaaatttcaaaaatggattaatatgatttttaaaagcaactttcctataggaaatttttacaaaaaacgcaccatttagtaatttggaaagcgtgcgcgcggaaaacgagatgttatctccctcaatgttacccgaacgaacgcagcctaattactcatatgtcaaacttcgtagtaatagtgtagcaacaggaagggtcaacttcaatgctaactttgtgaacacatattttacctttctggtcgtggcaggccagcacaagttaatagttctgactctatgttgagttcaaatatataatgaacacagaagtgaaagacatacaaaatgtcaccatagttttaagcaaaggaaaagcacttgaaatagaaaatgcaacagttagaagtatataccaaaactcaggcctgtattataaagtctaggtgactcgatgtccctggtccagtcaatttaaatagtttactattatatctattggttttataatatgcttaagtcatggatatgtactggatcctaagttccttctatcagtcctacaaggttgtggtcatcactagactggggagatcttacctcatcaagacaacattttaagtttccaaattcaatatgtattgtaaatgatagatgagtttgatgcacctattccaaatacgttgttacagttcaccaaagggtgtgctcaactgtgcttgctgcgcagccacagcagccagcatatcgatcaaccccaatttctcttggtacttaaagtgtgcattaagactgttaaatttatgctcttcaatcctcagttttcttgataaattcaagaaatcatcaccgtataaccgtatatgccaagtaaaaataacaaaagaaatcaacagatgagccaccacatccaattgtgtgattcaattggacatttggacgcaatgcacaccagtatgatcaacttgtatcagtatgcagattacaatcaatggatacagtgagcatgaaagtcacagcatgggcatgttgattccaatttaataatactttcttaagcggttccaagttaataatccttttcttggacaaaggaaatcaatttatgagttttagccatcctatgcaaacaataggacttactggagtgtaatgggattgagtatagatttaatcatacaagatacaaggatacagaaactaaaatccatcctatgccaacatgtttaaactgtatcgccctccaatccggtaaatggaactgttgtaacttgtagaacatcaaaccactctaacgaagctattgttaagcttgttgaaggtgctactgaatactgatgctcattactttagtactagaatacggaaaaccacaaaacaggaaactaattctacccccaaatattcgcttccgtagagtgctaccagcgaaatctagtgtcacctaaaccaagtatccacctacctaatgaatattcatccatacagattcgcattaacaaacgtgatacaagagaggaaacgatttgggtggggaggatctcacctcaaggaactcctgggcgtaggcctgagcgagctgcgccttgatctggtccatgagcgcctccgtattggggggcgacccggacgacgacgagaaggagtccatgccggcttcccaccttcttgattcccaagccttcgtcggcgaccggttgttgaagagcgctctccagcaacgacgattctccggcgcggcggggtgtgcgaagcggaggaggcgggcagagcggagtaataaaaccctagctttactggatcagaaccacgaatccacgattgggaggaaagggtagtaggcccacatttatcccccaagaaagagcccatatagtaattgggccgtacagcggaccatctctcgtggctatgtggatttaagccgaaaaaagtctactttgagtccttaaagtagtccgaatctaatttgtaccccttaatcagaaagttaggtaggacgactccccaaactattggaaccagtataatttgactccctcgaaggttttggaggacagtttcgctgatgcggtactttgacctagtataactggttgagttggtgtgtggggctactttttcttttggttactatcccctcctcaccttcctttccgcgggaagcatcagggcagcagatcgacggcaacagggggtgcacagcggcagtagcaagggagctaggccccgaaggaaaaccgcgcaccaccaccagacgtggcacccccacgttgggtcaccccactggcctcaataaaaacccgtacgcatcggcattggtcgtggcaccatatcccaacctcccccggtagatggcggcggcatggagcggaaaaggggtagtaggggcggcagcgcgttgcgagcgattcgaggcgaaccgagcgacgacgcgacctcgtggcggagagcggcgatgtctctttctcccttcccacacaagtacacgattcgagatgaaccgagtgacgatgcagctgagtcggagcgcagcacgacttcgtggcggagagtggcacaactttgaggcattgcacaatgcggcccaaggaggagcaagcggatctaagcgggtcacgtcatcgacagccggaccacgccaccctccctgtggcgtcagcccataccactagagcacaccgtgccctccctgtggctcccgcgatgctcgaagccctcctcgtgaggggtgcacaaaagcttgaaactcatgagctaactcaactcgagtaaaactcgggtcgacttgagtagttaatgagtcgagttgagtttgaacttttacttgtttgcttaacgagccaactcgagctagctcatgagttacttggttagctcgctgagctcatgatgcattaagatagaaattgattgttcatattttgcaggtgtaaaagtcgtgaactcataattatacattatagcacaatcttatgagtcatgatacatagcatggcaatcataatctttggtcataaaatcacaaattatactgcatatgaattttaaaccatgtatttcggtgtaacgagtttagtgagtttaatgaatcaactcagacttttattgtgtcgagtcgagttccatttttaacttgttatgttaacgagtcgagccaagatagctctttaacttaacgagtttttacgagtcgaggtaagtcggcttgtgagccacccaacctcgtggcgtcggcccaggctgccgaagcacgccgcatgctccttgtggccgctgcgttgctcaagcaccgtcacgttgaggccctctcacagtctggctcctttccccgctgaccaccacccactgccctggagaaaaagagaaaataaaaaggaatgaagaaaatgtgacactaacactgagtcagccgattggactgggtctaagcaccatgtcagcgaaattaaaccacactccaaaacggttaagggagtcaaattataccaatttcaatagttagggtagtcatccggttttccgattaaggggtacgaataggattgtacctacttttttaagggagttaaagtagactttttgcatttaagccttggaatggcctacgtactcacatataaggaataagttcatctgaggtcccttaacttgtcaacgaatccgattttcatccttgaaccgaaaaaccagatacaacgggtccctcaactatcaaaaccggtgcagattaggtccttcagcggtttagatagcggttttggatggcgtggcgcctacgtggctaatttgatttgttttcatctgacgtggcattgacgtggcgctgacgtggcaattagatttgaaaaaataataaaacccatgggacccatatgtcagtttcacatataaaataataataaatggtgggacccacgtgggccccacatgtcatatctatcctcttgtaacatcccggcctagggcttaataagattaatagaatactcatatcaacaagttgcaacttcttttccggaagccaatctccaaagaactccagggttaagcgtgcttagcctggagcaatttgggatggttcccgggtgcacacgagtgaggacaaagtgttgcagaaaagacatgtgttggtctgtgaggtttcacgggcgcgtgtgtcgcagttgcgcaggcatggtgcgcatggctggtgtagatcgggagtggttacacagcatggcacatgcgctgggtggccaagagaggacgttcctggcctggggttgatcgacgggggcgtcgatctctcttaagggggttaagcgtgcttggcctggagcaatttgggatgggtgaccgaccgggaaattcttcccgggtgcacacgagtgaggacaaagtgttgcagaaaagacatgtgttagtctgtgcccccgtcgatctctcttaagggggttaagcatgcttggcctggagcaatttgggatgggtgaccgaccgggaaattcttcccgggtgcacacgagtgaggacaaagtgttgcagaaaagacatgtgttagtctgtgagggcagtctatgagctataaaagctaccagatgtaagtgggcccggcctgggagaggcgggtcgttacacctcttcacctttcaccttcccctttaccctttctctctcgtgcatggcagcgacggcacgcgaggcggaggagggaggggcgcgggggtggtggcctgccggcggcggtcgcccctgccctggagcgacacgggggtggagaaagtttctcctcttatgtccacatctgtagagaagaggttaaatcaaggaaggttgcatcttgttcttgactgattaattggtgcgccataatctgcaggtaaactggttcttgcctgacacttgtcttgtccgggtggccaccgtggggcagcctggtgccatgagaaggatcaccgttcactacgtgaatttgctgccggtcgccggcgccggagaagcacacgtcgatggcgccgcgaattattccggcaaggtacgcacgacggattgattgttcgattgattggttgac

SEQ ID NO: 12366 - DNA, 3878 bp, Oryza sativa
gatggacatcaatgcctgggaggcgaaggagcggctggaccagaagctgaggaaccagatggaagccgtcatcaagaggtaactgatgatgcaaagatcaaatcatttgtttttttgaaaagaagaaagatggattgaaattttgctgaattgtttttcgtcgtttcgtttctgcaggcatcacagcacaggaagcatcaagctgaacagagccagcagtggaggggggagatcgacagtgacggcggcgatgggggtgcagagggcggtgtactcgaagaaaggggtgatgcggcggctgatgcggtggagtcgactgcggtgggacgcggcggagcaggcggagtgcacgtgtgcctagaggagttctccgccggcgacgccatggcccacctcccctacggccgccactttcactgggcctgcgcactccctggctcgaggctggcgccgcaccccgctcctgcccattctgccgcaccgtcgtcgacacgccggggaaggggaagtggaaggggaaggtgaaaggtgaagaggatagatatgacatgtggggcccacgtgggtcccaccatttattattattttatatgtgaaactgacatatgggtcccatgggttttattattttttcaaatctaattgacacatcagcgccacgtcaatgccacgtcagatgaagacaagtcaaattagccacgtaggcgccacgtcatccaaaaccgccatctaaaccgctgaaggacctaatctgcactggttttgatagttgagggacccgttgtatctggtttttcggttcaaggacgaaaatcggattcgttgacaagttaagagacctcagatgaacttattcccacatataatgacgggcccatttcatgttcgaaataggaagtttttggactatacaaagccgattttgctaaacatctcccgcgatttttttcctggcatttgatgtttttttggccacatgatctttgcaccaagatttgtgcagcaattgccgtggatgaggtcgacagggagtcaaggtgtgttggtattgccgtgtgaataaaatacgtgaagtatgtaattttcatatgtcaaattaagaaatatctctatgttaatttacatgtcaaattaagtactaatcgatacaacaaatttaacatatcttaaacatctaaataaaaattgatttctttaaccattgaaaaattaagatatttgaaactaaaataaaaaataaaaataaacttaaaattacagtcctatataactaaaattatatttgtaaatttagttgatttgacatgtaagtgcactgtaattttgataaaaataatgggtaagtaaatatgtacttattaaattctttaaaatataaaattacagtcttatataactaaaattacatttataaatttagttgatttgacatgtaagtgcactgtaatcttgataaaaataatatgtaagtaaatatgtacttattattttctttaaaatataaaattacagtcttatataactaaaattacatttgtaaatttagttgatttgaaatgtaagtgtactgtaattttgttaaaaataatatgtacgtaaatatgtacttattattttctttaaaatataaaattacagtcttatataactaaaattacatttgtaaatttagttgatttgacatgtaagtgcactgtaattttaataaaaatgttgtgtaagtaaatttgtattaattattttattttgtagtccgttggatgtaaatccaacgaaagaaaaaatctgggtgatattttctcaaaaatcacccgagtgatgtataggcattgccatacaaagccactagtgtactactactgaatatatatatgagattctgacgattttcatgaaaaaaccaggagattgtcctaccttactctgcgcgtgcaatacatccatcactcaatccatccaagtccagacattctggcaactaggcctagtcacgatcactggaacctgactacaaatccagattcatcaaacacatcaaccagacgattctggattataattattttccgccgggccctggattataattatcgatacagcatcactgatcaggatcaggcattggcgcattgcctgttgttacagtaaaagaacagtaaaaccattggtgtacctgtaccggacgccgggcgagcaatggagagggttgctagttgctactgggctgtacagcagaaggcaggcagcgccacagcgcgcggagtgtgtgcgaccccgcttcggcgcggcatgcaaagcctgcggcatcgtcgtggcaggggaggggagtggagaaggggggaccccgcctgccttccggaaccatccaaatgcaaagttcaaaggcccctgtagccagagcgcgcgtcgtagcgaaagccagagcgagagcgaggtggttctcgccatgcatgcgcgcgggggcggtcgcgtggggggcgacgacgtctcgcgcctgcaggccgcgcagctaagctgcagtccttgttgttgtggtcatcactcactcacgcatgcatatggctgggctgtggctagcgaacgacgacgagcgagctagggcggtttgccggtgtggtggccactgccgtggcatgaagtagtattcacctcgccgtggtttgatcctggctagctgtccgcctgatttttcacgtaatcaccaacctaacgttagaaaacgatatgaaaacaaacgataaaaaacaatatatcgttcacggaagagacgagatttaacgtagaaaacccttccaaagcaaaagagaaaaaaccacgagcgtcagccagtaaaatatcttcacaatatcggggtgaggttacaacaccgaacgacggcttacaagaggtatatatatgatatgaaattctaaaagggatgacgatccgtacctctgcttcgctctggcccagcctctggcatctactggcctccacttcacctttacactactagaaaacgcatttttcccaacgcaggggtctttttttcgcaggcggacatgattcttatagccaaatgaccgcctaaaaaatataaatcggggtgaagttcgctgtccgcctgcgagaatctattttcgcaggcggaccacttaagcggcgcattttcacaggcagactacttaagcggcgcctgcgaaaatagattttcgcaggcgaaccttatgtagtccgactgcaaaaatcgtacctacccaaaaaaaaaccccacccttatcttctcatcccacccctcccaccactcaactctctctctctctccttctccctccactgactcagtctcactgactctcctctccctcactgactctcctctcctctcatctccggcggcgcggcggggccgacgacggcgcggggcggcggcggcggcggcgcggggcgcgtggccggcggcgtctcccctcgccccctccctcctagatctggccggagggaggggggaggccagcgagggcgacggcggcaacgaccgcgcggggcggctggcggcgtctcccctcgccccctccctcctagatctggccggaggagggaggggggggcggcgagggcaacggcacaacaacggcggcgacggcgcacgtggtgcggcgtgggccggccggcggggtctcccctccctccctccctcgcagatctggccggaggaaggaggggggaggccaacggcggcgaggacggcgtggagcaacggcggcgacgacgacgacggcggcagcggcggcgacggcggcgacgacgacggcggcggcgacggcggcgacgacgacggcggcgggggctcccttcccctcccctctcagatccggccgggggaggggggcggtggc

SEQ ID NO: 12367 - DNA, 8871 bp, Oryza sativa
ggaaatcaccacctccgtctcgctctcttatcccctagtgttgtccggccggggtccggccccgtgaacaggttagtgtttacccactttgcgatccttttttctcgttctcgttcgtcttttcgagcagcagcagccgcagccgcgcgcgtgacggggacgggccatcatgtgcatatccatcgttcgtgcgcgcatgatagatgcttctgcgtttgccggtgttgcgctgccccgtcttaatgcaaatatgcaatcataatgttcgcgtggatcatgatggttggttgattacaacgtgcactgcgggcacggcgtgctaccactgtacacgcgtacatcaatacaaagcgtttcccaaaccgccgggaccggggttacggcgccccggcggtaagcacggttaccacgcggtaaccgtgaaaaaccatgtaaaatttatcacaaatttaaattattttttaaatttatttaaatttaaggaggttaccgcggtatttatattgccgtaccccgcggtaaggccggtaaccgcgcggttaccgacggtaagggaaacccatacatatatcactcagatctacgagaggatctccgaaccgcgcgagatcagtgatcgattgagagttagatcgaaaagatgtgcagatgcttgagttcagtatatatattaaagcacaacacacgttatattataccgtaaaagttttccttcttttttgattgttgtgaattaatgcagtgtatatctatctatttaatctaataaaaatatgagggaaagtaggctggattgattccttggttcgtgcatgacagcggggaggtgaagaacatctcctgttctagatgcgaccaatttgatcctccgtgtcaatcatatatatcatttggtatgggccatgccacctcttctcctcagtcctctgcgtgtgctttagccggcaggctagcttgcgcgatgtggtccaaaactaaagacagcatccacatctcccacctcctaccttcggcagcgacgtttgccggtcggccggccgccggaggacggatgtcccttcaatctgatcgatcccctctccggcatcacagacgaatacagcgtattagatatttagataggcagctatcagctggctatagatcgatgctctttctgaagtccgagaaaatgaagtgcatgagtacatcgtctgtactggggtattaatttatcaaccccaaaccctgctgaccttcagtgagagagagagagagagagctgcagtagttgtgtccatggatgggagagagagcgagcatgggaacaaaagcatgtacaagccaggtatgcatgccgatccgcctgcgcttctctgcgtgcacactacggctggtgatgggagcgctggaaagctgaagacgcgagcctgcgctcaagactacttgtcgttgacatgaactgacagttcgtttgtttctttctacatgcagtgtcagtttatgtatggccattgtgctcagccactcggagaggatctacatatataggagtatatatcgatccaacctatatacggaaacttgcaggcagaatagctgtagtatcttttctttagctgtacaaaatatagttgtcgcatataaatagacagcacatgtaattttggtttacagtagatagcaatagcctaaagatatttgctagctaagatttaataaccttccaaatgagtcgtcagttgaaggatttcaacaattgagagccgcgccattgatatgtgcaattaacttaaccaatggaaattgatactccctccatcctataatataagggattttaagtttttgcttacactgtttgaccattcgtcttattcaaaaaaattttacaattattatttattttctttgtgacttactttattattccaagtactttaagcacaacttttcgtttttatatttgcacaaatttgttgaataagacgagtggtcaaacattgcaaacaaaaactcaaaatctcttatattataggacggagggagtaataaatatttatcatgttataacttataagaaattaaaccaaaactggcaacactggcaacaatgacggtattggtagctaaacacagacgaacaccatagaagatccaacctttatgatggtaccgaagcatgacatttgtgaatgaggtccagcagaagctagcctacatccctactggttataggcatatagcttaatcggcccatcgactagcgtaattatagtgtatctgagtatcacacttctcttagatctagtacaattacgatgtatctgagtatctacgaccttcgaatagcttggctgtcgcccagtagtatctatacctatgctatagtcaccatgttaccatgcagttaaaacactacaacaaaacttgtaataggagacgcaattatatgtgtcggttcatctaaaacagcacatatgaggcttttcccgctttcccaacccctcatgtggatctaaaataaaaaaatcggcacctataacaccttataagtgccggtttattaaacaattgcgctttagggatggagctgagctgaacacatatttctctgtttttttaagtcttcctcagtctaaagtcctaatcttatgttctcccaaccaccccctctctctcatactccatccccattcgctctctccccacctcaccaagttggcgagcgatgcatgcaacgacgatggctcgtctctcttgctgacgtgacgacgggggttctactacctcggtgacggcccgcctattctcagcgatgccatggcagtgtcaggtcctcctcatgctgccgtcagacatggcctcggctccgtctactggatttgatggtgatggcgatagaattggcacctacgccaaattcagcgggcccaagctcaggggtctccgaatatggccccagtatcatctcatctaccgcaccaagaggggttgccataaccacatcgcctcggtggttaggtccccagatttgacctcaggcaacggcaagacgcaccgtcaatgctccactattgtaacgtcccgtcttcccccaggccgggcccacttacatctgatagctttcataggtcatagactgccctcacagaccaacacatgtcttttctgcacactttgtcctcactcgtgtgcacccggaagaatttcccggtcggtcacccatcccaaattgctccaggccaaaggccgggatgttacaccctcacccccttaagagagatcgacgcccccgtcgatcaaccctaggccaggaacgtcctctcttggctacgcccatgtgtccagtgccagcgcatgtgccatgctgtgtaaccactcccggtcttcaccagccatgcgcaccatgcctgcgcaactgcgacacacgcgccgcgagagtcggctctgataccattttgtaacgtcccgccttcccccagaccgggcccacttacatctgatagctttcataggtcatagactgccctcacagaccaacacatgtcttttctgcacactttgtcctcactcgtgtgcacccgggaagaatttcccggtcggtcacccatcccaaattgctccaggccaagcacgcttaaccctggagttctttggagattggcttccggaaaagaagttgcaacttgttgatatgagtattctattaattctattaagccctaggccgggatgttacaactatgaagagcttcaagggcctcgtgaggtaggactcctccttgaactggccccctccctgttgcggggattccctagcaacaacggcgaggacctcaactgctcaccatcatccagcaaccaggcccaaggcccgattacttcgtctccaggtggtgctctcctttgcgtttttgtcttgggatttctcgatttttgtggaaagggaaatgtatgggagtttgtgttctagggcctatgagttcttgttggatctgaatatgaactcttgtgtgcaatgtagctagcttattgttgttgatgtagggccttatatgtgatgaatgttcttgatttgtttttccatgaaatacaatggacgttcttgatttttctcccatggcttcttaatctatgccatggatgtggatatggggggatgtgctgctcgaagcatcggcacaattcatcgagccgactccctttttttttctccgtcataggcctcacatgtgttgttgtgcctgttttgaaatcgacaccaaaagcatggctcatcagtgccggttgcagaaaccagcacatatatggacttatagaccgacactgtaatagcaggcccttcggaactgcacaacccaacccatccaacagacgggcatacttacacatactatcccattatactttcatcctcacttcgtgtaaaacggttaagccaagagtgacatggttggagagacaagctcttataagttggttctatacttgctaaactagcaagctggtattaaacatgcacacatagctctcatgcgacacgtaagtcttatcctaattgggtcaggatgtaccatacatacataaggccatgaaagactttagaacacgctaagttgttatgaatacctgaattcctagtttgggcttgtaaataatgaaatggcactaaatgtcttggtaatgagatatattatcgctattgggggagcggctttgccctcgtcctagggaggcagttgcccccttttcttctctcttttgtctctgtctgtgcatctcaagaccggcttcggacaaggggcccctaagaaagcctttggaggggctttggggaagaaagaggccccccgtaacccataaaaatgcctcggagaggggcaccctgaaggagcctacggggtggcttccccgacacggggctcccaaataaggcattccccacggtggggagatggcaacaacattgatggggcattcaaagggcaggctcaaccactcctgacatccacgaggaaaggccctaagcaatgtatacatttcgctctttttccttgtgctcgatccctattggattctattccaacataccctattgcactctttctccttgtgctcgatcccttttggattctgttccaacatacctccatttattaaatagatgacgtcattgacttttagacacacatttgatcatttataatattaattttttacataattataatttattttgcagcgagttattgtgccactaaaaagtattataaacatggtttatatcttatacatttgcatacaatttttaaattagatgaatggttaaatatgtgtccgaaagttaatgatggtctctattaataaatagaggaagtatatgctatgtaactttactttagcacacggcagtatataggaatctactgaaatgaattaaggtcatcacacacgaaatttcgattactgatcagtaccaatggcagctgggatcacagattagattcagaacaattatactaattcagagtaattaaggatataaaccttcaataaatagaaatccttatttatatagatcaagtaacttgcactggaagcacaaatttcttaactgtaatagatcaagttatggtaaaaaaaacgtaagttatatacacacactcgcgcgtacaaaaattaattttcacccaagtaattaattcatcagagaatatatgcaggacttgagttgcatatatactccctccgtcatctaatataagggattttgacattttgcttgtcctgtttaaccattcgtcttatttaattttttttagaattattatttatttttacttattttattatccaaattactttaagcgcagcttttcgttttttatattttgcacaaatttttttaataagatgagtggtcaaatagtgcaagcaaaatatcaaaatcccttatattaagggacggagagggagtagttattattttcagtttttcaccctgataaataaaaaatgcagaatcatgatgggcaataatgcataatgcacatctcatgcaaacactgcggttgtcacaaaactaaaccacaattaacaccagtacacacacatgtacactaacccatatatttatcgatgcggttcgttagccatatgattcccctcgtaactagtaccacatgatcgactagtatgcagaatttaagtatatatatatatatataaataacgatgtcttgcttaattttgacacatagtagaatttaagtatgcagagtatagctagctagcacttagggcgctccctttgacatatactatgcaggaatggtaaaacacataaatagaaaaaaaacacaacattttgggacgaatgcatatgcaaaacggatgaatacacaaaacatatatatagaaacacggaaatgggcgtaaggtgtttgatagactcttccaattagaaaaacatatgatttagattagagagatatatagactcaatagaaatcggaaaactccaattcgtttcttaaaagattaggtaagaatactctataggattaaatcttaaaaaatttcttcacataccatttgtctcgagggaggtcttaaaagatgtttctgctgggtgctggttaagagagacagtttacacttttacagccgcctgccatctctgccatagtagttcaaaggcattgatcagataaggaagagtactcgtatatatatgcggctatatacgcgcgctgcccaggcaggcagcacgccaaatatgcccgtacctcactattactacacagtgaaaccagacgttgcagagcctgaagaaagccccccacttctctgactatctgaacatcacccatgcataagctcatcatcgccctcgctctcacagtcacatgcatgcatgtatgtgtgtacgtatatctgcagttatgcaatgtgtaactggcccatgcatatgtactatcagccagggagaacaggctcgatcttttaatgctactttaatttcattattttttttatatactgttgctatgtggatatatattgtacacatacctgtatcaatatatgcatcagtgcatgtgttccctccgtacgttttagttgcaaaaagaatagccaaagattaacattttgttttatattccaagtttcccatatttctcttctagatccctccaccatcctccatctttaattacaattttatacacacacacacacacacctatcattaactcattatgtatgcatgagatgatgagatattattgaggaatgctttgctagattatctaaattgaaagtacagttgtcttggtatatgcatttttaaatggcaaaatttgccacaggacatgcaaaaaatgtgtaattggttgtaggacaccggtcgcattattttattatttccgggtcaaaagaggtgagatatttttctaaatgcccagattgcccttctctttccttccttttctcttactctgtccttctttcccccttcttgttgatttcgccgggaacggcatagcagcctcaaagcagcggtggggcgaggtcggcgcggcgtggtgcggaatcaccagcggcggggcggtcgatggcatggcgcgaccatggaggagtggtgttcggccagatcgatagcgggcaggcgacgacagtgccggtgcggtggggcgcggccgggaggcagcaccaagcgtaggcggggaggctacgatgggtcccggcatcaccaccgctacgatggccagtgcccttgctcccttcggtgcgcttgacgagtgccgacgactgcggcgggttcagatcggcgccgacgaagaaggggtgcgatctccctctccggtgcaccatttttcggggtccttgaggggagatggagaggaggatgaggcgaagatgctggcgcgacagcttggcccggcttggtccagataagtgggaatgtcgatgatgtcgctgcggcggtgcgcaaagcacgctccagagctccggtgggcacaacagcattcccgtcgattggctgcacgaatcgagaggttgtcaaagcaagatttgatcggcatggagagaagataatagaacatgaattagataggaacggagatagctcgttggtgatcagcggcgtcctccttctcagcggccgacgacgaaagataggtggagagggagagctggagctctcttcctcggtttgctttgtgtggaaatgaagtggagtagatggtgatgcagtagggacgagatgaagactcgcctcagcattttgaggcgttgacacgtcgtgcacacgcgtcgaactcagccggcgccgatctctctctcggctgtctctggtcgatctctctcccatcgcgtgctagctcatgtcgcttggcccaacctcccccaaacacgacgagctgaggaggctattctccaggttcggcaagatcgagagggagaagaagataagggcaaaactgtcattttacattgtttctctctcatcaattgaccgaatattatattttaatgtgtccaatgtcctgtagcaaattaccacatttttggagtgtcctcgggcaaattcacgtctttagggtgttcaacagctaattacacattttttgagtgtcctgtagcaaattttgcctttttaaatttgtcaagggtgtatcacagagctttgtcaacatagatcaatcccacttaagtgccatacacatgcatgtcaatgagaaatcaatatgtgatctataaaaaaattctatattccaaatatatatactttcttgatttctcaagtgtaattagatatatttgtgcaacatgtcaatcagctctgcaatgaagtgtttgttctcaattaatccctactcc

SEQ ID NO: 12368 - DNA, 3786 bp, Oryza sativa
  unsure (1)..(3786): unsure at all n locations
tcccttatatttagggatggagggagtatgtcccaaaataaattaacctagtacggaatgtgatatattttagtactacgaatctggacagctcataaaatgtatcacatcccgtactacgttaacttattttgggggcagaaggagtacgattcctcacatcaacaactccgcacaactaaaactaaccaaattttagcaatatatagtgcatgcatgtattgtagtatagatgtaattcatgagttaatatgaaaaaatataacatacataaaatatataactaacgactttagtgcgtcacttcccaattgtgagttatttttttaactgccgccttactagatagctagccctacattatgatgtcatctcagaaaaatcatagcaaaaaaaaaaggttttcgaatagactatatatatgttagacacaacgtaaaactttcaacatcttgttgttttcttgtggactttaagtaccttcattttttttacaattaattgtaccttcttgatcaatatatatttgcttgttaactaatctaatgattaattagaaatacatgcatgcataggcgttcccatattatagtattgattaccacgtgaacataaaagtggaattgctagatttcaagtgcctaaaatttcacatatagtacctaaaattaattgcagtgctatgcaaaatgcgatttaggttcattttaactacattatgttgttatatatatggtttgaattcatttttgtctatatatgtttgaattttctttcatgtatcttaatttgtaatgttttatgagttatatgaatttatttgtatttttgtatttttttcttgtttgttagaataatttattgttcaaccattgggtagttgtaagtaccactaagtaacaggaatgtaatggaaccattggattattatctaacaagggacgataaaagtgagtggactttttgaaaatttcaggcgcctaaaatctagacactcacgaaaaaaataattacacaagggcatgatgatttactaacacatcttgatatgttgttgatcatatgtaaccataatcaactcatgatcactcatcatgtatatccaaaatatttggccttttagccctgtcgtaggttttaatttgcctagtagtactggccatattatatatctacatcttcatataaaatagctcactagcaagataagtatatatatggacaggaatagagctagacaccataagttgccatttcatcctggtaaccgggctatatatgtaatatggatatttgtcaccttcacaaatacaattattgtgtcaatcagtaatatgctataaattcattggagtctgttgtggaccctaattacaactgaacaatatatagaagtgcatgttactatgcagcctatttaaacttaaatggggagaaataaattaagatagagttaataaactagggagaaacatatatatataaggagactgaaagcaaaaaaggaaaataattgggcttagtgggactaatgcccattgaaagaagcaagaatcaccctaaaaaacaaagaaagaagcaagaatcaattggaaagaggtaagaactatatattttcactcaaacaaaagctaattaaactatatgcgtacggaaaatatatgtctagatataccatggtatgataaccttgctggaaatgaagatatataagatcaatgttctgatccgctcgatctcaatttgcaaaatattggtcatttcagtatacagattcacggaacaagaaataattaagctatgttttgactatagatactcagatttatatacttgatataattatgttccaaggaattaattagttctctgggagattggcaacactgtcaatctatggagaaactttgttcagcataactggggggggataagagatgtaatagaagcttatttatgaagaattaatggatcaaattagacatctattttcatcatgtatattactatatatattaattacctattattctcaatctaaatcatatatatcattagatatagagatagtaaactagagtttatattagaacttaagaaaacgagcaagactagctacatgtaaagttttcatgctaggtgatgcagataataattaagaaaaagacgttctaatttcaggcaagatgctacattttaatttctgggcttagctactcaagaatagtacctgtagtccttaattagtattaaactttcaattcacaggatagataggaccaaccggcaaactctcatcctagctagatggatgttcatagcctatacgaagatcctcaaaaagaagctaggcagattccctcaaaggcatgctaanngnnagtaggagagaaaacttaaccatgagctatcaaattgcagccaccatctagagggtatatacatgcacacatatagcatggactgagcttgggaagcaaaaactgaagcaaagcagaagaaagaataagcagacgacagttacatgtaccaacacacctcccattcgtcccccttttgttttgcgaaggagatagtagaagactttcctttctcttttcaacttcccataacgtactccctctccctttcccctttcccctttcccaatcttacaaatggaccaaaatgtactcccttgcaagctagctatcctcatcagcatcaatcaatccatctctattctctgaattccaaacccttccagtgcaaaacaaaaaccgaaatgcatgcgcctactctcttactacagatgattgctagttatatatcgacaatgcatatgcatctatatatctagccaaggccggctcatgtcctcccttttgctcccatcactctctgaacacacccacaccgtgcaggccagtagtcctagctagctacactacactacacttgatgacttgatcagtgaaaaggaaaaggggagagagagagagagagagagagagagagagagagagcatataggggagctgagatcaaaacagcacaagcgcacagccaagaacggaagcagctaagctagctagcagccgcagcacaacgacagccaacaagtgtacacctcctcactgtttgctactcccaaatcaacagtgatcgctcgtactcgccccataaattctcctagcgggacgtacaaggaagttatggccagtgagtgccactgcatatattgtggcaatattgccccctctttacagactgccacggccataaagatctcgtggactggtatactgttcgcgctcaaggcccagacaatccaaactatacgtaatctgtcccactgccatcagtaaattttccagtgtaccccgctaatcagcaacagaattatgcgtaatctggtccaccctgcatcacttaattcagtgtcccccgttaatcagcaacagaaaaatttaagacatggaaaactcaacaccgtactggatatgccagtagtatatatatcccccatatgctgctactagtagctagctcagtactacactctataccatgacgttacttatacagatatcatacatccatgatatatatacatgcagaagagagcgacagtactactgccactgtagcaggggaaaagcggcggcaaagagggggaaaaatatatagaagaggaatgtacgttcacgacgactttcactgtaaatactgaaattatggtacagtgaatggaagagaattttgagacctaacctgcaattgttgctctctggagctgtttgttgt

SEQ ID NO: 12369 - DNA, 2691 bp, Oryza sativa
aattaagtggcccacaaaccaaaaatgtcaaatcctaatgctgtcatcaaatttcaggttataatggaatcacaagagaaagtgagatcgatgttgctgcgagaagaagaacaaaccaaatcaaaacagaagaagaaaaaggaatcgttgatgaactttcctttgtttttctctctttaggtcgctacagatcgagatccaaggccgaatgcgcgtccctcttggaggaagacgacgaccaccgagacgatgcagcggacgactcggcgccatggtggtggtgaggaggcaattccagcagccgcagtgttggatccctcctcatccacgcgggcgtctgcaatgacagtgcattgccatgattgctcgactcgcccgcagaggcgccgccgccgccgccggcatgcgggttgtcgaggttcacgccgaacagccgcacgcgcttcgcggccgtcgtggggctctcgatgaccggaaccgagtcgagcaccaccggtgagcccgccgcccttacaccatcgccgctcggctgcagcgtgtagtggtggtgcagcggcgacggcgcgcgcgccagcagtggtgcttgcggaggaatcctcgccgagccgaacaggaggacctgcctccccatcgcggcggcggggttgaagcgcggaagtcgaggccttgcctgaggcggtgctcgtagagcgtggccggcggcgagggctgcacgaagaatccccctccgccgccgatcccccacggggcgtagtgcgacgtgagcggcatcgggagcggcagcccgcggggcagccggagcgggtcgcgggtgtcggcgcggcgcttccagtcgatgaagaggcggtgccgcgccgcctcgtcgccgatgccgcgggagaaggagacggtgtccccggcgtcgaggcgcttctccttgacgaagcggctccaccccttggtcatcacgtagctctggctgctgttccagtaggagtagcggaaccgccatggcttccccgcgcggtcctcgaagttgagcaggaggcccttctcgttcgccgccgcgtccagcgggaagtacttctcggcgtactgcttcgggatcaccagccggttcagcttcccaacgtcgctcggcgtcaccaccttgtcgaacatgtgctccttctccaccacctccgcttctccgccgccgccgccgccgccgccgctcccagacgccccggcgccatcgtcggagcgaaagggagtgctgctccctgacgcagacgccgacgccgacgcggaagccgcgtgatgagcaggagacgacgacgacgacgtgggcgcaggcgcggcttcggccgtggccgtcatgaaggggatctctcgccttcccgcctcatcctgctcctcgtcctcctcttctttagaaaacctactgcttgtagtgaactccatagaaaactatcactatttcctcaaattcttggctgtatttcttgctcctctctcccaactcctccttcttcttcttccttcttcctcctctgcaagatgttcgaggataggcactgttacaaagaagtaagctataggatactagagagggggatatgatctacctatgtatgcgtgtatgtattgtattgttgttcctatgaattcctattgatctcgagctgtgtttggaggaagcaagccaagctctagctagggagagggagaagagcagagagaggaggaatcagagcggtttgcattgagtcttgtgcgcttctaagctatggggaattggggatatggtgggaagagagagagagaaagtgaccatggaattggatgtagatcggtggttcttactggttatactactgacactgtcatcgaatacgtcactccgtcattttctttctccattttttttgttcccaaatacaaggcattcataagttcaaatacttcgatgccattttcatccgtacaaatgatcccaggaaatgtctgcacgtgcatattttagtaagatattggaaactattttgatatgattattcctcgatgggttgtcctctcatttgcttaaaaaccatccaaatagttatgaaaaattctagaaaaatttgataaaaataaaaatttggcaaattaaggtcccttcaaaaataaaaatttttttgtggtacttaaagaaaggtgtcattcttactaaagataatttagctaggaggaattggcatggtgatttaaaatgcgctttctgtcatcagcctgagtcaattcaacacctgttttttgattgctatattgccaagttcttgtggcgagcggttcatattttgtttggtataagtaccccatcaaacttagttgagttattccaacagtggtctaaggggggtaataaaaaacaaaatactttactgttaactgcagcagcagcgcttttctggacagtttggttaacaagaaacgagttagtgtttgacaattacggaccgaaatcttttttgcaggtactattcaggggtacgcattggttacgccaatgggcgaagctgcaacggcatgaggatctgcgttcacagttgatcgcggcatggcaacatcttgagtcatcagctttgcaattttttagttccaatggatggttatcagctagacacatcggtctttagtcgtctgaacttttatctcggttttgtttccaagtgatactctgtaagaacg

SEQ ID NO: 12370 - DNA, 1544 bp, Oryza sativa
tatggttgttgttaaagagacgacacttgtatacaccttttaatctagatcatcatctaaccagactggccatgcattcagtcagagtcgttgcccctccatttttggtacgttggagctcgcatgctcctgggaccatatatatataagcgccttgtcagctagatgctcaagttcacttgctaatttaagcggccgggaatattatgcagaggcaataatgattaactacaaccgagacagtcgcctgctgttctttcttcagttcgtgtccatggcgatgcatgtttttttttcaaccctggattgcctttttgttttaaaaaaacaaagtagtactacctcttgattaaaacaggttataggatgaaatcggatttataaaaaacatatatctgctgcgcgaaggttatagtgacaatatgctctgtttgatttattctggagtacttgccaggcactgaaaaacctgaagtacttcttcagtcgttttgattccaagcgccagagatatatttgtttctcccttctttttttgaactacattatctttataggactattgagatatccatggcggtgacaggcaaacaaagccggcaggtcagcatcgtgttaggatcttatcagacttaacctgacagagtaggaccggctgccggctgacggctgaaataaatcataaaaactatgtaccagattacatgggctacagtacacatacatgccaattaaggtgtacaggaactgcgtactaggtctagatccatagccagagcactcgtatagtttcctaaattgtatggggtaccaataaattaaggctgctactattacgaagcatgatagataggacgaaaattttgtcttacatgtactgcataagcacattattaatatcagttgggctcttggcaagtgtaaaccgtaattaattaatgtatctgattgctgggcaagggcagtcttaactgttactagtctagaacacaggatatgcgtgataatgttataaaaccggccccgaaatcacatcggaaaccaaatcgtgaaagaaaacgtcatagaacatctaaacataatgatgataccgagacatgatatttaataacggagttcagtcgaggcctacatctccaggacactaattacgggcgctcctctccccgatctagcatattacagtgtatccaggtatccacgaccctccacctgctaggtcgtcggctagtcgtacccacacacctatgctattgtcgtcttacggttacaacagatatgtccctctatttaagagagtttccaggatagagtccgattcttactctattcctatacctagtacaactccaagtcctaaactgtaactgatcacgtacacatatttgacacaaactttaatagacaatgttgacaagaaaaaaaatgttgtggatcgtgtcgcatacttaaaatatattaacattatttctatgtaataaattcatgttttcttgggatataataatttcttttatatgctagaatattcagcaattaatgac

SEQ ID NO: 12371 - DNA, 4240 bp, Oryza sativa
ccacctcaccaatagtacaccctaaattaaaatgagactggagaccaaattaatccaaatggtacaaggtgaaagctaagacagctaagaggatgaaaaagtgcgatggcattccacatgggcaatgcatcagctctgtgggaagcctagtagacatcacacatactgtggtggtcagccagcgtatgttatggggcgggggtgacaaactgacaatgaatttaattagagctaatagtaacgggaaacatcaggatttgaccataggattgtgggttatatagggacgaggaggatgactgaatttagagctaatagtgactaagatttagctagttttcaagagaaagatggacacactcccttttttaatttttacttggttttacataataaacttagtattgttgaatagtaatttctactcttttcaacccaaaatataacaacgtgatactgaataagacatatcctagttctatgaatctgaacatgagatatatccagattcgttgtactatgatatatctcatccgataatagattgctatatatattgggacagaggtagtacttgaacgcggatgctttcaaaccctcatgtgaaactctaacaagataagataggtatatcattgaccgatataataggaataacacgtgttggctttgtttaatgtttttcccttcaacagagccagctgaaaacaagtgtttgcttacacaaatgatgtcagactaaggcacgtgaagatcatgtaagatcaatgtgtgttttgatttttattctgtgatgaacaattggcatctgtgattattggttttgatatttggagattatcgtcgaagtggttttggagataatcaattttcaggtgatgatcagattcactgttattttatgtgaccggtctgaccgggctgtgtatgccggtcagaccggcggtgatctagcggtcagaccggccggcccgcggtctgaccggccgacgctgtgtcggtttcggtttcgggttgtttctttggatatccgtgattgtttcatggttatggcttctagatggatactatacgtatgtaatactgttgtttgctaacaatgagtcaagttggtgatagcttggtctcggaatatggtttctttgtttgtttcatgtgtaggtgactcgatgcctcgggagagtatttgcggtgatgaaccgggagtcggcttggtggtaagacgatgtccgtggtggtcagatatcatgcgggatactaaggctagagttgatgcacgtggttggtgaagattctatatggcatacgatggaggtattgtgtgcgtatgggatgcggagtcgaatttggaaggagtccaaatttggtacaattggttatgtaaagtttgtatcttgtactagaggatttcctaaggtgtttaggactcttagtatgagtttggttcgtggctttaggctgcctacctcatgtataaatagagggggagcgtgaggcttcccggtatcgtttttgtatcgcttttgagagcaattgagttgctagtttagtcagggtttcgagtttagtcgaaatttttgtaaggagtgctgttggtgcactttgtaaacacagagagaagcaataaagttgttatctactttaagagttcttcgatttgtgtttcaccgggtttcggcggtctaaccggcaactcaccggcggtcagaccgatggcattgtggcggtcagaccggcggcggcgacagcgagcggcaggcgactttggcagttcgaccgatcattctacatcggtcagatcggcggcatccactcggtcagaccgacagatcaatctcggtcagaccgatctccgtcgatttcgagggtaacttttatttccgctaaaagtttttggtttttgggtataccaaccattcacccctcctctggttggcttagttcttgtgattcgatcctacagatccttttcttgataattagatactaaccttagccacaaattattaaattccatgtagtagcaagagtgagagaagtgggcacccagagagtcacatgctcccttgacatatgcatatcaaatcaaaaccatctgagaagcatgttacatatctaccactgtctctgctctgctcaactcttaataagataggcatgttgaacagttgtactgatatactacgattctacgaataattaaagtttcggggagagctgcatatatgcggtccaggagctagctagatcgatatatagatatcttgaactcggccaaccatctctctcactgatctctcttctcctagctagccttgtgctgatctgcctcccatttccccctcaacttttgtctctccacacatgcgaaggcacgcgtattgcacaagtgggaacgcacctgcctttctagccacactagtgtgtatcgttagggttttgtcggtttggaaagatgcctcatcacatcagtcatcagcagcagatcttcaacttggtgactactgagaaaaacctgctcaccttatacgtacggatcagttaaaggtagtttttgccagagagatggccaaatgagaaccaaattctactactactgactaccattagggaaatttcaacctgtttatatacatatggtggacgaaaagggggaaattgtagtcggccaataagaatggaacaagaagctgaaaaatattcgcgtataagcatggttcagcccactactaattaactgatgtggacctatatttgctgcactaacgaccaagctacagcttaattagcaccaattatccggaaattaataaattgcaacctaagcaataggaaggatatgcaagacatttagaccagtatataacataattcctccggttataccccaaaagatgtttttttaattatacttttagaagtttataagatatacaattttgaccacttatttcttttgcataaataaaaaatagttataaacatgcatggagtatcatgaatgtttttcttatttatataaaacttaactatgtcatttgcatatacctacaacttgcataaaaataataacaacgttcaaaattaacttatgtttattgtaagaattttcaaaaaatatatatattttgaccaaatggagtagtttttatgtaaaataaaacgtcattttttttgtagaaatctagactaaagtatttgcttgaacataacatgtgtaaagctttccaaaatagagtatatgcaaaccattaatagattaatgtcataataaaattttgctccgctttctcaataattttgctccgctcctcttgtcttcctgcaactctagtgcacttattgtgacgttggatctgtacgtcgtcgcccctccaaccctagagacctcaatttggcatgctttctgaagttcaggtcgcaccgtcagacatcggtgagttcttacgttgagatccaatggctagggaacttgcatttggggaaatcatagtaactttatatatgagcatcaagcttgcatacatattatgtaagtgaccttattgtttgggggtaatattgcatatacttcatgtagaaaatctttgagattttcatgacatcaatatgcaaatatatatggcaaaagtcaaaaaaaaaggccctaaactttggatgaaagtccatctagcaccatcaactttgaaaccggacattcagccccgtaaactttacaacaccgtttgtaaaaccccctaagatggttttgcatagtggtttttatctaatttgtatataagttggatgagtttaatcacatgccatacactttggacatatatattaaaatttttacttagatatttcttttttgctccttattagctccaacttacaaacgagtaccaccataataatagtatgatatcactatataaaaataaattgattatttataactgatgatatgcaaatatgttatattagttatttaaaattgtttgtttaagctttcaagatatacaaaaccatcgtccaaaaccacattaggggtaatatatatggatggtatggcaaagttcgaggggatggatgcccggttttaaagtttagggtgttagacggactaccatctaaagtttaggagggtatttggactttttccaatatatattgattttaggttatactagtaagttctcttgaacgtatagatacatactcagtactatatattgctgaacatattaattaatta

SEQ ID NO: 12372 - DNA, 3891 bp, Oryza sativa
aagtgtccacagcgcaaggggatgaaggcacctgcagggcagacttctaagtctgctaatgtgaccattggcaacactggagatggaagcgggtatggtaatttacctactattttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacgaatttaagatggtttttgagtctaataaagtagtcgtgtctaaacatggatattttattggtaaaggttatgagtgcggaggcatgttccgcttttccctttctgatttctgcaataaatctgtaaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtgtggagagtttttctcgaacaagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaagctgtccgtagtgaaatggattccattatcgctaacgggacttgggaggtgacagagtgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaataaggcagataaatgtgtgtactatcgccatggtaggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactcttgacggagcgtggggctcctcaccgggagactgcgcaggcccccctttgccagttcggccgggggccctgggtgagattctaagctcctagtctgtgtgtggaaggttcgcgagaatggaaacacacaagacacgggcgatgtatacaggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggaaacttgtatggttgccgtccgaatgaccttttgatgggacggcccatacctacctccacttccgtcggaagcaggccccacgtgggaacatggctgtctgctgactacatgaccactgtcaaaccggccacaaatcggtcattcttgtccaccaccgtaagcttatcaatctgcatgtcccccctcttcatacaaagtcttgcttgcaatggt

SEQ ID NO: 12373 - DNA, 14031 bp, Oryza sativa
ccccccccccccccggagggggttaggccacgtgggtgatcgtgtctgcctcaagtctctaagtcatgatactcccggtcccatgtcaccgacagtagcccccggcgttatgccagggcgatcgccctcctcgagggaagcggtcgggggtgacgccccttcctaaggcctggtgacaggtggggccggtccaaaaatcgggacaagccggttcgtttttcctggagatatggtgatggcgcttcggtcggcgagcgtaattaacgcgcgcacgagatgttccatctcgactgccacggccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcatcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttccttcctttcgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccacgggggccggtgctgaaccgctacattccctgcgtcctccgcaagaagtgggatgactggaagagcgactggttctacacccccctcgccgacgaagcgcgcctccgacttccgagctagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactaggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggtgtcggaggagcgggctcctcgaggccacgatggcgtgggcgggagccgcagggggaacaatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaaggtgggggggacagaaccatcccggggaaagctcatttcccctccaaggtggtcgtttaaccgaccccctcgcaggttcgtcccactcccatcgtggccgtattcattctctcaacgcgagttttcactcatccatcttgtttgtcttctggtctttcttctgtttcagcgagatcccgtcgcgtccctcccgccattccaagtccggccagcctgaggccgaggacccggcgaccatagaggcccggaggcgggaatctgaccggcgagaagccgcggatcgccttcgagaaaccgaggaggccgctcgggaggccgcccgggctcgccagaccgaggaagccgctcgggaggaggccggactccgccaggccgaggcgacgacatcctccgaggcgacccgtgaaactgacgggcaagaggccgcggatcgccttcgagaagccgaggaagctgcctaggtggccgtccgagctcgccaagctgaaaaacccgctcgggaggaggccagacttcgccaggccgaggcgacgacgacttccgaggcaactcgtgacgaggccgcgggcgcatcgcttgggcccactccctcgtgcgacgctcagatcaaaccaggtccgggggacatccctgagtccggcacgtccatcggcgggccaagccgcgcggcatcctcttcgaggcggctcttccccacgccttccgttgctccactgagcgcagaaccccttctgcaggccttagccgtcgcaaacaccacagtgttggacgggttaagtgcccaggtggaggccctgcaagcagagcgggcggagctcgacgccgcatgggtgcgtgtcgatgaggggcgacgctcggtggaggccatggtggaggtgggccgcaaggcacaccgccagcacgtctcagagctcgaagtccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaaaaaactcgacgcagcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgctattcgggaggtcacactggcggtgcacgaagccgcctgtgccgaagaagagtccgcgctccgcctccgcgaggacgcgctcaccgagcgggagcgagctctcgaggaggccgaggccgcggcgcaacggctggcggacagcctgtccctccgcgaggctgcgcaagaggaacaagcgcgtcgcaatctggaaagtgcccgcgccgagagggccgcactgaaccagcgggccgctgaactcgaggcgcaggcaagggagctggatgcaagggcgcgtagcggcggggcggccacgggcgacagcgacttagccgcccgcctcgcagctgccgaacacaccatcgcggatctgcagggcgcgctggattcgtccaccggggaggtcgaggcccttcgcctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggaactcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggtgacccgggtgcatcggagtgagcccccaggcccccgccaatctttaaatagtttcttcttttcttcttccgagtccttcgggcccccttcttgtatagactaatttaatctgcaatcaaataaagaggaaattttttgtgtcaattctatttgttgtgtgtatgagacgaggatgcctgtgccgcggtccttttgtgtcttggcttgaacaagggctcgtgcccaggtcctagtcctcaaatggctcgggttggggctagtgcctggggagatccacatgtcgagactggccaggccgggagcgtggtgaccgagggttatgggttacccgattgtgggtttttgccgattcccccccggagttcaccacgccctggggcacggctcggttctgggccccgtttggcgattttagccgacccgagcccccgagggcaggattgaacacgagtgacctatttcaagtcaatatccttcaaaaggaaacaatagcacagatacagcctttaggaaatcgaaaatgcttttattgaaatacagatataagagaaataagaatagacatatgtggtagcccccggccaaccctgcacgcccgaggggggtgcggggttggcccaagcccgaaacctgacacccgatccccctttaggggtagaagcgacgaaggtgttcgatgttccacgggttaggcagctttgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatgatagcgccgtaggctctgctggtagcgcgcggctcggagggccgcgcgccaccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccacgaaagtggtatgatctgcagggcctgggccggctgatggatttgcttggcgtggaattgacacgctctgcatcgccggaccaggtcgaccgcatcattgagagctgttggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggcctgtcaggcgcgtccgtctcctctaaggggtcgggtcgcgccgacggctgggcaagcctttcttcaaaagcgcccggtggggtctgggctcgcgaggaagcgagccgtgagagttcgtcggcaaccgtgttatcccgtctgggcacgtgccgaagctcaatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagatagggagccgtcgaactgcatcacccagtgggcggtgtgaggcagctgcgaggggcccgagctggcctcggggactgagacgggctcgagagctggggtccattctgccacaaaatcggcgagggcctggctcttgatagcgtggcgtgggtcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccaagcggcctcgcggggcgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgtttggctcgggggcctcttctccctgctctctcccgggtcgagtcggcacagggttatcctcggggtcagagggcgataggtgcggccttcccgcagtggccctctggccatcctgggggtcgggggcacctggcaccgtctgacaagcgggcagagggcctgctccggtcgtcgggggccttgggccactgttcggctcgggggcctctcctccctgctctctcccgggccaagccagcacagggtgggggtgcgcggaatgaggatcgtcctcatcgcgctccacaaccaacgccgcactaaccacttgcggggtcgccgctaagtagagtagcaagggttcatttggctccgaggcgaccagaactgggggagagctgagatacgccttcaactgagtgagggcacgttcagcttcctccgtccaagtaaatggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttcttggggttggcctcgatgcctcgggtagagaccaaaaacccgagaagcttgcccgcaggtacaccgaacacgcacttatcggggttcagttttatgcgggtggagcggagactctcaaaagtttccgctagatccgagagtaaggtctcttggttgcgcgtctttacaaccaagtcatcgacataagcttcaacattacgtcctatttggctacccaaagaaatccgagtagtacgttgaaaagtaggacctgcattatttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggcattgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttaaccgggacctcgtcgcatgtgactatccgctgcctcggggcggcgggggcggaggtgccaagcctctcgtcgcctccctcgggcttggacgcggcggtgaggtggtccgcgcgctgctccatacaagcaagcgcgactttgaggtcgccatggacagagatggggccaccggggcccggcatcttcatctggagataggcgtagtggactgccgccatgaacttcaccaacgcgggcctccctaggaccgcattgtagggcagactgaggtccgccacatcaaagttcacccgctccgtgcgaaagttggcggatccaccgaaggtgaccgggaggtcgataggacctagcggccaagtgtgacccggcgtcacaccgataatcggctgggacggccggagccccatccccggggccttgatagcgtcaaaggctgcgggggaaaggatgttgagggctgctcccccatcaatgaggacacgccccagcttcacgttgcaaacagtgggggaaaccaccatttcgatctgtcctccccgggcaacgcacggtgggtggtcggtctggtcaaaggtgagggcaacctccgaccaccgcgtccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaagttttgactgcgcggcaatccgcgaggtcgtgaagggaggtgttgtggacgatgcaccacttgccggttgggcgctccctactgggagcgccggcctccttctttttgtcgctcgcaggcctcccctttcgggtggcccgcgaaacgccctcgacggcgaggacatgaccctcgtcgtcggaatgggctgacctcttcttcctcctcctgtcacgccgccctgtccgagcagcggatccgggggcggccgaagctgccacactggaaccggaggggttccaggtccatgcctcttccttacgagccactcggtccgcgtgctgaaaaagctccgcggtagtctggggctctttggaggcgatcttttcgagcatgcggttgtgccgcacacccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgatcctgtcgtcacccccggcggcctcgatcccggtcgtgtagacctggagaaactcgacggggttgacgctcccgtcatatttttcggcgatggtgggccggaaccttgggggccaatggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggcaccccacgcagatcttcctgggtcggaggcgttgacgaaggagtggcggccgaatggcgagcaaccgccgccgctcgccgcgcccttcgccttgacgacacggagccggtggtagcagcgccagaggttttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgactctctcgagcgcctcctcccgcctaggactttggcgtggagggggcggtggagtacgagctcgacggcgtgggttcggctccccttcgtcaccgctaacactcggagagaggttgtgcgcctttgcttgttcagccattgggctgaacaggaaaagcttggcgcacacgaaagagtgcgagagcttagaagaacacacgtagaaccccctacctggcgcgccagatgacggagcgtggggctcctcaccgggagaccgcgcaggcccccctttgccagttcggccgggggccctgggtgagattctaagctccttgtctgtgtgtggaaggttcgcgagaattgaaacacacaagacacgggcgatgtatataggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgtcggaagcaggcgcgacgtgggaacatggctgtctgctgacgacatgaccagtgtcggaccggtcacaaatcggtcattcttgtccaccacgcgtcagtttatcaatctgcatgttcgcccctcttcatacaaagtcttgcttgtaatggttaggatgaagcctggtatatatctgaccgggaccaacgtgccatctccaggagctaacacgccggctccggctagggacgagtgattggaggctctcatcctgacgggatggggcgaggcgtgcgtcagaccgcctgtcaccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccacaaggggtcggggcgcctcgaccctcggggctgagacgggagcggtccgacccctcggggagacaaagagaagggcggccgtatcaccctcgggcccgaccccccccccccccccccgagggggttaggccgcgtgggtgatcgtgtctgcctcaagtctctaagtcatgatactcccggtcccatgtcaccgacaactctcatgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttaagtgaaacttgcttgcacaagacttacaattcaaggcgtagtccattgttcaagttgtgagtaagtgtagcttggagttctaggtggatgttcaaccttaattggtctccatcgaaccactggtatataaacagtacattggaaaaggcaaatctcagtgggattttgagatttggtgggggattgttggaattaatgaatgggccttagcccactcgaagattaattctttggaaaatcataaaagcccacctcatgggatggcatgcatgtggagtttagtaccaccttgcttattctaggagagggggacctccttaaaagggatgatgccctcctagtcgcttgaagcatgtgtggtggagagaagaggggaaacacacgcgcgcgctcgctcgcctcgcctggcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcagtatatatgcaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatacgtgtaccgctcctagccatacccgggacggcagctgcccccgcgccgacgccgtccgcgacctgtcacccaagcgcgcctccggtggtaggccgtacccgcgctggctgtgctggtacgaggggccccgccgtaccagcacggcagtcgatcgccgaagtcggagaagtgtactccagctgctgcctgctgcgccgaaatgtcaaaccggagtcgagcagagctgaggagagagagagagagagaggcagggcgactcttgcgttcgggaagaggcactctgccacgctgcttcaccttcgcgatcccatggctgatcagcaagagaagggtgcaaaatgtctgatccgtttagagcggactgaaagcagcacaccagtacgtggcgctgcaagcgtggatcgtcttcatgtcatatactcatatcctgatatccgtggtggatgtgattggtcaggaggaaaacgacgcatgcacagcttgatactgatacagtactgctagtatgaaatagcatcgtatcggagtaagatactatgagattttattttttaaaaaagtttaattaagatttgtattaattacaaatagccattcaataaaaaatacatagtaataatatatatcatgcaaatagagactttatcaagagaaatcacattagttttgatatatttaactgatttttatataaacttaagcatatatatttacgttatttttcaaaccatcttattttaaataatattttgtagaatcgtaagaatcgtagaatcaggatactatctataatttcgt

SEQ ID NO: 12374 - DNA, 3704 bp, Oryza sativa
ctttaaaatgaatcaaaatatattttttaatattccatggcaacacacgggcaaatcatctagttattctaaagttattactaccatattgtatctgaaaagcactctccttccaatcttaaatattattgcgacataattctcactgtctaaagggagggccgaatttattccctttatttaaaagatcacagttcactcacttaacacgttaatttacatgtctatagataattttcttttaaaaaaagataagtacaaatgcatgtgctcacatacacatgtacacgttgtgcacatcctatatctccgagagactggaccgatatatattgagattgacaaagttataataagtgtcttgctgttgacagagacatcatctatcaaaaaaatataattactcagaaaaatgatcacccatattaaatctggaatttaaattggaatagatataagaaatctaactagttgagttatatttgctggtatttatgaatcttgtttcaagtgaacaaagccacttgagacattgtttttaatttgtttaagtcaaatatcagttctaacaacttaggcagaacaaaaatctcaaatatatgagcaattttgaagcttctctgcagttatagcctggtttaattcctaactttttctttaaactttcaacttttctatcacattaaaactaattttctacacacacaaacttccaacttttctgtcacatcgtttaaatttcaatcaaacttttaattttcgtgtgaactaaacacacactatatatgtgaaactaagacgccgtacgtttggtctaatccatgaaggaaaggagaacgtggttttgagctttcatatgccaaatttgtcactatcgactcacggttggtgtttgaatgtttgttaggccacagcaacagaaaagggccggcaacttgttcgtaccactctagcctagtactccaacaatcttactccatctattctaaaatataagtatttttagatcatggcacggtcttcgagatgctatattgaccaacaatatttataaaagtaagatattttaaataaaaatagttgtatattatgatagtttgtttattgataaatctagtaacatcaattttatatgattgatgttctttactctttttttttttgctattaatagtcaaacttaaaaatgtttgacttatcactgtgctaaaaatgcttatattttaggacagaggaaatactattgagttactactggtattcctagtatttggtaggctagtattcataatttcctccgttttagaatatagcaatttaaaatcagatgagacttattctaatcatataaatttagagggagtatatccagattcatgctattaggatacgttctattcgatattgctatatcgtggaactgcggaagcacatggcaattgccaacagcccaaaccgcgggacacgcaagtagtacgtgcttgactacccgttttttttatgtgcatgcatgtgctgttgtgataaaagcaacgggtgcagatactagaagatatctgcctgtaccattcgatatcttggagaagtgccgtttatatatactccaggcagcatcacgaggtgcttttgtttcttcttcagacgtgcaggcgcaaatgggtgagatattctcgacgcattcattgagccgcctccttccggtgagtgggatatttctgatttctcgtcatgttttgatcactgcgtattcggcatgactgcctaggcacgtcttgcttttcagagcgatgcaaactcgcagatggaagatacacgggtgacgggttacggcccatgtttgatgggaggtcaccatttcgtagctttcccttgtgcgttgctcttcggctgtcacctgtcatgcacctgcatcccggatgtgttcttttccactgaaaacggaagataataggaatacgcgctctagctataatttaatgctgcgaaagttaaaaaaaaacgttctgcatatgaatctttaaggtgctattttaattctattttgttcgtttacttcctctatcccaaaaatcttgatgtttttagattcctcagcaaaattatcttcatgccaaaatgattaaattgctcccgtcaattcgattcagttgccattttatcaagtctacacgcactcatcaggttatacagaatcattgcatgcaattaattaataaattctttctaaaacacattgccaaataacttgacggaatagactagataaggggcaattgcaaatttaccactactttgaatcgttattgcaaaactgccactagaaaattgcaaaaatgccactagaactgtcattcgagtggtatccttgcaatattcaaaaaaccggtggcaaatttgcaaatgccccaatagataaatggtctcacttctccgatcaaatttactactccagcgactttttttattggtagaacggctcgtttgtagggtggatgaaaagaatcatcggttggccatattttctaataagttaaaacaactttattaagaaataaaaattaatttattggtaaaaaattgtatatttgctctgcgacttaaaagccaacataaaaaaatacattaaaaatatcttaaaatcaacttaaattttagcttttgctttagcttattaaaccaattgatagggcttgaaatatacttttaatcatttgaccatttagccatacaatgtttccttccattttattctgtccaaaataagcttaaagtactactatcttcgttctactatcttcgttctaaaatatagtttatttttaacacagtacattattccaaaataaagttatctgtttaatacctatctcctcccttctactattcacaactattttccttcactactccctccgtcctaaaatataagtatttttagttatgaatctggacaactgtgtatccacatttatagccaaaagttgttatattttaggacggaggtagtattttctattctcaaccaattacaaccatcctctaattcaaactatattgtccagattaatagccaaaagttgttacattttaggacggagtgagtaacatttttaatgcctatgtcaacaaaaaaaatgcttacattttgagatagttgtagtcctatgatactagagagtactttctctgttttagaataagttaatctagtactaactccgtcccaaaataattacagccgtggatattcgtgtccaacgttttaccgtccatcttatttgataaatttatgatttttttaaaaaaaagtcagacataaagtactattcatgttttatcatctaataataataatactaatcataaaaaaatcaaataaggcgaacggttaaacgttgaacatgaactatgcaaaactacactattttggaaggaataagttcacttcatgaccctcaaaagtgacccgaatctaatccatgaccctaaaccgcaaaaccggatatcttcacccccaaattattgaaaccggtgcaatttgactcccttggtggttttggagggcggtttcgctgacgtggcgctgacgtggcagtattgactcggtcttctttccacgtggcgcttaggtggcattagaaataaaaaatatgcgtgggacccattagtcattcacacacaaaataaaaattgtggggcccact

SEQ ID NO: 12375 - DNA, 4730 bp, Oryza sativa
  unsure (1)..(4730): unsure at all n locations
gcaattactaatggcgcattagcaacacatgacagcgaggttgccggaggagcatccccagccacaagaacgagcggcttcccgaattcccccaccggattatttatttttcttttcgcgcgaggaaggtatagggggaaaaaaataaagaaaaaggagaaaaagagacggggaaaaaacccagccaaaagaaaagagaagagggaaaaaaaacgagggaaaaagtttggcggaaaaaatcgagtcctacgtggcgcgtctcgccatgctctttttctcccgtcccctcctccctcctcctagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccggtaaattgagtttgatctttccgtttcttttcttggcgagatcgtttttgaatgaactttgtttttcggattaaatgatgttactgggaactgaccgtgtgctgttttttcccctctttttgtggccgttctgtgctattcagggaaacgccatggcaaccgacgaaaacggtgccgacgatcgcgccggcggcgagagcaccgtggatcatctcaggagccatatgaactacggcgacatggatttgtcaggggaagagcacgtgccaaaggtaaattactcctccccccgaatcgcggcttctccgctgcaaaatcccgtgcggttcttgtgtgcttgagttcgttggctgctcgattccctcttaaaagattgtgttccttccttgcacgcttgcccccgaccaggcgcgaaagccgtacacgatcacgaagcagcgcgagaagtggacggacgaggagcacaggctgttcttggaagccctgcagctgcacggccgcgcatggcgccgtatacaaggtatgtctcatcgaacagatcgaattttcatggcgatcgatcgcaattgtccgtattcgcctgtgtgccgtaacgtttgtgttcgtctgtgtgtggatgcagagcacataggtaccaagactgccgtgcaaatccgtagccacgcgcagaagttcttctctaaggtcgtacagcctttcgttctcatgtaaacaacaacaaaaaatctctgatctctgccatgaaaaaacaaacaaacgaaaaaaaaaaaaccattggttgtgttacttgattgcccaaagtaagtcgccaatttttcaattttttttcatgggagagaagaacagatgatgtcatgtttttactgcgggttgtttcacagagtttcctgacgctgtgattgcgcggtgctctgcaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctccaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaaggtatattctttcgtgggcagcacatgttggacaactttgtaaggcattagttcttccaattttgcaagaatacaagatattccccatcagaaaagcaatatttaggaccaataatttcagtcgagaatttctgacatcactttcagagaaacacaggtttttttagccttttaggtaggagtatctctgaatcaaattgtgatatgcaatctgatcatctgcagttttacatggtattaatttgatctattgtcgccaatggaaaaataaccatacccttttagtgttattggcacccttaataaattctgtttttgtttttcgaatgtgaatttcagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtactactattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgcaatgtagtctgtacttgtgtgcatcgaatcagcatagatatctggacttggtttcatggtttgttaccatagtacgattttggaccatgtcagagcaggtacaattctagattataaaccatcgataatataataaacacatatcgataatataaatgagaagagatgagaagagataagagtagcgagttacagatttatagacagctgcagcgtagactataagacatagtgtgtgtatgacaggtggaatcaggtggtagatgtgacaaatatagtacaatgaatctggacaaacatttgtctagattcattgtattacgatgcttcacatccacccaaaattttttatattatgggacgaatgaagtatatgtttatagggtactacctccgtcctaaaatatagcaatagttgggtggccaacgcaattacgcggctagcacccaaacaaaattatatattttcttagtatgattttacttaaaatgtattaaatagctatatcattgtcttaanacttggaaagactaaaccttatcatcatggtgtttctaattatatagtttttaaaagtcataccagtggctaccccttgggtcatcttcttctttattggctgctcggatctaccattatttctattcattctgttgggaacctttaaaaattggattttatagtttttagagtttattgtcaagttgaatttcatttttataatttgtaaatgtcccgtcaaacgtggccattatactcctgtaggcccggtccacggtctcttctctttatggtcattgagattttaaaaatggaacataatgatggggggggggtcattggttactttctagaagtccagccaaacgtcacagctttgccattgtactccttacgggcggcccgctgcctcccttgtttatggtcattggagattttaaaatcaaacattattatcattgttttttttttatttttttagaagttccaaacctttaaaaatggactggtagtttcactttttataacttttagaagtcccatcaaacgaggccactatgcccctgtatagcccgtccgccgccaactctttattgttattatgattctaaaaatcgaacataactattgttggaattcatttttttattttctagaagtcccgtcaaccttcggcggctctgcaactatactcttatacacccccgctgcttctcctttttattgtcattgagattttaaaaattgaatatgattatcaatgagttttttttttactttctagaattcccggcaaccgcattactaatttgcttcacggcctgcctaacgtccctccttttaattgtcattaggattctatttggtgttttattaacaatttttatatctcgt

SEQ ID NO: 12376 - DNA, 5249 bp, Oryza sativa
ggctagtaattgtggtaggaagacattgttttatttgacaaaatcataacagtacctttgcaactacttctgtagttggaatattttttggtatttacaacataattgaacattttgtccgttatggctagaacacgtagcaccctgactatggctgaaatggaggctgccagcaggtatgttgggttgctatctggaaccatgcaaaatagcattccatttgttagctgctccagctttttctgtatgttgggtcaattaggtcatgctttacccatatttttagtttagcatcagatggccgttcatacagattataaactccctcctgtcaagaaactagaccgtttggagattatcgttttgttcacaaaagcaagacatctggaaagatttggggtcatttggccacctatgccccttattaaatgactttatgcatgctaagttgaaatttctagaggaagttaattgcgacagtattatgacaagtcactgattaatcattccttggtagatgcaaacaagccccaaacattttcctttgctgactgaagggagtattgtttccacaaatttgtgattttggtagcattccgaatggttgaattgtcaacagtgttgaccacgtccagactagttcctcaaatgtttctatgtttgataattcctgatgaaaagttaatgtgtggcttgttacatgtagatatgcacatggtgcgctcggacattgtcatctttaactgcacggtcacgccaagaagatcggtatggagttgctcaactcacaggctgcaatgctgctgtgatgtctactttgctgtctgcgctagttgccgttgaggcctgtttggggaagaaaactaacccacaacctgcgcactcactgggtccagcaagcattaagtgggctaacttttccaccgggagaaaaggcaatgtaactgccattgcaagcacgcaaagaggtggtcttcacactaaagctttttccatggccgatgttattcgaacttcgatctatcagatggtttcagcctttgagcatgacatgcgggcaaatgctaaagcatcaagtttggagaagaactggatcagtgaaggaagaaaacctgtatttggttcacaggctgtgttggttcagaagctgagcctgtttattgagtaccgtgctgtctgaacttggcatcctgtaccaaatccttaccggccatttaaattattcttggatgaaggttatttcgttttggatttggatgggagagtttgtttgactatgaatctttcgaacagattatgactctcattcaggttcagggggccaatattttatatcaagaacgacttggatagtggcattttctgctcataatcgtcaggatgtaagaaagacatgaattgttatacctatggagagcttttcaaaagataattacatttctccactgggaaaaagccacgctggttttgaaaaactatgccggtgaacctgctgtatactacttttcattttctcaccctggagttgtaatctgtatgttgtcatgggagaaggaaaccagagctgtgctgaactcaataggcttattggaattttcgttctcacaatgtaacttgtttgttagtcttacccacttaacagcttcacctgaagttctagtcaaattctaatgctttcattgatttacgtgatgttgtcgcctaatcttacattttcattttgggttacttgttacagctttgagccatttgaaatttgagttggcaaaactcccttgtgctttttctatgacagtttcatgatttcatcttggatcaaaactcagaaggcacatcctggaagaggcgtactttctaattgagcattctaactatccacctcatcaatcgtggatttatgttacaacaagctcacccaacaaattaccacggacagtggaaatggaccaccaaacagcgaaaatgccggtcattcagagtacttatgtacagacgggtaaacacgttgcttcgactgcaactatcaccaaactttctactacctagttaacgacgagaaacttagctgccaccccctccggcctcgccggcgcggccagcggcggccgcctcggcgaggcggcgagcatcgagagggcggccctcgcggtcgccttcttggcgccggcgacgacggccttggggcaatgccggcgcggcgacaggacgcgcccgcggtgcgcgtccaggcctcccccgcagctctgcgacggcttgaggcgcttcctcggcggcttcgccaggtcctccagcgaggcgaccgccgccagcgacgcgaacgactgcgactttccgtcgaagaacctcgacaaccccctcctgcaaacgaaaaaaatgaaaaaaaaaaacactccggtgtcagctcagctagctcaaggatcatcaaagatcaagaagaacgcgaccagctagagcaaacggcacgcacttgaacgggagctgcgtcatgaggtcggacatctcgaagcggcgctccgccgagctggaggaggaggaggagctcgcgtcgtcggcgagctccgaggacgaccccgacgaccgcgccgagctccccgccgacgtggacggcgacccgatatcctcctcctgctcctcgcaatccgccgcgccgccgcgccggcaccacgcgtacgcgtccatgtatatatccccaactcttgactctccccgaccaacgccgatctcagatcaaggcaagcgaacgcagctcagatcgatcaaagcaacaaccgagccgtgtcgtcgtcgactggtggaaagaaggcagctggtacaaattataaaggtgtggaggaggaggaggagaccgtggccgtggtggcgaggtgagtcactgctggcagaggaggataagaacgagcgagaactgaagtagtagcggagagcgtacgcgaggcgagcggatgagataaaagaagaaaaaaaacaccggtcgtttatttgtttatcgcgtgtgcggcgcggtagggaagggaaggagtaaaaactaaaaaatagattcggcgttatcgcttttcttttgggttttttatccgctgggttcggcgttcgaattcttgctctccgttttttttttctttttccggagaacggggggagggggagagagtggataaggcctccacatgcgtatacgtgtgttcccgcgcgcgcgggcgcatcggaggccacacgcgacgcgatgctgctgcgtgcggctgaggctataggctagcggagtggagtagtagtagcgagtgggcgttgcttgtgattgggggaaacggaggagggccacacgctttacagccacatctttttaacctaagctaatgcttagtactcctatcagttaaaatttttttttaaccaatttaaggttattttatcgaaatttactttctaaattttttgcttttagattcttaagaacaatacgtaaatgtttattcataaattatttttaattttcttttgtaaatactacctccgtcccaaaataagtgcagccgtgaatatccgtgcccaacatttgaccgtccgtcttatttaaaaaatttatgaaaaatttaaaaatatttagtcaaacataaaatactattcatattttatcatctaatagcaataaaaatactaatcataaaaaaaatttaaataagacaaacggtaaacgtgaatagtgtaaaaccgtatttattttggaacggagggagtatgttattttgtttattcatgtataaaccaaacaatggtgccattaattcccgcctgcgccacgcgggtttgtgcagtccacctgctacggattttacttggatagtgcgggctgtgcggctactactacaaatgtgtgtttcgatttaccttgcgcgcgtggcgttcccatcttgttcttccgctgttgctcgtatagtggagtggactgctcgtacttgtggagtactgctctcttatatttaaaggatatatcttaaaatgtgtatgagctttgccctaaagcccattacaaaaatttgattatcaaacaaactaaacgcacaacgagcaacggcatgtgttcattaatcattatgttagtactttttagctagaagcctagaaccgcatcaaagtggcaagatggctttagcctttagttgtccaacagcagtagtatcgatggtacgtaagcttaataggacaaagacagaccatatgtggcatccatttccttttgtctaaaatatgtccccttttgctaaagaacaaatgtacatttgcaacctttctcaaaacataattaaaaaaatgcatgctatttgtcattgtatgatggaatatgccagatccggtaatctgcgactattataagtgtggaacaaacaacttgctactcctttgcaccactgttaccctcctgacagtgaaagaaacacaaagaaagctgcagctagctgagatgagactgtctctaatttaagaagagattattgacatagtctccaaaaaaaagagttaaatgaggatgattctctgtgtacttatcgcgcttcattacgagatgccgattgtgcaaagctgactcagctgacctggtaattgcccccctgaccactaactcgtggtccaatcttcacttttggtcttcgttgtatatcctttcaacaatatggggtacttatcctttcctacgacttgaatttataagctatatggtgatggttacattgggtatgaaatggatatgataatgaaagttggctctataatgagtccatggttttgtttggaggtgaggtgtgaatacactaagttttttactttctccgcttcatattataagaatttataacattacccacattcatatatatattaataaatctagacatatatttgtgtctagatttattaacatctatatgaaggtggacaatgctagaaagtcttataaactaaaacggaggtagtagcttctaacttctaattcattttcttaattttataattacatctttactcctttaaatgtatcttatggttgtgctggtgagtctgtctcaccaccaccacccaatatttggccccacataaatagtattcttaaaatcttgaggatttatattaggagtcggaaattctaaaacaagtagagccgctatggcaagggggaaaaatgtactactggtagagtctacttgtgattaattaaagtaggaaagcaggattagtgcgctaatcgattaagtctt

SEQ ID NO: 12377 - DNA, 5706 bp, Oryza sativa
ctgtgcagcactcacggaccaatcaccaatttgagtctccgcgagaaacaaacaatcaccaatttgaagatttgtgtattttggatggatttcgggcatggtgcagcgagccaagctgtttttagggtgggcgcttgggccgtactgcacatttcatacatacgggccaggctgaaaaggcaagcctagttctgggctgaaacaagcccaccattgcttgcaacaaattcagctcaacatctcagaacaaagaacgttcatatttcaaaatccgaatcactccagcaacgaaatgagaaatacaggagacaaatttaattttcgcaaggattagaatcacatcatttcatctacggaaatgagcaagactgacaagtgagtgagtgacaacatggagtaataaaccgagtttctaagcatcaaactgaagattgtgtgggcttgtggcaatttatttgccttcagctaacagtagcaacaccaaccaagcatggtaaatacgtacgttttgactgccatttcccacaaacaaatcagcacgaaatcacattagcattcaagaaccaatcgccaattcgaaactttgttgtgttttttttctgcagcatagttcgaacttcgtatacagagatactaccactattctgttgcttttagatgattctctcaactactgtacgtgcttcaacaacagcttaccccttgttgcaaattcagatcagcattcacatctcaaatcacagcagcaacgggatcagaaatgcaggaaacaaataattttgctacgattgaaatcgtaatgtcattacatctatggaaatgagcaaatcacaaccaggagttgggatactactaatcctactactaaaaacccacccgtggcacatccgggtctctctacaccagcaaagcaaaaggacacaacaagagctaaaacaccagcaacagccagtccaggaggcggcggcggcagaggcggccagcgcgagggcgagggaggaccggagggctcagccgccgaagccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatgagcccggagatgcgcttcacgccccccctcctcgccagcctccggatcgccggcttggtgatcccctggatgttgtcgcggagcaccttgcggtggcgcttcgccccgcccttgcccagccccttgcctcccttgccgcgcccagacatcgccggagaccgagacgagaccgagacgaatccgagatggaagaagagagaagtctactacttggggagatctgaaatcgctgtggctcttggtgagatggatttggatttgggggtggttttatagaattttggggggattttgagtttgtgtttgggcgggagaatttttggggatagatttgcgcttttggtgggtgggtttgggacgttggattggtggtggacgggcgcgatgggttggggtgtgtttccgtggattgatgacgtggtgggaggcgcggggaatggatccgtgggtggggggaggattgccgttggattgaatcggatggtggggaagctcgtcgttgcgagtggagcggatcggtgacgtggcaatggttctgtggccaggcgaggaacgtgggctgggccgggccgccggttttagctcggtctcctgatcagtcacgaggcccgtagcgtcaagtcaccggcccaccaccaccgtccggcgaataaacccgccgcctctcgtttcgccgccgccgccgtcgtcgccgtcgccgtcgccatctccaggtgggtgctatagcgataggctatggctttcgcgccgtccgcgcggagggtctcggccgtgctgtaccactacccgtgcccggacggcgcgttcgcggcgctcgccgcgcacctctacttttccgccgccgcgctccccgtctgtttcttccccaacaccgtctacgaccccatcaggtaaatcttctgtaacttaaaagatcgacctttgggccttcgaactactagtttctgcttccaatgttcttctcctccataggttcgtttgaagagatgtgaaatcggcaggaagctgcaagcgagtacaactcttcctttacaatgtctaactgtagtttcagttcgtttagaccgaccaacatctgtgaagctgctcaatgttcactttggcattgctttgcgcttattaagctttccctttgtattttagtgggagaaaattgcatctagttggcattctgacaagtccctttttggaggggaaagattatgctttggggtttctattctgtagtgacgtttggtatagtcaggcctaggtgaaatatacatttttttcccggatttcaatatttcatgaattatgaaaatgatgaatgggaggtcaaaattgaacaaagctgtttgatgattttgtcatgatatgagcctctgcacagcagatacagtgatgctcaagtgtttctctttactatagcattattcttactgttaccctctctgtaggagtgatgctcttccatttgatgaaatcaaagatgtttatctcctagactttgtcgggcctcctggttttgtcactgatattgccccaaaagtcgagaggtttgtaagcatttatctactgctatttgctttaagttttgttctgtgtgtgttagtttcatgtgcattatgctgttaatcttggattcttagaaataagattcagcctatgttcattctgtcattcatttaatatacagattcgatttccgtacacttcatgagtagattcagtatattctgtaaaatattttggggaaacacattgtggccatcaactgttctgaatattgctgaactgtagattgtagaagttatgcatcaatatttctatacattctgaattgttttgtagaatattctatccctaatgctaggacaattctaatgtttttatcttgttcagtgtcacaatcttggatcatcataaaactgcctttgaaagtttatgcgggaaccccacactcggagaaaatgtcaataaggtgattgacatgcaacgcagtggagcaacaatcgcatttgatttctttagcaacaaactcttgacaataggtagtagtttatggaatcatagaagtggcaattcttttaatggggtgaaatatctacctgataacaagcttgaaaccgtacacaagcttttcaagtttatagaggatggggatctgtggagatggaccattccgaatagcaaggccttcagcagtggcctgaaagatttggacattgagtttgatgtcaatatcaacagaaagttgtttgatcaggcaagtaacttggtactagtgttctgctacagtagcatatcctcattaaaaattcatggtacaaatctagcaccaccacttttgcatcactaaacctatatattgctagcctaattgttggttaaaaacaaagtctagatcttaaaatacattagtgccttctatacttggacagaatgattattgatgttgtcctactatacgagagctgttacaaaacattgaaatcaccgagctagccatcataccaaaatgctttttcatccaaagcttgtattgttttggtccaataacttcctgtgaagtggtattgttgcagttactggaactggatcctgaggaagtcatttctcgtggacaagcaacattgtcacacaagcaaaaattaattgatgaatgtctggagaaatcctatgaaattgcattaggatgtggcaggttcggtaattgtctggtaaatacctgcaggttttccttttctcttgattattttgtatgttcattaatattctattcatgttttgtcaacattctattatgtgaaggtgaatcgtccctacattcgtctataaattctgttatactacttgtttgatggggctgttgttgcaatttatgatggtccatgagctatatgtttgatccaaattagcacatttccagtaaactggatcagtagctatatttcgtgccagggattaaaatttgacatattacaagaaaaaatcctgtggtcttttttggtacacgtagctttccagttccaggttctggaaccatctggtgtgcaactccactatccttacataaccaggacgtatcttttttccattagttctgcatgttttttttatttgtgcaatcattcccacctgaatttcaagatagcttacttatggtagctttatggttcgccgccatcgaatttgaggttctcttattatagcttaatactttactgatgcagaggcatgcaaccattcctacagcctaatgtctcagtatccgtaatactttttactctctttgtttgcattttaccaacattacaggctctgctgaattatatttttattgacccttaggctgtcaacgctgatgcaatttcaaatttgagaagcgaacttggaaatcagctagctgacaagagtcgtaatttaaatctgaggcaagttttctgttcaacctctccatgttgatgaacaatccatattgtttcttcaaagcgctatgttgttctaacacgaaccaatggtaccttctccagaagtattggcgctgtagtgtacaaagtacctgagttgaataatgacaatatgctgaaaataagtcttagaagtttgaacgaagaagacactacttctatctctaaggtacttcatcctccgatcaaatctataaagctgtaaagtagcatctgaaaatgatctattttaaggctgttgatttgttggcgtttgactctttttgtaggaatacggtggtggggggcatcggaatgcaagctcatttttgttgagcgttactgagttcgacaggtggaaggttggagctgaaccttgcaacactaaaatgtaagaacttcatcaacaaattgaatggttcataaagaaggaaatgcaggatgttacacaaaagcacaaaatggaaaaaacatcaagtcctaggccctgttcttttgttttcttagctaggaccagccgtgtctagctatctaggcacatgcacatccggtcagtggcgtgcctgtggttcatgaacatgagcccccagtatcattgtaagaaaaaaaaaactgtcagggtcgttttgaacatttttgttggagagccaattgttagggactgactaggcgttgatcggctgatcgctattaaaggtgttttgaacgattagttgtcacaagcaagtactccctctatcaaaaaaaaattaagctaggagatcctagtagaacggatttgtaataggagaaatctcctaggttgagttttttttaagacggagggagtagaccggatgcgacggtatgattcatgacatgaactgagcatgaaggggacaggcttggggcatgatcggatggctcataaggcgttcaaagggcaaggacgtggccttcaaccccatagaaaaaacgaatattagcgccacatcagcggtacgcgaagccaaacgaggttctcgtagccaaacatggatgctcgttcttcgttcgtcgaacgacttgcggagggcgaagaaagggtgaactgccgcgttgtggagggcggagcctcgcgggc

SEQ ID NO: 12378 - DNA, 1391 bp, Oryza sativa
gggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggaaacggtatgtggaaatggcttttgaacggtcatggcccctcgttatatttgtgtgggtacaagagaaagatacaaatgtttcaatgcaaacggaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctg

SEQ ID NO: 12379 - DNA, 4352 bp, Oryza sativa
  unsure (1)..(4352): unsure at all n locations
nnnnnnnnnnnnnnnnnnnnnnnnnnnnnnnnnnnnnnnnntataagtagggtgcggatggagttgttgatagtgcgaagaacacactcagctttgagaagtgtatggacaagacaagcgaagaacggtaccgcagctagcgaaaaaagaagtggtggcatgattaacaaactctgtaccgttatcggcctgaaagcacttaatgggcatgctgaactgggtcttgacataggcaacaaactcgacgagatgctggtgaacatcggacttatgacgaagaggaaaagtccaacaaaagtgggtgaaatcatcaagcaacactagatagtatttaaaaccagacaaactcaagactggagaggtccatacatcgcaatgaacaagctcaaaaggggaagaagtactagacgaagacctagaaaaagaaagacgcgtgtgtttcctccctgctcacgcatgacaaagcttattatcagaccgagtacaagaaggaatggctaatttatgaagagtttgaactgcagctggactggggtgaccaaggcgacgatgccataaggtggatgactcggcaaggaagctgtggaccgtgatggcagggacggcagtaggtagagtgtagaggtccccgcgactattgcagcgaagaatcacgcgccgggttcgaaggttcttaacagaaaaaccaaactcgtcaaattcaattgagcatttgttgtcacgggtaaatcgacgaacagaaagtaagtttcaaaccaaggagggagcgacaaggatgtttgtaagagcaaacctagtagctcctataggtagaaaagaagtaccacgacatataaccggaatagtatgaccattaccaatggtaatgaaggtatgagagttagggaggcatgtaacgagaataccgtcagtggaggacatatgcgatgtagctcccatgtcaagcacccatggacttggactgttcacagacagttgattgagagcagcaatgagaccagcttgatcccagttgggctggacttgcagcattggaggccatcctggagttggtggagacacataggaaccggcaaaagctgtgtgagcttgaggatacaggccaaggtagccagcactgttgccaggattgctgggagggcgccatgtagaggcctgcacagcccatggattgaagcagaaccacgggccggcagggcgaaaaccggcctgctgctgttggtaggagttgccacccgaatttccgtaaccgccgctgccggagttgttttggcgaccattgctgccaccgccaccattgttccggccaccattgcgacgctggttacgcttgccattgttggaaccaccaccaccaccgcgaggttgggacgaaattgtagtggcgcaggtaccggaggagcaagagaaagcagaggaaacagctgccaccatggctgtttcagtctgaaccttgtgctctttggcaaggcgaagctctttcagcaacagagtattgcgcgcagaggcgaaggaaggcagaacgggagcaccggcaatgttgtcggcagtgttggagaagcaggagttaaggccgctcagcaggttcaggacgagctaggactcggtgacggggtggccgacgtcatgtagggcatcagcagcagtcttgaccttctggcagtaatcagcaatggggagatcgccttgcgtcatggagtggaactcgtggctgaggtagatggcgcgtggttccttgttcgcctgaaagatgtcgtcgatggagaccctgttaggaaacgataggcgaacaaacgataaagaacaatagatcaatcacaaaaaacacgagatttaacgtggaaaacccttccaaaacaggagagaaaaaaccacgggcgccagccagcaaaatatcttcactatatctgaggtaaggttacatcgccgcacggcggcttacaagaggtatatatatagtggagccctaaaagggatgatgatccgtacggcagaagctggcctttattaagtgcaaatgaatttagatcacaactcaacagacccaaagatcacgggctgtctggtccggttccatagcgacatcaagaatcgcgttggaaacagaaccgaaaagccaaccccggacacagcaatcagcttgttcccaagccggatcttcagggcgagcaggagcagtaccatcaatatgagcgaggagtccggacttgccgcacatggaagtgaagaaggatttccatctgttgaaattaggatgcttaagctcgagggtaatcgggatgtgtgtcttgacattgacagtggcataagggttgatgacgatggcgccggcagaatctccagtggtgccggcggaggagccggacgtcgaggacgacatggtcgcggaagcagtggtggaagcggtagacatggcgcagaggaggaagcagcgcggctagggcgcggctggggcgtggcgcgagcgagggtgcggctgggtcgcggcgcgaagtggggcagggcgcgacgcggcgtggggcagagcgcgcgacgcggaaggcgcggcgagcagggcgcggcgcgggagcggcagaaacgcgtcggtagggcgcggagaaaaatcgcggcaacgcgtggagagaagccggcgaattaggagaggagagggaaaccggtatctgataccatgtagaaaattatgagacgccacacttcccaacgtggggggcgattatatttatatagccaaatacaatagagattacaacaaactcttaaataagagatatatacaaatacgagacatacttagactatacaaatctaatctaattctaatacatataagctatttaaattactgtaaattcttttgttgtatgttctgtaaccatgtcctaatagatttatttttagaacatcgacggatgccttgtgcatttcatatttaaaattaaagctgataagttcctgaaacattgatgttgtgttaggttccatctacctgtattccactggaagcatacaagttttaaatgttactgatccaaacatggtgaaggagctagccaactgcaaatctttggatcttggaaaaccttgctacttgcaaaaagagcgtggagctcttcttggtatgggaattctgacatcaaatggtgatctatgggtacaccagagaaaagtgattgcacctgaactattcatggaaagggttaaggtaattatctgcaggcacttgtattgggccatggatctctctgtcaaaaaacaatatttttcttggagcaactttctagtacactacatgtagcatatactaaaactcaatttattgttaaaatgacatccacagggaatggtgaatttgatgatggaggctgcaatgtcaatgttgaactcatggaaaaatgaagttgaggacagaggaggcagtgcagagattgtggttgatgagttcttgagaaccttttcagctgatgtcatatcaagggcttgtttttgaagcagctttagtgaaggcaaggagattttcataaaaatacgacaacttcagaaagcaatggcaaaacaaagtatgctcattggtgttcctggaagtaggtatatttcagaaactacacatgtactactgtggcacatatttcaatttgagacaatttaaaactcaaaagaatgatgtctttgaactgctcaaaatcctctgttgagctcttgtgcttagtttgaatgatttcaatacccaagtagctgcccagattcaacttctgaaatcactataattcagataatgtgttactgttttggtttgcagcagtatcagaataaccttttggagaaatatacagcttctattttgtctgggctaacttacatgtcccattttggtctgatctacctgcaattcctacatatcattctaaatggatataaggcctaaaaaatgatattttatctagaatccgtgagatactacagtagatccaagagtatcataacatgtattttccaatccatgccattgcatgagaataattatatgaaaataagtggcttctcatgttttatcatcttattgtaattggttaatcatttaaggattttcctttatttttgtgctgggccgactaggtatttaccaacaaggagcaatagagggatctggaatctggatagtagcatccgtaccctcattttaaacatatcaaagaaatatgaacatgattcatcgacctcagtaaacaaggatctcctgcactccattattcaaggttctaaggatggtccctttgcttcatgcacgcccgaggatttcatcgtcgacaactgcaaaaacagctacttcgcagggaatgagacaacggggtgca

SEQ ID NO: 12380 - DNA, 25780 bp, Oryza sativa
  unsure (1)..(25780): unsure at all n locations
cttccagtaacagaagagatgaaaacaatccgttcattagattacagctaacaatggtgtgctgttgatacttgtgcagctgacaatggtgatccaggagacactccgattgtacccaccagcctccttcgtcgcccggggaagctctgaatgacatgaaacttgccggcatcgacataccgaaaggaactaacatctggatcccgatcgcgatggctcaccgggatccttcagtatggggtcctagtgccgacaagttcgatccggacaggttcgccaacggcatagcagggacctgcaaacctcctcatatgtacatgcccttcggcgttggggtccggacatgtgccggccagaatctagccatggttgagctcaaggttgttctgtcactcctgatgtccaagtttgaattcaagctttctccaaactatgtgcattgccctgcgttcagactgaccatcgaacctgggaaaggtgttccattaatttttagagagctctgacttgagattcttgaaggttatataaaatgtttcccttttccctttgttatatctgtttggtatgtgtttgcaacaatgctgcaactcgagtgtaaacagtagtatattctacagtctgcagttctgtacactgattgaagtgttacttatttgtggaatgcaacttttacttctcgtctgtcaattaatagtttacataacatcaggtgaaaaaaaaactgaggtcaggatggccgagtggtctaaggcgccagactcaagttctggtcctctaacgagggcgtgggttcaaatcccacttctgacattatatatatatatatatatattttaatataattttcattcatggactgataaacctacgtgcattgcccttcgtttatgtattacacacgaaaatagtatttatgtattacgcatggttttttacgtttggccatttgttttatcagttgacttttagacatacgtttaactatttattttattaaaaagattatgtaattattgaaaaggaggtgaaattaaatctttccaaatttccattaaccctatctcatctagtcatcccaattccaaatctaccgatcagagccgaaagcaaatactgcaaagatcgggacctcgaacatagatggcgtgaacgcttcgtgctatgttgcccatatttcttggatctcatttgatagtagttgatagcgatttttagtgtcaatttatctaaacaaaactgataaaaagcgtttgtcacacttttcttcaccaatttgaactagctaatggtgatatgtgcatatttttatttgttttgaagtatatttgcttgagtgtattttggaagtttgtgacaaatggaacactcgtggtatttggaagtttctaatgaatggtatactcgtgataatattgtaggcaataacttattatgttttaactagtccataactacgtactactcacgaatattctctatttattaaggaaattatgtgaaatacattttcggaagtttttgcactagaaagatgggcataaaccaacgaaaacagacaaagacccaacaagataggctaagactggtggagatgggtgaacgctgaggagagtggaggaagacttgtagatacgtgtgaagactcacggggacttcataggaggaccggcaaaggtggatgaagataaggtggaaattgaactagttacactaccaatagttttgagcgggcaaaaggcgcctaggtgaagcactaggcatggcctatgatagatacagttccatctattcgtcatgtaatttggcttaagtgtattctaataaaaacatgttgacaatagaaataaggaaatgacatatatcaaaatcatgatagggatatttatacctgcataaaaaaaatacttaaagcttccgggaattttttttgcccgccgtctagcttttgttcccgtgcatgtatttttgtcagattcccttcttccccgcgtacgtccggatcacgaagagtccacaatgttcccacggcaagcgcaatatgtccgctactgcatccaatccgttcgtggccggctcaaatgcttccaattcgttcatggccggctcaaaaccttcagagttcgaggaaaacaaacatgtccacatggtttccgatccaaaaccttcaaaatttgaggaacatgacaaaaaatcggcaacgagaatagatgaagctgcaaacactatccagttatacgagcttttcaccatagtagaagacgagaacttcataataaaataccaaaaattcaaacaactcaataaacacaagaaagtatagtacacttgtatcttagcaagccacctcatacacttgccatcgccgattagggtggacggggagcactgccgtcctcaccgcctatggaggctgctggcgtcaccattgtcgtctactaaggacagaggagcaccgttgcccttgctgcctagggctaggtgagcactgctaccccgcgctaagggaggacgtccatcgtgctgaggggggttggttggctacgggagcaccgccaccatccctcgcgagttgcaatgagagaggctggataatgcctccaccatcactggacggattccatctatgtgtattagatgataaaatatctcggattcatcatcaatctttcatttttaaccctttcattttgttaatattacgaaaagttattcatttaattatttttatgtctgccctcgagtttatatgtatttcacataaacttctttatactggtagaattaggtatcaaaatctcacaggattattctttaacctcacttgtgtgtttcatatgaagagataaatgacagaacaaacgtatgtttattctttggcctcattgacgcgtttcatacgaagagatgaatggcggaacaaggtatgtaaagttataattgtgatcttcacccgtcgtgaaacttaggtattgcaagaaacttgggtattttgcttgcaatagataaattccagtaaacaagaaaaatagaaaattaactgtctcttaatcattatggtctttgataacctgcaaactggcctcaagccctcaacgtagtatacacatcaaacccacttagtttatgattatttgcacctataaatttcagagtgatcacaaccattattttttttcctaaaaaagaactcatttttcacccaaatgatgatatgtataggggtggacgaaaagctcgtgactcgttagctcgctcggctcgttacattttcttaatgagccgagctaacatcttagcgagcagctcacgagctcaacgagctgggcgcatagggagcaaaatcaaacttcagcagataggaggccaacttggtggcagccccatggtccatctcgcccgtggcaagcccaaagacaattagaaacacatgaccagtcatcggtttctccactctcccgtcggctgcatccccttctcttcccgatccacatctagagcgccgcattgagccgccacccgtggccccgccatgccgtcgcgtagatgcgctgttgttcgcgccgctcacaccaacccgtggcgccatagagtctcgcgttgcagcggccggccggcaacgcgctctgctccctccatcctatggcgccggcgtcgacctcgctccccatgcccgtggtccgtggagaagggagaggaggtcgtgctcgtgcacgcgtccatgtatgtatgcatggacggatggaactatcttgttgcttgatactttgaatctgtgagtttgtgaagaatttagtgctagttgcttgatttcttgtttgaactgagacctccacctttaggattttaattttatagtgatataggtgatgttttaagcttctttttttttgtttttggaatttatgataatatgattaaaccagataagatgacccatttacctcatctgattgctgaacggttgttttcagaatgcgttcttgtctgtctgctatctttgaagcgatgaaatggctgtattagctcgcgagatcaacgagctggctcgagtttcttaccgagctgccatttgagctcgttagccataacgagccagctcgagctggctcgttaacctaccgagccagagcgagtcgagccgagccgagctggctcgatatccaaccctagatatgtactactccgtcccaaaaagaatccaatcctagcaacgaatctggacacacatgtgtctagattcattgctagagtttgtctttttttggacggagggggtatagtataggcacacctattccgcgggaaggatctgctatattgctacacgcgcgccaaggttgcccgcccaaattagttttccctcctttggtgcattttactcttcaacccactgattctttatttttcacatatattcctcagtggtgcagctgagctcgctggatgttgtacaaaggaatagaattagcaaatgatacattctatggggtgttttgtgaaaactttgttttattttatggggtgttttgtgaaaactttgttttattttaatagggggaattgttttggcggcaggaggcctcatcccaatcgcggtcggtgccgcccaaaccaatctcgcgcccctatccagagctgctgcgaggtattttctttcttcccattttcttaaccatttctactcctcaatctttctctcacacagatccaaaaagctcctcttctttctatggatttttttttatggtttttcacatgttagggttctagcgagctttatctctttttcctgtgatttttcggctttcctcacctcttaaagccctaaatctgcttcttttaccatgtgattctgatttccaggtgcgccaacaaggaactcacatccggtttgctccccttctcaatctcatctattcggttgaactggaagatccatccgggcttggattggattggattgatttcttcttttgttggtaagtaactattaagttgcatgcaccagccagttgcacctaaaagcctaagctgatagggaaagatgggcaattcactttatacactccaacactccccctcacgcgagaccccctcaagtctcaagcgtggaatattggagtgggctgcaattattttatttnnnnnnnnnnnnnnnnnnnnnnnnnnnnnnnnnnnncggctttgataccatattaagttgcatgcaccagccagttgcacctaaaagcctaagctgatagggaaagatgggcaattcactttatacactccaacagtaaccctattttccttgattagatatctgttgtagtcttgtcccttttgttcatggtgtgggggatcaaatccaaactttttagcagcgccacgccaccatcgagcgagcgctcgggtaaggtttatggttttgttcagcggcggcgcgcgcaagatttgtctcagccaagacacccaatagggctacaataggtctcggtgtagagaccacacatatttggcatttgggtgcctattactctagattggtaccactaatagcaactttgagtatttcgctatggtgttcagtttaacgctggctatagagaatatttttaatcttttatgtatctgccatagctgcatataaacccttgatacatatatagtaggtaaaaagtgtgggtgaaggtcttccaaggagctatgcatagaaagcattttaccttttagttttcccattttacaattagacggtgctttataaaatagatgttgatggttaattgatttctttttacagaagtaaagaaatatatataattgctgtatatatacttggactcagagtgatggttgaacagtttgaaatgtggccaaaaaaaagggttatcgacaaaaacggcttcggttatattagatcagatgatttcactcggcttctaacaagagttctgcttattagtggctgacgactaccttggcgccttgcatagtcttttagaacacattttacattcatagcagttgcagttacatttggggctagtgttttgtcgataaccacttaattttgctttagtttctcttattgaccctttttgccttattttctcctagaaaccttttggactcttcttgggtgtcccttgtttgtttcggtgatcattttctgttatgtcctggttagtttgcggtatttaatttttctattccttatttcattgtaggttttcattttgcaagttacaggagaggttgagtccacattactcccaaatagatcaaggggtggataagaatgttactgataattcgctagtttcaaactgtgatttccctgttgtaaaaaagttggaaaagtgtgtggatgaagaagtttctgtgcaatctccctttgaaaataaggacacaagatcccttggcatggtatatgatcatgaaaataacaagagtggtgttgctgaggtgattagaccagacaaggaagcaattgaatcatctagctcaatgaatgttgcagatgaagatcctttgtatggctgtcagacaccgcgtgaaagcatctttgatccttttgctccgggaccagaggagttagcttgtgcaccaaagaagaatatgatcaaggcaccagaacttcctccacgaaggcagctaagttttgattcaggtgattaccctattaaaaggttaagttttgaattcgatgatgctgaggaggatgatcagtttcttgaacggatctgcaagatgtttattgatctgattgtctcaaatcaagcactagagacgattggaaaggatctgataggttctaattcacctggaagctgtgagaccccttcttcagagcctctacttacaggcattgcagacacctgcccagatgcaccactgaggcgacctcttaaagcagtacagctcagcccaagcatttgtcgaaagctcgactttgattcagtcagtccaaggtgtttattcgttaaagagaataagtgatatcttgacacccttttgatctgcccaggaacagcattttggggcagtttttggctaccaatttcagttgccctgtgccaatatggtaactttgctaactgaaacgtgtaggtagtgatgctaaaggagtaggaggcagtttaataagttatacatgtaagctttaatcagtcttccttttaggtgggttagtcatatacattaggagctgtggtctgtgaccatgtaccttttgtaaatcttaaaatggatagttgtgtctggttgaactagtgagtctgttgcaggttcatgatgtggatcgtctgaatgctattcaatagtagttcatttttccttcacaagaactgggagatggtgtgccgtgcttaaatattttcatttatgtgatgaatgcagtggagcagtgaaaatcatgattgataatgtaaagtgctgcttgcttgatgcgactgttagtgatgaggttaaacagaactgctggaaatggccgtttggtttatacatgtggcttcattatatgttttgaaacctgtaacaatgtttagtatgtttgtcgtttgatcatgtgaggatcctaaatcctagcaactcagtatttgctggtgaaaaaagaagtcagcagcatatgctgttttctgtcctttttttctttctttctttctttttttttttttgcgccgggcctagttttgtgtgtgctggcagtttgccgctgtgggcatgctgtggagaaaggtctgttaaagttaaactgaagtttggtgctttggattaggaatttttggattagtagctagtaaacatgagaatagtgaaatactgtatatgtacgtatatgtcaaaactgacacaccgtgttatatacatgaatcgaatcaatcccaacacccatcaagaaatactgaagaaaatcggaagtcctgaatcctgaattcctgatcttatactatctgtaataacgaactaatgtgccacccgtgtagaatatagtaatactctatgtacttctagtagcagttgcgtggtgtaaacaaaacaacaaaatatggcttctcgtcttgtcccacgtcgcgatgtggcatgcccaccttacgttgcgtgcttggaaacttgcaaattaagttggaatcacatgatcaatcagagcttggtgcggtcgctgcactgctggctacgcacggccatctccgtgacgccgaacacgaaatggcaatccgagtacgccaccgcgtggcgcttgaacacgcccaggatggccaccctcccggggatccgagtgctcgcctccagcgccaccgacccgcccatcacgtccgtcacgagctgcgtgaggtcgccggcgaagcggtcggcctggagggtgagcgccatggtgacgttggcgtccccacggctcgggattcggcccgggtcgatctcggcgtcgccgacgtgggcgcccctgtaggtgaggtcggtgtggccccccgtggcgtaggtgaaggaggccgggttggggttgtgcaccgccacggtgatgaggagcgtgacgttgagctggaccgacatggccgggaaggagaggcgcggggagaggccgatgaggcgggtggagacgaggcgggtggtggggtcgcggacgcggagcaccgtgaggaagaggaccaggagggtgatggccagcacgagtagtaccaccagggtgacgagcaggcagcagcacaggcagcgtcgccggcgccgtcgcctcctggattccaggtcggcgtccttgtgggttctgaagggtggcgccgtggcggcgatggtgtgggtggggaggatgctgccgctgccgttgccggcggcggcggcggtggtggaggccatgtctcgatcgatagaggattgggtgcgtgtgcgtggcgtggaagagaggctagtaatttgattcgattggattggattcaagtagtgtgcggttggctctctctctctctctctctctctcgtgtctcgtcccgcggaagaagttaatgaggagagtattgctggtgtttggaattggttggcgtaataaatgggagtgttgacgcgaatgcgcagcacaaatcagcctgcaactgcaagcatagcatgacgccattgcattgcgtctcagaatttggcatgtccactgctcgcggttaaacaacgacgacatggaatttttttggtaagatgcggccagtgcgtccgctatcatggacacttcatcagtttaattcttcttattttttaatcgaaacggctaaacagaatttgcatcactacagaattactactcttttgctctatcaatagaaattcgtaccgtcgttaaaaaaaaaaagaattactacaagcacaagtacaatcggaagggagtgctttagcattttagtcggcaaagcgtcaccgtctgtcgggttcgactaggcacagacagaccacacataaggctcagctctcaagtcctcatgttccgtttcctgtcaccatccagcactaactatgaacgcctgcctgcgtccacactcatccctcccgcaatcaactccccatccttcattagcacaaaccatcatgggacagtagctgccccaaccacatccatacttcccttccatatcatactttttcgcaactcagcagcatccagcactagtgtttcttcacaacatagtactgcactactcgccgctcagattctccaatcaaaaacacccactaatagcatccgctcaagagtttggagcacgatttatacacaatagtttttaccaaacaagttcatgcaatcagctcaattaccctgcatggtcaatataccttctgcacaaccaaacagctgaattatctgattactatagtttgttacaaacagggctgtctttgttcagctcttcatgttcaagcaaatctgccttccaagttccaaccacatcaaggaaaacaaaggaacagaaacaactgctacagacttcaatttggtgaggactgttagttcaataattctactctagtatcatagtaatactagtttggataaaactccttttcaacaacgctaagacattttggcatttctgcctcagtcaatcagtttacaataacatatctgaaagggagttctctgtaggtgtttgattttacttcagcctacagcctcccaagcgtcaagcacatcaaataaaatatttttgtcaagttctaagggtccctttcaaatttcaattgaaaagatgaattggcaccaatacctcctgtataccataatcaggtgcagcatcactttgacattagtgacccaactaatcattaggaccagtcagctgaaaggttcaggagttagacctatccttcatcaatgtttcgacaagaaagggaattctacagcttcatgtattctgaccaaatggttcacccgcatctatagcaaattagcaacatggaaggacctctagcaactgaagatttgttttccttcttcggctagcaaaatgtgtcggcattccaaatatacttggcacatattgtactagctgcagtttttgtggcatgtcaggcattgcctaacctttgttatgaaaagattgggcaccaatcaaattaacataccataaatcctagcacaatatttgcaaggatgtaagaatgaaatcttgtagctctaacaagtcagtcattcactcagactacagcaagctaaactatcaagtgtacataattgtaaccgataaaacaagaaccatttcacaaacaacttattcacaaggcaaaaccaaaggtaataactgaaggagtagcttctacaaactgtagcagacctctcgtcatagaattatgtagctttgatcccatccccaatgaacaaaaataaaagagaagaaacttaaaggcttactttaagcattcctcaattccttgatgaaatcgagaccgagctatcaaatgcagatcccatgtgattgatgacgaacccgtaaatcttgcacttcaactgctcaaccttatccttagttgtagcctcttctgcaatcttgcctactccatccaaccagtcactgatcttcttgaactgggacagtaccattgttatgtggctgctctgctttcccctacttgcaacattctgatcttcaaaaaggtggaaacccaaatccattgcctcgtccacaaatttcaggaaccacgtatgcatctcacggcacaaggtcgtggcaagctcagccgtctcattcacgccctgagttttgttccatgcgcagctcgctgtagaggtcggtaagacctttgactggacctttgcagaagtcccatgtgattgcctcttggatatggttgttcttggagcttctaccaccgagggagcctttggcttatcagcaccccttttccgagagagcgattcaggtgccttattcatcaactttaggacttcaagatcagttgccaatgctgcttcaacccaatgagtagctgaattctcccatgatgcagtttcagttctattggtggatatagactcagcaattttcttccatttgagagtatcctcatagacagcaaggaagatatcaactgttggaaggggattggaggtcttcgatgctgaagtaagttcagaaaatttactgtggacaatagcaagctgagtgttaggaaaaaccacttttgtgctgaatgaaattccggggacacaagtcggcttttaattaccttaggttcctgattacggattcagtgattaatgcctcctggagagcatcagctgcagcaattgctgctgcgtctcttcgttcagtggcttcctgcaaattcagagaagaggtggtgtttcaaggatcaatgaactgcgacttgatcattgctaacaaagatgaattgggagtgcttacctttcccatctttgaaagcacatcagaaactccatccaatggaatgcttccatcggtccatttaggatcatgaagcataatttttggagccattgctttcgtctttactgcaggtgactctatcttcttccgtggctttggcttctcatctacagatgaatcatcatcgttactggatagttctgttgtaacatcactcagtcgtcttgccattgcttcctgcagttacacaaaaaggtgatgatggtcgcgaagggcacctacatgactccaattcaaagataacaactagctgccattgcatatggaaagaaaataaataccagtattttaaattctctctttcctcaataaacttataaatattttaagtaactgcaagaaaatcatgccatttctcatatatgtactgaatcaagcatttgaagtaaccactgttttcactacgattagcctgttcaaagtagagttgtactatttgtctgttcactacaacaagatgaatgtgcagtgcatgtacaagtatatagcaatagtagcatagcaagcacatttccaagattgcaattgcaacacaaatgtaaaaatgatactgacctgtgtcctcagaatagtactcttatccaccttgaccttcgatttcatcacagagccagccgctgctgcgattgaggtattgtcccagctcttcctccccggcttaacagccgacccattcgtcaaatccgtcatcttggagataccagccaccaacaccccgaccttcttcttgctgctaccttccccggacagcctccgggagctaggagacagtgacgcgcgcctcccaccgggtgcgggcgacgccgcccctctcctccctcctaccggtgacggctgcctgtacctcgatggcacgataatcgctggctccctcgccgtgcggcgattctcctccttggccgaaacaaggctgggcaccacgcatttggaaggcgctggtgacgtcgccctgggcgtgcccctgaccgcaggtgaggacgctcgggaagcgcccttcaccgagggcgacgaaggccgtgacgcgccgcccttgaccgaaggcgacggatctcgctgcttggacggcgccggagacgagaaccgcctcttggcggctgaaacggcgggcggcggcgcggcctcggagacgctcttgggcgcgagaacaatcctcttgacggcatccgttgcatcggactgcaccgcattgccggaactggatggcatgagcggcggcgcggagtcggagtgggacccgggctggatgacgtagccgcgggagcacgcggcggggcgggcgacgagcggctccgggtttcctacgaaggagacgctgcgggaggacgggacggggcggatcccgacggcgcggggcaccgggcgggcgaagcggaggcggtcgaggtggacgaggtggccgacgagttgcgggcgcgcggagacgagggcgtcggcgtcggcggaggatggctggacgtaggtggagtggaggccgtcggagagctggaggaggaagccgttggagggccagagggagtcggcggtggaggcggtgagggcggggactacggccgtgacctggaggacgggggagcggtggtcgccggcgacgcggtcgtcggtgtgcatcgcctgcagcagcttgagcagcacccccggcgtgaccgtggccatggctggctgccggaggaggagcggcggcagcgccgcgatggggaggagggatttgggggaagagtagacgttgggagtggtgaggaggaggatttgaaacggttggtgttttcgaatttcgaaatgccgccttgagttgtgttgagctctgctgcgtgaggcatgtgacaggtggggacaggtaaggcaattgtatatgggctttcagaggccgagatttcggcccatgttgagcccactgtttagtagggcctgaaatggtttgagccaccgtaccattaatcacgatcagaaacagcgatttacatccataaatcgggatccctcgacacggcgccgcggcggcggcggcggcggcggaggcaaattgcactcggaatagtaatttcttcctctacacaatcaagatcacaagacacgtttttctcctctccatacgttgtacgagccccaagagggaatattaggtatcctggctgactggcttgtctcgagtaatcttccttgatcagctctctcctctgtactggaggaatcacgcctcacgcatgactcacaattccaggacttttgggccatttcgctgtggtttatttagacgccaaaccaaccatcccaattgctatctcttcaattcctcttagccaagcatatgaccccatttccacaacatctttgctttccatgcagaaacagaacaattctagatgaagagcaagcaagtctgtttctcaactagtatcgccatcatacaggtacaatagtgtactatataaacaaaaccacccatcgcgcgcgcatgttaattgtggaaggcatcaaagaaaagtgcgcacaaagtgataattaaagagcacaaccagtcagcaaaaaacacaagggaaaaggatggttacgatgattatttctcaacatatcatcatgcaagaaggaccaatctagctaggttttgcgcaaatggttttttttttttgaagggagcaaatggtcttcgaacgtctccatattttctatcttgttaatgcatcttgattaggagatcgaatatgcagtgactgatcttgtaatagcataccctatacccatagtattgagtttactgtctggtttgagaacgtcaccaccagattactgacatcacgtagcatgacgatgtttactcaggagtacttcgtatgtagcatgtaaatatattatcagtgaagatgtaaccatgaatatgataactactaattcctccgtttcatattataagtcactttaatttttttgaagactcgaaactaagagttgacttacagaagggcacgtactatggtactagtacgtatttgtatggtatggcagcttccttgattgctttgttcgtgtgcttttgttgtaagggcattcccaacccaatgactagaatggtgttcatagcattaaataagttgtcacctaggacaaaaaaaaatgatgtagcaagtgaataaatgaggaaagagaaggaaaccatgtcttacatgagacatgatttctacacaacatccaagacatcatgtgagataagtagcattaaattgaaatatgaaatagtggtgtttgcattggaagagttgtgtctagtactagtttcttgatgatgtggagtttatggaaaccatgtctagtgttatgggttgggactgccctaatcacgcacatgaaatgagcagatcgaggataacaataagatgactttggcccctccttaaaacgtactgcaagcgaacgttttctctggagagttgggcaatttcggcggctaaaagcgcaaaagttcaccaaaggtcagatgcacgtacagtggcgcatgcaggactgaaaatgacactgatcaatattggatgagtgagcagagaaattaagtctagcagccatgcatgcatccattatgtttctatacagcaagtacttcgatgaatttgcctaaatttttcggtacgaaaaagccgtgctaccatctctcaaaaccgtcatttcttgcctctgtttatgtaggtaattgttggcttgttggaaacttggaatggcactccctctgaagtctgacccgtgaattagtagtccatatcagtatcgccaatcaagtcaacatacgtatatgtatcaaacgaatggatcgagtactaaaccaagtagtcgaacgctgaaaaagtgcacgatcctctgttcatcgtcatgtagaaagcgctgaaaaagtgcagagttatctgtttatcgtctgaaaaagtgcacaagaaacgatctggagcatttggttgcaaataaatggcaggatcttcaacagtgtctacggtacggttgaagatgtagtagcaaatttggcaaaggagttgttccaaacgagaggagaagcacgactagccccagccccagagtaatcactttggaccactcgtcaaattagttgggctagctgctcgatcagcttcttggctgttcagcttgtaataatttgttttcctctagtgctctaagctcttttcacctcctgtaattatattgaatggctgagttccttccctttcccttgaataaaataagtgcacatatccagaaaaagttacacatgaaattaccatttaatactttgaagaaattaagcaccctcggtctgcagtcagcaaaagttacacatgaagactgatatattcagggatagctcggtagtctgcatcatgtccatgtgttttgtgttttgcaagggggcggggacactgcatgcgtttgtttttctctctgtacgatgagatgatgacgatgttgagtttgattttctcagctgcatgcacagtctatagacaaaattatttcgtctaattttccatctagctctcatactgtagtactactgtattacgcggaagtgatgaatttctagcgcaaacaaattaaggatcacaccacacggccggaagaaagatgcatgtgtctctgttcatcgagctataagctactctagttgggacagagcatcgacaaggatgtcctcgatcagtcgtccttgaggcatctactgccttttctctctttcatcgtctcaaacaagaatgaatggtgattaaaacgtgatagatactctagatcggttggtagtactagctccaccgcgagatgaacaaggcagatcgagtggctctacagtacagcacagtgaatgagacctgaaacaaacgaactgggattaatttcaagaaatatcagctggcacaagtctgggactaacagtagcaagtcaagtgcatgttagctgctaacatcttgtatgttcagctgaataatgttctgttgtttataatgtgtgttactcatctctgtcaagtgttacgcacttccaagctaagctctgctccatccatcatcgatctgtgtcatatcaaagcgtggtatagcaatatgatactagcagaagaatagcctaataataaaggattcccacttctaaacaaaataaaatattgctggagataggatctgtttgctactcacatcaggtgtgtttagttcatgctaaaattaaaagtttggttgaaattgaaacgatgtgacgaaaaagttaaaattttatgtgtgtagaaaaattttgatgtgataaagaagttaaaagtttaaagaaaacttttgtaactaaactcggcctaacacagaaatggtctcaagtcgctcggatagacggtcaagtactcacaaactgaacatgctgctgtatgggctagccgtctataaaaaaatactctctccgtttcttaatagatgacgccgttaattttttctcacatatttgaccattcatcttattcaaaaattttatgcaaatgtataagatataaatcacacttaaaatactataaattataaaacaactcataataaaataaattataattacataattttttttaataaaacgaacggtcaaacatgtgagaaaaagtcaacggcgtcatctattaaaaaaacggaggtagtaggaaggaaaaggagaagcagttccatttctccatctaataataaacaataatctttgtaatattacatccggggaagaaaaaaatgaactcccctgtagctgtatatatgtactgtcctacttgtgctttactttcacaagcctgtattaatcctgcttaattttcctattaacatggatgattcttaaccaaccagtagctagctacaactaaacaagatatagatgtaaattcctctgttgtttgcctgggtgtttagtgctttgcatctaggtagactctgctgctgagtcgctgacaggtgggaccccgagcttcttatcccagcaagcaaggaaaggaagagatgtggtctaggcggagcaagtcctccgtagcagcgagctgccgccgcggaacatctcgtcgatggcgatgacgatggccatggcgagcggcgcgcccaggcggggctgcgccacgaggcggaacacgtcgtccccgaccgactccttccgcctcacctccgccacggcgtccccgcgcgcgtcgcgcaccgcgcagctccggcgcccgtacgagccctccaccacgtaggcctccgggagcggcagggaggaggagagcggcgtgacgtgcgcgatggccttggacttggaggcgcggaggccgacgcggcggcggcgcacggagaggagcggcgtggcggtggaggtggcggcgccgtcgccgtcgtagatgatccagctgtcggagaggctcatcctcttgcggcggatggtgaggagcggcttgccggcggcgtccatgaggacgaggtcggcgcgccttgagctggtggagtcgtagcagtcgaggcggaaggcgaggttgcccttggcgtcgaagacggtgaagccgtggcagttgaagaggagagacttgcgccacaccgtgagcaccaccgggggctcctcttcttcttgttgttgggagacgatgctgctaatgcagggtggctgtggcgcggcggcgacgttaggatgcaccttggcggccattcttgcttgtaaatttcttcttgtcgattcgatggacagaagaagagaaggagcaagtgcagaggaggtgtgttgtttagaaataggaatggttggggttggggaatggaatgagtggagggcgcggggaatttataccgcgcgaggtggtgcgtgcttacgtggtttgtgcgtggacggcagccgctagtgcgtgggcggggaggggggagcacatgaatgaatgaagccgaaaccgatcgaacgatgcagacaaatgctgcgcccgcggctaacactaacagcggatcgagtattattagctttggatccgcttaattcgctgtggtgggattgggtgccggcgcatcttcatctgcgtgtacatcagatgcagattttagctttgatttttgtttcttgtaaaagcttgtatataaagttaatttaaaatatcaattaatctatttttaaaatttgtaataatctatttttaataatatcaaataaaaacatattttttaaagtttatatataaactgttgtttccatgtggcatgcaacgcgcgagcggcacgtaggatccgaatggagcgtggtaattagggatcggaatgataattctatagtatgtaattaacttataatatacggagtaacttgtttgtatgtaagtactgaaaaatatataattttattcattagagattacaatgtagttatattataattacattacagtatattatatttatatttaaaagtttttacccgaaaacgtacactaattttttagcagttttacacgtatattctatctcttagaaacaagatcaaaatgtatcaaagtcacgacagaagtcttgcggtcacgataaactaacctcatcaccacacttgactagcacaaatttttttctctgattgatgattttatttgcatatctctaccggtttttaatcttttgtttaaggtttaaggagccggttttctcggttggacgcatggggcagcggcaagatcaggatggatatatgcgtcataggcggcggtggacgaacatattctttgcatgcctagataagacttagccacacaccgacttaatccacttttacttctacaatcaactcaaagttattcccccacagtcttctaaagtgttaaagagcatgtaaagctataataattgaatggcctactgccaaaaataccaaagcaccggcttgtcaaactacatctcgcacatactacgtactcaattcgacatctctaatctattatataattaaagaaatagaaaaagaagcctccacgttcgctctcatggtctagaaattctcacattaatcggagaaaaagaaaaagacagagtccatatagaaatacaatttaaaatagctgaaattcggaattaaaaaataagaaatattagaagaggagactagagtctatatagaaatacaatttagaaatagttgaaattcggaattaaaaaataaggaatattagaagaggagactagagtccatatagaaatacaattaggaaataactgaaattcggaattaaaaataatgaatattaaaagtagagtatagaggccatatagaaatataattaggaaataactgaaattcggaattaaaaataaggaatattagaagtagagtatagagtccatatagaaatacaattagaaaataactgaaaatcgaaattaaaaataaggaatatttgaagcagagtatagagtccatatagaaatacaattaagaaaaaaagaaattcggaattaaaaaataaataatattaaaagtagagtatagagtccatatagaaatacaattaagaaaaaaaatagaaattcggaattaaaaaataaggaatattagaagtagagtatagagtccatataggaatttaaaactaactaaaatatagaataaacataataaaattaaaagtagagtttagagttcgtataaaaatacaatttacaaataactaaaattcgaaattaagaaaaatatgggaataagagtttaaagtcaatacagaaatacaatttagaagtaactgaaattcgaaattaaaaattaaagaatattgaaagatgagtttagtgtccacatagaaataaaattagaaataataaaaattcagaaataaaaacaaatagtattggaagaagagcatagagtctatatagaaatacaatttatagaaaattcgaaattaaaaaaagaaatattaaaagatgagtctagagtccatataggaaatatataatttacaaataactaaaatttgatattaaaaataattaataactaacatgtatataaaatacaatatgaatattacacattagtagttttgtaaagttattgcaaaatttaaaattatgttgtcattttaatatatttgaataatataatgagaaaacatatatactattatatgagagaaaatataatgctgctagccgcgcaatctgcgcgggccaccatgctagttaaatataatattttaagcctttacaaatatattgctatattctgataacatgttgatttctcttaattaattgctattcgctaagcacataatttgtactaatttatatttagaccttctaatcttcattctcgttgccgattaagatctaccttgatttgtacaaataaccatatttaaaccggaaacacatcatgtgtatattagtttcacgtgtaaactaactaacaaatgtgaaaaaataaagaagaaatacttaaatagtgttacatctaaagtcttaatcttaaattcattatattttagccataattaaaaattatgatatttttaagactataaatatgtcggttttgtttattttgttgttctctatgtacgatgaatttaaagatgggaatttacacgtagatgtaatactataaattatagtgaaattacatgcatgtataattttttatgatatttgttaattggtatgcatgatatgtacatatgacgacttgtatgtataggatacgtttatatttaaacccatctagacaaattttagtagcactgattacatagttgtattttcgaatgtttttctttcaataaatatactgatctatgctctatacccaagttttattaatgtgatgtagacgtatgataagacttgtatgtatatatgtacagtaaaacatggataaaaaaatagaaccatctatacattgcgtaatccctctcccttcttaaaaaaaaataagtcacccctctgccatcttctccatcttcccatgcaaccatcctcatggagccacaaattaaatccgccttcaccttccattctctctcctaaccctcatcttctgtattctcgccttctcggacttcattgatcgtatctccatcctccttcgactccggcttttcccgctgccggatccgtcagtccgtcaccacactcaaaagacacaagagcttcctccccgtcagcgggcccaaactgtcccacactagtgatgagctgcaattatccaggatatttatctaagcaagggaacacctccaattagctcattagagttcgctggagctgcaaaattaaggttgtgaagcacgaatcttgaaacggatcgatctgaaggttaattagacattaacgtgatttcttctcttaaatcacacgtgtgaggtagtattttcacatgaaaattgatatggatgaagctagagtactggaaactaaaaacagatattcccaagtgattaacagtttttttttttacaaaatatggttagctcggcaagatttataggtggagaaaaagtgtatctattgtttcggatgtatccaagtccttgcaacaaatgacattcatcctaattctttggttaagatgcgcacaaataaatcttggaagatgcatggtgcatctagaacaaatgcttcatgatcagctagcagctggtccggcatatgctggcaaaataattcaatttgattcagatgagatgattcagggagatatgccggccggggacatcctatactttggaacaattgaatagttcacacaagtagctactagatcagaatatttctacatcttaaataaccatgtgagccttatggatactgtccacgaaacaagtacgtatggttaataagctagccagccagccaaccagccatatatgttcttttcgcttgactaccatattattcttatttttttaaaagaatatattttaaatgtctatatatattaattatgcagtaatggagtgcatgtcttctccggtaagccatagcccatagggctataattgctctaacaactaaatcgaacatagcctacttgctttgcactgtataggtcctgttagtttccactcagtggatgtaattttgaattttcatggcacgtttttcaaactactaaacagtacgttttgtgtgaaaaatttctatataaaagttgttctaaaatatcagattagtctatttttcaagtttgtaataattaaaactcaattaaacaccaacatactccatgactccatctacaaataattaaatccatatatatcgcgtaattgataattttaggttttctctcctcaaagttttgaggttaatttataactatactcctcatactcatacttaaaatatacctctaaaaataagtaaaaaaataatcttacaggtttaaataggatcaggaaacatatattgataacttcttgcattttttaggtgtatagatatttgtgttaattaagacagctatataccttcaccttggagctatacacctctgacctccgaacgaacaatatgaggtgacgataaaagaaaattcttggtattgccaatcataaacttgctttttaatggtttaattttttagctctcagacaatgagagtatatacctctcaaggatgaaagaaaacctctaaagattattggatgcatttggaagaatattgacaattgacatatcgtgtagtcagagtcacttgcagtagtgtggtgggcaaatgagaactattctatatatactattaatctattcctgagaatatagatggtaaaataacgcgtacaattatttattcttgtttataaactgctggtgcctatatttccactagcgttaatcggttatgtttgtccgtatataccatactaatttgttcgtgtgagatatactatggtcagctagcatctgtcgctgttgctatgggcatatatatgcattacatgtttgatcgatgcaacatatatactacacattttgtatgtttagacattaaatcatataaataccagtcgtggatcgatgcaaggggtgggttggctacagagttcgaggtaattaaccggagtccaatgatttgtatgggttaggcaaattcagagaactcagacacatgaagtaaccagaagatgtgtatatatgcagtatgcatgtgcaactcttggcagtatgttaactaattgccttctcgatatgatccagttaacatatactagtgagtagacattggaatggagttcgacaatagtatatcctggatagcttgttcctctgcaaggggggcaaaagcagagttcttctccttctatacactggctgcatgcctgtgttgaaggcaaagatggagacagttacctaacaatttcgttcatgtgtgtctgatcactcaagtcatgtgctttgctaagcatacatctctcgttgatacttcctatgtcctaaaataaaaaaaagagtaaaactagataggatatttcctaatacagatttatagtactatagaatatcatattcgatcctaggtacttatattttaggacggaaagagtgatatttattgttttgaatgagtttgatatcaaattataatttttttaactataaataatttttaaaatatttatcttataaatatgaagactaggtatatatagattcgtcttaaaatgtacttcaataaaatcatatatttaataatttttctatatgtattataataaaaaaacagtgactgaagttgttttttagaccgtgtttttctctcaaagcaataagtattagtattaacctagagggagcagtacctaaattgtcttcgcaaacggcttaaaatccttatcataacacatgtaatggcagtgtgtattagctcctaaaactaacataccattagctttctgatctggaagtgaagaggcacgcatctacagctccctgcccccacatgaagtttttgggcttatttggtttgataccaatttactaccctaccaaaattttggcaacttcaatagtagcaagtggatgtttggtttgctaccaaattttacccaccatagttcaaattgaatactatctaatttggtagtgccaaaatttgccaatgttttggtactatccagattttggtagggcaaaaattggctccaaaccaaacaagccctttgtttttcctcttgaaagattgtagtactgaaacaccatgcatatcgtatcgttttgatatgcttttgaagtattccatccacgctatgtagctatcttttttgcaaactgcatatgcatggttcgccacatgcatgtcatggtcgaatgatatttcgctgccgaacaaattaacccaaactctaactgtagcttaaagctagattgattttggactgcacgggggctgtctcctgcagagatcttggcattttctaggtcatgcatgcatatggacaactttgattcatggttgatatttatttggaatgttgcaattgctcattgctcatgtgctagctgctcaattagttgcttgtccaaggtgcttaagacacagaataggcatgcatgcagctttgcaggtttgggagggaacaaataacgccatcaaaagcacaccatccaaactgggccatgtggtcactccagcttagctgagtgtatatagttaaatatccagcaaaatcttttctttttcggttgtgatgatcgatcagtagtggtagtgaagctgcaatataatgtcccaatagcttttccacaactgtcaggttatatttctactatatgctacatgtgcttgcacagttcacccctatcattccggttacagtgcaattaggctagaagccacactgtcatattttagtacttcctgtttgtttccgggggggggggggggg

SEQ ID NO: 12381 - DNA, 11914 bp, Oryza sativa
gggggggggagggaatgggatacagatgtagcaagcatatacaaagtggagtagtaaaaaataattgtgggtattgtgctaccaactttctgaatttgtttttgtttctgttgtatctaacctgatttaaggattttcgaatatgacatgataacactagctagattgctctaacaagtgcatatatattacaggccagacactagcttaatggaaaattacaaacctttgaacatgcaaggtcttaaaaatagtcctatatttccactgctgttgactgaacactatcttgcactagttcattagtattatctgatcaaagtcaaacagcgattgatcccgtgcaagtaggtagtgagagagagagagagagagagagagagagagagagagagagagagagagagagagagtacattagatatagaataataatcaggcgatcattgcaaaacctacgcagaatgcactagcatgaacaagtgatcaagataaacaaacagacacaattgcagattgatttatctcgtcaagattgatgagcatgcagcaacttgtttaatgtcaagtcaccaaacaatgccaatatatgcctgcaaagtgaaggtagcttttcggtcacaggtgcatgcatcatgttcatatgaacgacaaactactttagaaagtacgcacatgatcgatcatcacttcactttgaagtggatttgcatgacaactcctattcgatcaggcagtggacactatgctccctatatgtatactctagtttaattagtttgttgagagcaaaagtcaaaatgattatttagtttatccactatcatcaccctatccacttcactttttcagtaagtcaaccggacatgattgcattttcatcgcggtgtaagttttttttttgtgagccgatctgaagtaggagtattaggttatgttctttactctgtgttcccaacttcacacccaatcgtcttccacggacatgtttctcagactgtatatatttttttcataaattttcaacaggaaattttctttaaaaaatcacattaatctattttttaaataatatttaatatttaattaattatgtgctaataaatcgttccattttattgtgtgggagatgagttccaacccattaagaagaacacagcattcgttacatgcaccactcagctttgggccggtccagacaacaatatgggcttcagatgggccgtaaaaatgcaggcccaccttaattttaggcccataacaactctacattgctttcctcctccgtcgattcgtccgccgacgagacggcagctgatgcttccggtgctctccgccgacctccgccgcgcgcccactcccttctcccttctccctctcgctctcgctccgccgccgccgccgcctcctacccttcttcggcgccggccactgcttctgccgcgagccatctcctcctctacctcgccgccgccgggccaggagatggaggcggcttacaagttcgggccgtacaagatcgacgcgagggaggtgttccactccacgccgctgtcctacgccatggtcaacctccgcccactcctccctggtaataatctcctcactcccccttgctcagttttaccacttgatcgatttactctctctaatcgcctccaatcccccttgttcagtaccacagtacagtcccaaaacttgtagcggaaattacagagacgggttaagtagcttgccattgctaatttgtttgatgaccagttcgcgaatcatactgtaactgccaaatgctaacaagcacgtttttttttcttgaaaagcacaatgtacacgcagatactagctagtctgttcacatataatagtgtttttctgcaattgatctcttcttctgcctaacagattcaccttaatacagtaccatttcaccgttataccatatgcgattccgtcaactttgaccttgctgttgctgcatgcatttaattcctgttatattgctatatattggttggttcatattctgctcttctttcttaaccatatcattccttattgtgcaggtcatatccttcaattgcaccaaaagagactgctactttttttctgcaaactgctgttttggagatatttgcagttgatttctttaacgtgccatactgctagctagttccgttgggattgtcgataaaatgagcttgcttttgctggcttgtgtttgggtaaagtttcatcaatgcattcaaagtaatagtaaatagatgggcctgtggaatttatttattcatgaaaggattgtgttggtttacccttctatacttgacaaatatcaagtctggcttaaggtcaattttgtggattggctgaagaggtgatgtaggtgtttattttgccgcatgtcatcttacttgattgatcatcttagaggatgtcatctttaccatgagattgatataactgtcaattgtactgccgtgttgagcaaatcttacataaatttattggttagccatcttcttttgatttatactgtggtatattgagaatatgatatatcttatatgttgttttcccttaacaatatacaaatgttctagtgtgccccaagcgtgaagtgaaacgatttgctgatctaagttctaatgagattagtgacttatgggttaccgcaaaggaagttggtatacggcttgaacagtaccacaaagcgtcttcacttacatttgctattcaggtaaggtctatgtatttatgccactgcaattagtaggaatttgtattttcattatttcaatgcttaatcataccatcaagaggagtaccatatgggttttgcttattgggggtctaaatatgatgatcttattgtgtgtggaataaaaaaaaaccattttcccatacaagtattcttaacttttttttaatcatttgccctagctataactttgcatgtctgtcttgaattatttttttaatataatagtaatattaagctatttactcattagttctagtgcttacaggatggtccacaagctggtcaaactgttccacatgtccacatccatgtcatccctagaaagaaaggagattttgagaaaaatgatgagatatatgatgcggtttgtggcatattcctcaatcgacctccttttatccaatacttgaacccaatatttaccacaaaattcttactcagttgctttctaatagattgatgtcaaagagagggaattgaaggagaaacttgatctggacatagagagaaaagatagaaccatgaaagaaatggctcatgaggccaatgagtaccgtggtctcttctcttagatgtaatttttgcgataaatttcttgtaaactatctctaaattgcagttactcttctccagaaattatttttgtaactgtttgtcatccatcatgggaattcaagtcttcgaatgatattatgaaattatctaatttggtacgatacttgtttgttgtaaaatgtgttctttcttataaatctttatctttgaaactagttatgccacggtgtggcagtagttgtttgttggaaaatttatatttttatgacagatgcccctgtaccatatgaaattacacagccatatattatcagtagctggctgggtcatactatggtttcacaatctacaaatagtaacaaaatacattgtattacctttcagtacctatttgaaagcctacttaaaagaaagaaggatcattcttttggtgttttggatcaaatagagttgcaatccatgctatcaacacattgcattaagtttcagctgaaaaattgacttttcttgagatttccgctgctcttcagttattcagacacagtattttggtcctttgatcatgctagttagaaagtgtgttctctcatgcttatgcggattgctgtgataaattatgtttttgtcatgttttgttgagagaaaagccagaaattcgacatggcatagtagctgacagtttgttagacaggatggataactcaactttctatctagctctttgtgctgagtcaaagtttttattccttctgccgactgtccataaagtttgtggtttagcagaatcttgcctaagtctaccatcttggatgcgatatattgtttttattaccttgttactgttagtctatgcatctagccaacattggaaaagttaacctgactcattaatacaataattctggcaatttgtggccaatggccgtagtcctggctaaactatatatcattctgacgcacctttctgataagatcatgaaaactttaatgatctgattgaaccatgaaaatactactttaattttgtatcattgtgtagtttttaccttttttgctgcttgtttttgtctcctgtgaacttttctttggttaagggactgttccatcaatcccatttaatctaatgttattagaacataagaggctctgattttgattagtctccagtgttaactcttgtgcttgctttacgcatatacattctggaagatagctcaagtaaagtaactggttagctcttaatctctttttgctgatttttttttctgggacttgagcacctttggtcattttcatctttgcatcatgcttgctaagagggccattgagatgataagatgcactgaacagaataattgattatgcatatatgccataagttgcaattttgatacgcctgtagctacctttgacaagtggtaaagaacaatttgattggcaatttggctggttgtgttctgaagtgggatgtgactgttgcaccagacctgaggatttggtaacggtaagctatctggagcccctcacttgttggctgggattgttgccggtgtactaggtaatcaacaccaagtaagcttctgtcgtagtcgtgtgacctggtttgcttggcttgcataccaaccactggttgtctctgctgcgtagaggctattgttgtgttgagtacgttgttgcaaatattcgctggcatatataggtagtatgcatgcttcatctccatcagcaggagattctcatctgcaaatgcaaaagtagttctttcggcaaaaaatatagtgcctcaggtatccactcagaatagcaagtgcttgtcgttctcttgctagaaatgtgcactctgaggtcacattatgcgtactctttataaagcctgaacttttcgcaaattttcttcatgtgaaatagttgcaaatacacaaaatttagcacaaccttagttacatctcggctgcaatatataaaatttacagcaaactactactactgcggtttagatggtatttttccttggatttgatgatttctccactatgaactactgaatttccagatgatgaacacgccattggtgtgtagggcctccggcagatacggtccatgacaacgaccatagccatgacgaccgcgacatcgacgcctggcctgacgacgagggtgaacacgtcgtcgccgaggctgaccggtctggacatcacgccggcgttcttcctcgtgatccgcgctgcctcctcgccgttgctgccacggatcttgcagctcctcatggagaagcagccgtcgattctgaagctggggctgggagaagcatcaggtaattggctgtcaccacttgttcttgttgacatgaaaacttctgcttcgtcgctgctctgaagagctgagctcttcctcatggagaagacttgctgctgtgacactgaaggagagctcgtgctgtccaagccttcttcctcttgtgctctgtaacagttccatcgattgtgcaggctgagaatctgtcacattagagcaatgaagattactttttaatttactctgattatctgtttttacattgcttagtttcaaaaatagcggctgaagaaaagttgacaacgaatcatgcagatcatgtttcttttattacttctttgtcacttaactgaaaattgcaagttgcaaatggagagatctaatgtgaagcacataaaggttgaaaaacaatatataatatgttattatgatagaagcattttgtttgcttgtttcaggatttggttgcattttgcttggacatgtcctactcgatagactaaattaattaaatatttttatcaatagtacaatatctttcacattagagcgatgaagattactttttaatttacgctgattatctgtttttacattgcttagttcaaaaatagcggctaaagaaaagttgacaacgaatcatgcagatcgtttcttttattacttctttgtcacttaactgaaaattgcaagttgcaaatggagagatctaatgtgaagcacataaaggttgaagaacaatatataatatgttattatgataaaagcattttgtttgcttgtttttggatttggttgcattttgcttggacatgtcggcctactcgatagactaaattaattaaatatttttatcaatactgtacaatctttcaattattatagagaatgacgcatggaacatactagtatatagattttctttctttggtttgactggtcaatatctgatcataaaagattttttaagagttaattaggaccgcatatgagatgaatacagtaaaatttgtcgtttgagactttcaggactcaaacaattggatttttttttaatcaaatcatcagagaacggaaacaaggaagcaaagctataattttatacattggagattaagcatatgtatatccaacggttggattccaacctcgaataggtaacgcatgtttggctgcatgattaatatagcagcaaagctttgatcaaagcaacaaataataagactgaatctttaagttgagatgcaaacttgatgcgcatgtatatatggatattgtagtttgatagattatataaatattgcagctagctagcttgtaccctgaaatttctttatctaagtaccctaaatttttggactgaaagcaaagcagaagcagtaagcacacggccatcgtctatatattatggtaggaaagaattaaagtgagaaatgcatgaaagagaattaaagacgctaatcccaggtcccaacctatcttaagatatatacatgattccaaactagcaaactaaactgatcgatcagtaaacaggtcgctgctaaagcaataaacgagtggagctagagaagaagtaatgaagtgaatgagaaggtgatcgacctgcggcctgagggagagaagaggcgtgccgtggccatccatgagcagcaggtcgccggcgaaagctttgcggcggcgggagtagttgtcgacgcggaaggcgagcttgccggcggagtcgtagacggagaagccatcggtgccctggaagcctatgctggacctcttccacaccgtgtacaccaccggctgatctgccgcctgacgacgtgcacggccgccggtgccgccgccaccgccatgagaggggtgtatctgtatccttctcatgctagctatagcttgatgaggctggtggaagtaattaactaagtttgagagggagggaggaagctataggctatagcttatgttacctaggggaagcacaagctagcaaagcaagatttagttgggccaattagatagctaatcggtcgatcgatgggcgatgcaacgtatggacgtacgtggttgcctagctttgcctgcactgcagtctgcagattgggttaattattaatgcaagagagtgagagcagctgaaatgggccggcgaaaaggacatgcagcttaatttgctactagctaggaacgaatagaagtgaaggtgtagacaaacagtgcagggcacgttggattgggatttggcttagcgtgagggagctggcatgcatgcatcgccctacttattattcacaaagcagaagatcgcagggtgaccaggtcaattcagagtggaaatcagatagagaaagtgacaaaattaatgggcctgatttgaatagtagtagtatttctgatgggctttctttgcttctactgtgggagggagagcccatcaagatcattgacttgacttgacccggccccacagtcccacaaccattgaccatttgacccaacgcaactcaactgcttcttcctcttttccatctccatcgccgtcgccgtccaggaagagatagaagatggatacggtcgcgggaagcaagtacaggtttggtccgcacgagatagacgagcggcaggtgttccgcacctcgcccctctccttcgccatcgtcaacatccgacacacccgcccaggtacctagctatttcctctcctcagaacaaatctatcattcctgattgctctctccctctttgtttgttcatcatgctattccaatcttgcccctgcaggtcatatcctttatgtctgccaattatgtgtttgcacagctgctttactcttctctctcatttagtgccttctagtatctacttcacattgcggtaatatctgctctcaacttctcataccttattattattattattattataaaagagaaaaaacttctcttgctattcatcaatgaaatgtgcctctgtttcaaaagtaaaaaaggaaagaaagaaagaaagaaagaaagactctgcactgaactatataagtaatgtacggtatcggttcattgaaaaatggcagtggagtacatcacagtgctcacttgttttttgccttccgaaggggtattgtgcatttgtgctttctatttcaagacaattaatactacctgctttaccgtgttaatttctggtcgtgctaattacttcagttaatccctggtgacaactggcaactcagctctttttgcctttgtcctatgatggattactatgtggcactgcaattttgatagcctaagacttttaacgcccccccccctccttttccttaacttaaattatacatgttcttgtatgcccaaagcgtcttgtgaaacgatttgctgatcttagtcctgatgagacaagtgatttgtggatcatggcaaaggaaattggtgcacgtgttgagcagtaccacagggcttcttcgctcacattcacaattcaggttcgatttatcttgtaacctgtgaggtctttcactttgaatttaagaaatgttataactaaattcgtgtgagcatgacaagtatgatgttgctcacaaaattgtggtttcagatcacaatttagtatgttcgtaacattttttaatgaaaagttgtaaaaactaatgaaaactaactttatcttctattgtgtatgatatgaagttgaataaatttttcgccgggcatgaagttgaataaatattgctacttatcaggacggacctcactctggccaaacagttccacatgttcacgttcacatcgttccccgaaggaaggaagattttgagaacaatgataacaataaaggcatggttagtgatgctgcttggaacaactctcacttcatctgatactccatcaaataaatctgaataatctctctgttcataacagatgaatgcaaaaaatgagacattggacctagatattgaaagaaaagatagaacgatggaagaaatggcccaagaagccaaagaatatcgtgctcttttctcctagaaaatgtctatgtatactacttaactttgtgtggatttcactattcctctagcattcagcttcacagctgcattttacatattacactaatttgttgtgtttttatatcagatgattatactaatcgtattgtgcatactacctgatattctgttgtaatatatgtgtagccgttacttagtaatattgaactccttatttttcatctcatttattttgcattgtgtacatattttactgccagataatatgtttattcctttgtatatgctcaatgtattaggtacagagaacacttcttctgtaaatgataaaccaagtagtacggatcacaccagccctattcgaagggcattcttttgaaatctgaaatatatcatgtcagaatataatgcatatgagtaaaagctgtgtcagtactgtttatgtagcttttggggggtataatacgaggtattatggaatttttttgttgagatgatcactgcaacatgggactttatttcctgatccatgcgggaaatgaattgctttatgtaaagttcctgaatagtttctgtcttccaaaggaacccttaaacagtgacatttcattctactttatatgtaaattaagaaacagagtccttaagtatagaataactcttttgtaattcatacatgttggcagcccacctgtgacattgcccacaaatataaggaattacactagaattttgacataattctacaatattcggttgtattggtgtgctgcactagtttcagtctccccgtattcagcaatatatctactgggttcctctttcattctaccaattagaggctggatcctatgcatgtcgcttccagaatgtattatgtgaacttgtgaatataccaatggacgttccgttcatccttaactttttagtgatcagaagttagatagaagacttagattttgcaaaactcaaacaatgatttctgcagagttgctaaaattccttccaccttgatcaaactattcattttaatttgtatacttagttgttaagttgcttcttgctgatgggaaaccattttattccttctgacaactccgtattaatgtagcgcccgttccgtcgtggcgcctagcgggaaaatttaaattctaaaaaccctaattgcgaaatctatttctttgcttgttgtcagtttccgtgccaatccttgatctcgaatccccgatctatcgtcaaattcaaattccgaatccaaatccttcccaaatcaaattcctccacaaaagtctattttgcctcccccaggttcggtgggccgatttcctctcagcccatctctctctctccccccctcagccctcctctccctcaccccgcacgtgcgtcgcacgcgcgtgcgcgtgagccgacgccaagccgagcgccatctctctctctccgctttctcgttctctcgctctcccactccccgtctctctctccccggcgagccccgcccccgagttttgaatcccccgcgccgttgcttcccgcgcggagcgcgccgtggtggccgaccggccagtcgccgccgccgtcagcgcttgccgccctgtagctgcgcccttccaaaccgcccccgccgtcatcgccgtcgtcacgacccggccccgccaccaccgcgcatgctcccaaggattggaggcagagctcctcccactgcctcgtcgccctctctctccttccttcttttcccaaagtggcaagaggcaagtctcctttcccccttccttttcttcctttttctccccgccggcgtcatcctcccaatcgccgttttggccgcgaccgccgagcgccagctcgctccttgaccgccctaggtcggtttccaaaccgacattgccctcctattaaaccaaggcgccctcccttcctttccctctcccattctccctcgctccaccgcgccattgccgtcccctctgtctctctatcgccgaccgccgccgtcgcgtgtgccggaggagccggtgcgtgctaggacgcggaaggggactccgggcgctcgtcttcttcctcttccccagcccgaggccggagagatcactcccgtgcagtcggcctctcgtcatagcgccccgcctcgtctcggtagggcatctccccgttctccctcctcgttcctcctcttccccttagttttcggtagaagcttgtatagcctccccgtagctagctggcgccgccccgaccgctgccaccgctcgctgtgtgctcgccgccgtcgccgcccgtgctctatagcgcccgcatgtcgccgg

SEQ ID NO: 12382 - DNA, 5003 bp, Oryza sativa
tgaggctgcgcgtgggcccgccacaaccgcacccaccgcgagccgcgcgcgtgcaccgcgtccctcccccaaaccctagcacgcaccgcgtgctccctccgcacggtgaaccgtgtcaccgacaagcgggtcctactcgggaccacgcgaggtgagcctggcccaccggctccctctctcctcctctcctgcgcgtgccttgggccaccttctcgggccggccggcccattaagctcggccgagccgcccctttctctcgagccgcgccctagccgcccgaaggaagtatgtttcccctccctcttttctctttttcaaaagggtttaattaaatcatttttcctttagaccaaaaatccaataatcttagaaattcaatatcttctcaatcgtatgtccgtttgactccgttcaacttccaaaattcctcaaatctcgagatctgtttaatggcacgtttagaggtcaataatagggctttatttttgccgtttgttgagtagtcccatttcgcgtgtagtttcggagcccgaagacccgcagtgcgaggatttcgaggatcaagcaaaagatctcgagcaaggcaagtcacctttgatcatcttgcacctataatttaaatctaagtatttcttttccgcaaatattgcatgaataggatttacacaagtaattcggccgcggcttgcgagatagctgtcacgccccgaactagtcccgagcggaactagcccgtgacgctccaaattaacctgttaatcgataccagtcccaggaaacagcgctggtatcacaggaagacagaatatcacagcaacagaggtatctttattatagagtaggagtatagtcatgttaggctgcggacagatcccgagctcacaactgcatttcaaaagggaagcggaagccaagacttggaccaaacatcacaggcgtgacttgggaactaggccgaaaccctaaaactcatcgtagccggcttgctcttggaagaactcctcgtcagcgggatccgcttcatcttcttcagcaactgggggggggattatttatatagagcaagggtgagtacgggagtactcagcaagccatgggaattaagtgtttaatgcaggcttcaaggaaaggctgttgtttttgcaattgattttatttaaactcttttctgaaacaactaagtgagtgcttctcagacgacacggatgagacagtgcgtctcgtccggtcagagtatgtgcaatgtatcagtcttttgaattgatcaggattggcacccggccaacagctttcaaacggccacccgggcctggctgatcccatcagccgcagattttccaaacatcaatcccaaaccacatcagtaaattcacaaagcagtagtcaaacaaaactacgctaggaatcaccttacatccgcccatgaccgtgggcacagctgttcgaacagtttaataacctttgcagagggggtacactttacccacacgacattactaacccggatcatccagcccgtgcagaacggccacgactagagaccttaaggctttcatgacaaggcatttcgaaagccgacacaggttcaccatatgctgatgagaggggtcccagaccaacaacaggttaggtcccagaccatactgtgccaggaagcccaggggtcctccccgacaccaccccggcgaatccacttgtctctcagcatcaaggctcccctgattagctaattactcagccaggggtgtcccattccacccatgtggtcgtacttgtcttatgttcagatgaaattccaaggaaacggtccttaagtgcaagagcgggaaaccatacacccggtacgttccccggtccgcgattttggaaattcatttaggttcgcaagcaccgacccaggtgtcaggttttccaagtgttttgtaaaacccaagttttacccaagatgtttctctgattttaagtttgaaggcgaccgtcgatactcgtgccgagtgcacaattaccgaggcgcaactaggtggttacaagggaacatgatataacaattacaatggaagggtcagatgtaacaagttaggtaggtccgccaatctgccttgcagacgggacaagcagatttagtgcaatcctatcaatgcataatatttttcaagcaacataattaagttcaaatataggttcaagatgttcaaaggtggcttgcctcgctcgagatcttgagcttgatcctcggaatcctcgcattgcgggtcttcgggctccgaaactacacgcgaaacggaacaactcaacaaacggcaaaaataaagtcctattattgacctctaagcgtgccattaaatggatctcgagatttgaggaattttggaagttgaacggagtcaaacggacttacggttgggaagatattgaatttctaagattattggatttttggtctaaaggaaaaggatttatttaaatcctttttggaaaagaaaagaaaagaaaagaaggagggagggaaattaaactttcctcgggcggctagggcgcggcccgagagaaagggacggctcggccgagcttaatgggccggccggcccaagaaggcggcccaaggcgcgcgcgggcagggaggggagagagagagccggtgggccgggtccatcccgcgtggtcccgggtgggacccgcttgtcggcgactcggctcaccatgagcgaggtgtacgcggggcgtgctagggtttggggagggaggcgcggcgcatgcgcgtggttcgcggaggacacggtgcggcgggcccacgtgcagcctcacggctcgcggtggaccacgcgcgcgagggaggggaaacggagggagcggctggccgggtcagccgatccggtcgtggccgaggtggcgccaacgtggtagccacgcgggccggcgggaggttgaagaagacgtcagccggaacggacggcggacggcggtggcgagcggcggagcgaatcacggcgatacaggcgaaagcgagcacaccgggaagttgcacgggacgaggggagtcgagccaacggctcggatttgccgggggatgctcgatggcggcggattgcggcggcggcaaccggcggagggagaagggggaaacggcgacgaggtcacgagaggccgattcccggcggcgagagcatctacgcggctacgggaatccgttgctagcgtcggattgggcggagctgcgccgagcgaggccggcgacgagcgggcgctacggagcacgggcggcgagcacacagcgggcggcggcaacggtcggggcggcgcctgctagctacggggaggctactcgtgctactacccgagtctaaggggaggagatggaacgaggaaggagaacggagggaggcactaccgtgcgggggtgatggggcgcagtgacgagaggccgacggcacgggagtgatctctccggcctcgggccgggaaagaggaagaagacgagcgcccggagtcttcttccgcgtcctagcgcgcatcggctcctccggcacacgcgacggcggcggttggcgagagggacggcaatggcgcggacgagaaacggggaggattgggagggaaaagaggaagggagggcgcctgggtttaaagggcggcaatgtcggtttggaaaccgactttgggcggtcaaggcgcgagccggcgctcggcgcttgtggccaaggcggcgacaggaggtggatgacgccggcggggaggggaaaaggaaaaagaagggagaaagggagcttgccccttgccactttgggaaaaggaggagggagcgggggcgacgcggcagagggaggaggagctctgcctccgtcccttggaggctagcgcgcggaggtggcggggccgggtcgatgacgacggcgatgacggcggaccggtttggagtggagcggcgacacgggcggcagacgcggggcaggtgcggcaggcgctgacggcggcggcgactggtcggtcagccaccacggcgcgcgcgcgcgcgggcggcgcggcgatttgggcggcaggcgcgggaacggcagcgagaacggagagggaggacttggcgcggctcacggcagagcggagagagagagagagagagagagagagagccggggagggagggggagatgggccgagagggattcggcccatcgaacctgagggaggcaaaatagacttttgcggagggatttgatttgggaagaatttggattcgggattgaacttgacaatagatcggggatttgagatctgagatggcacggtcactagacaacaagcaaagaaacagatttcgcaattagggtttttaagagatagttttcccgctaggcaccacgacggaacgggcgctacaatagcctgccggcccccaatcctaattgctgcaattaccctccttgaattattgaacacttaaacctcctttgtcgactgttgtgcttcgatgcacgggccttcgggcacgcgcatcgggacacctcccctcaaatttaaaatatccaacgatgggtaaaacttggggttttacaaaagacttggaaaaacccgacacctgggtcggtgcttgcgaactaaatgaatttccaaaatcgcggatcggggaacgtaccgggagtgcggtttcccgctcttgcacttaaggaccgttttccttggaatttcatccgaacataaggcaagtgcgaccacatgggtggaataggacaccccctggctgagtaactagctaatcgggggaaccatgatgccaagagacatgtggattcaacggggtggtgccggggagaacccccgggcttcctagcactgtatggtctgggacctaacctgatgtcggtctgggacccctctcgttggcatatggtgaacctgtgtcggctttcgaaatgccttgtcatgaaagcctcaaggtctccagacgtgccgttctgcacgggctgggtgatccgggttagtaatgtcgtgtgggtaaagtgtaccccct

SEQ ID NO: 12383 - DNA, 6627 bp, Oryza sativa
gagatagttttctcgctaggcaccacgacggaacgggcgctacagaccaacccccctgacaagaatctcgcccccgagattcagcacctaagggagcagctccgggaactcggcgcggaggagatcttctcgttcccaggttgcctcgtcttcagaatgattgctccattggaccttgtagaacttgatggtcttccttcgagtctgacgttctgcctcttcaagaaccttgatcggtatttccttgtaggtcagattcttttccagttcgatattatccaggggaacttgttcttctggaacacggagacacttcttcaactgagacacgtggaacacgttgagtacatctgcgagactttcaggtaactcaagctgataagccacttcgccacgtctagcggttatgaggtaggggccgatgtagcggggtgctaacttgccggacatcccaaacctcctcataccacggagaggtgatacccgcaggtacacgtggtctcctttttcgaactcaaggtcacgcctccgattgtcagcgtaattcttctaacggttctgagctgtctttaaatgttctcgaatcagcttaacttgttcttctgctgccttgagtatgtcaggaccgaataccagtgcttcgcccacctcattccagcacaagggagtgcggcactttcttccaaacattgtctcattcggcgacatctgaatgctggcctgataactgttgttgtatgaaaactcagcatacggcaaacaacgatcccaagtgccttcgaaatctagggcacacgcacgtagcatgtcttctaggatttggtttaccctttctgtctgaccatcggtctgtggatggtaagctgtactaaaatttagattggttccgagagcttcatgcaactgcttccagaaccttgaggtgaactgagtgcctcggtctgacacaatctttttggggcagccaaatctacatacgacatgggtcatgtagagttctgctagcttctttccatcaaaggtggttttcactggcacgaaatgagctgatttcgtgagtcgatccacgattacctagatggagtcgtacccgctaggggttgttggcaagccggtgatgaaatccattccgatctcttcccatttccactcgggaatcggtaggggttgcagcagaccagctggcctctgatgctctgccttgactctctggcaaatgtcacacagggctacgtattctgcgacatctcgcttcattcccgcccaccagaagtatgccttgatatcctggtacatcttcgtacttcctggatgaatggagtaggcggactcatgagcttcctttagaatgagatttcttaactccttcttggccggtacacagatgcgtggaccgcaccaaactgtgccttgatcgtctatggagaaatcggtgtccttcttctcctgtattctttttattaattcttttatcccttcatcatctttctgagcttcccggatttgcgattctagggtaggctgcactgtcaagctggcagggacacctgactgtaccacggtcagctttaacttctccaattctctgcacaggcgatcttgggctggccatatttgagcttcattgcaataggtcttgcgacttagcgcatccgcgaccacattagctttaccgggatggtaatgaattccaaggtcgtaatccttgattagttccaaccatcttctctgcctcatatttaactcggtctgtgtgaagatatacttaagacttttgtgatcggtgtatacttcacatctattcccgattaaatagtgcctccagatcttaagagcatgaaccacggctgccaactcgagatcatgggtaggatagttgacttcatgaggcctgagctgcctggatgcataggccacaacctttcgttcttgcattaggacacatcctaagccttgtcttgatgcatcacagaagatctcgaaatcttttcggatatctggcaaggtgagaactgggacagtggtcaaccttttcttcatttcttgaaagccgtcttcacaggctgctgtccattcaaatttcttttccttctttaacagctcggtcataggtctggctagcttagagaatccttcaatgaatattcgataatatccagctaagccaaggaagttgcggatctctgacacattcttgggcgggttccaagcaagtacagcttcaaccttgctgggatctacttcgacaccgttggaggagatcacgtgtcccagaaatgctactcagtccaaccagaattcgcattttgagaacttagcgaatagttgatgatccctgagctttcccattatcagcctcaggtgttcagcatgttcttcctcattcttggagtatatcaggatgtcatcgatgaataccacgacaaactggtccaggtattccacgaagattttgttcattaagttcatgaagaatgctggagcattggtgagtccgaaggacatcactgtgaactcatatagaccataacgcgtcgagaaagcggtcttcgggatatcttcagatctgattttcaattggcggtaacctgatctcaggtcaattttagagaaaactcttgctcctttaagttgatcgaacaaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactttccaactcttcgatttgtcttttgacttctgctaactcattagctgccattcggtagggtctttttgcaattggtgcagtgcctggtgctagttctatggcgaactgaatctctcggtctggtggcatactcgttaattcttctggaaatacgtcgggatattcacagactatgggcaccgactccaaggaggtgacttgtaaacaggttaggatagaccgacttgcggtaggggcgttagaggtaaagcggacttgctttcctccaggtccttgcaaggtgatggacctttcggcacaatctatctgtcctttgtgcttagccaaccaatccatccctaggatgatgtccaagctttgcgagtctaggactatcggtttggctaggaagtcaacttcctcaattctaaggttaactcccgggcatatttgagttgcccttatattccttccaggggaatgtactatcattggtacacgtaaattttgggttttccaaccatttcttttcacaaaagcttgtgatatgaaagaatgggaagctcctgaatcaaacagaactattgcgggtacggagttgacaaagaacatacccatcacaacgtctggagcatcctgagctgtctcagcttgaatgtggttcacccggcctcgaccaaagttgttggaagcacgagaaccttgtccacttgcctgagagctaggtcgagactgagctgccgctggagtacgagttctggcagtgctgccattagcatgccctgagttggtgttggtaggattctgagggcactgtctggcatagtgacccatctggttgcaccggaaacactgaactgctgacagtcctagcggtgacttgaaagaggtaacactgtttggtgcagtattgccacttggggtatgttgctgtggctgaggtgccggacggttcatctgaggacgaggggcgtagcccggctggcggttagcctgagtgactgactggtgatattgcatgggttgaccatagcgagggtgaggtgcgcctagggaagaattcccctgatggttagacttgcgtttcttatattcttcggtagcctcttttctagcatcctcaagtagaagtgtcttgttgatcatatgttgaaaagtggggaagtcatgagcaagcaactggagtctcattccaactgcaattcccttcaagaacttcctgatcttcttcttgtctgtgtccacttcctcaggggcataccgagccaacttgttgaactgacttaggtactcattgacaccgttgttgccttgcttaagcctgttaaattcctctttcttcatatcaatggcgctttcaggcacatgagctgcgcggaaagccatagcaaactcaccccaagcaatgttagtgggttcagggtgtgcattgcagtaattctcccaccaatctgcagcaggtcctcttagctggtgagaggcgtagagcgtcttctcaacaggagtacattgcactaagttgagttttctatcaacatctttcagccaatcgtcagcctcgatgggctcgatggtctgagagaactctggcggacgagacctcagaaagtctgtcagcttggatctattgttgcccatgtgagggtggccatttccatgtgcattatgctgaaagccggctatggctgcggctaatccttgcaagatttgtgtctgtactgccatcaagtgctgcatgttgttttccacatgaggtggggaagggatgcgttcttctccagaattgtgactggcagtgcggtgagagcggtgagactgttccacttctgtattacgggaagctgtgtgatgcgagcgattgctgcggtggggttgctcaacttctgcattgcgggaagcagtacggtgcgaacggttgctctggtgagactgctcattagctgactcatgatttgcttctggctcaactctaccttcctcaaaaccgaagcaggctggtgtacgagcagcacggtgggggtggctagccatctaaactcccagaagagggcgaggtaagaattagataagcacttaggagggcaaggagcaaagtaaataacaactcagatagcacgcactaggcataaactggatttttcaaatcataaaaacacctgatacaacgggtgtggacaagtcacagagctacgccgagcttgactgtacgcacaccacctagaagaaccagactaccaaacaacacccacatcaaacacacgcacgcactacctcgccacgactccaaaagagttggcggcggaacaaaagggcctaacacacggacggctgctgaagactgcctcctctactcctcgtctgcctggctgcctcctgtagtcggctcctcagtcgaagaaacgtcgatcggctgacgcgaagggaccggcggaacctgtcgagggcccccaacagcacgggccgctagcggtgggggagctgggtagtcgaagcagaacacggtggaagaaccaacaacacgcttccgcgcagtgcggataaagcgtgggccacggcgggaggaagcaactggggtgtgtccgggggtgtaggaggggctaactgggtgtgggtagggggagtacacttgtgagtacggcgcacgcgagctgggggagcgcgggccactgggagtgcgggcagagccgcgagagctgtgggaggacaggtggctggcgtggcagaggcggcctgagtcccaagagacagtgtcaactgaggtgacaccctcctcggccagatgggcctccagagcggcgtagcggcgggcaagggagcagtaagcctcgaggagtaggttgtgctgagtggcctgagcctccgaaagctcaaccatgcgagtcagcactggctgagactcgttgtacggacaagggtacctggcgtctgcgtggctagaaggaaggtgtgggagctgccggaaggcagagcccccaagacggtggctgtagtcgtgggccaaacgacaaagcgcagtccaggagaggtcctggtacgcgatctggagagtgggcctggccatagtgaagtggtgtgggcgaaggccagctccgtgtatacctccacgagggtaaaggtacacagagagctcacagcgagggggaacacggtccacggagtaccccgtgtactcgggacatgagaagccaaggaagcgggcgaggtcacgaagctgagcgacgtggtgaccctcaccaaaaccgtgggaactgaagctggcgttcactgccatctacaattttgaaagagggagaaaagatcagtaaccattttagcaacactactgaaaataaagaaaccaaaagaagccttagcttttcgcaagtagttttgaacttagtatccttagggtcgtcctaaacgtcgggtttcgccctagggccaagcctgtgctctgataccatctcttgtcacgccccgaactagtcccgagcggaactagcccgtgacgctccaaattaacctgttaatcgataccagtcccaggaaacagtgctggtatcacaggaagacagaatatcacagcaaacagaggtatctttattatagagtaggagtacagtcatgttgggctgcggacagatcccgagctcacaactgcatttcaaaagggaagcggaagccaagacttggaccaaacatcacaggcgcgacttgggaactaggccgaaaccctaaaactcatcgtagccggcttgctcttggaagaactcctcgtcagcgggatccgcttcatcttcttcagcaactgggggggattatttatatagagcaagggtgagtacgggagtactcagcaagccatgggaatta

SEQ ID NO: 12384 - DNA, 12652 bp, Oryza sativa
ttgaatcaattcaaagactgatacattgcacatactccgaccggacgagacgcactgcctcatccgtgtcgtttgagaagcactcacttagttgtttcaaaaaggagtttaaataaaatcaattgcaaaaacaatagcctttcctttgaagcctgcattaaacacttaattcccatggcttactgagtactcatgtactcacccttgctctatataaataatccccctccccgcagttgctgaagaagatgaagtggatcccgctgacgaggagttcttccaggagcaagtcggctacgatgagttttagggtttcggtctagttcccaagtcgcgcctgtgatgattggtccaagtcttggcttccgctttcccttttgtaatgcagttgtgagctcgggatctgtccgcagcccaacatgactgtactcctactatgtaataaagagacctctgttgctgtgatattctatcttcctgtgataccagcactgttttcttggactagtatcgattaacaggttaatttggagcgtcacgggctagtttcgttcggggctagttcggggcgtgacaattaataaccatatatgtgttattaccgtattgctttcatgctttgtttgtttatgcatctagcaaacaaatcaaaagtgtcttaaataaataaagactggtgagtataagacaaataagttgtttgtaatattccctgggatttgtccatattattgattcttctaatatttggtataaacaaaactttcttagtacactaacacgctatcttattgcagtatattgtcgatatctttcgaatctttctgagagggactgcaaatcttaagcacatgtacaatgcaaatgaaacacagtgctggtttgaagaaatcgagtaacacgtaagcatggatactcaccatctccttctccggctctctcttcgtggaggacactagttttgcctcttcttcagtgtgagtatacccaacttgctttatactgctaaaggtagctgaagtcattgcttatatcttaattctattattttgagcatttctcttttaggattcaacaaactttggtcacttttgtcctttgcattgtcctgggcatgaatagtgctttgctctgatggtgcttctaggtggatagcattaaaatgatactgcccaaacagttggtaacagctcacaattggtaacaagtggattaaaggaaccacatgggaaaagaaacatgcatttcaagttgcagtaggaaagcatcctactgcaacttgaaatacatgtttcaggcatttcaaaaaaaaaaagttgcagtaggaggaagcaagagattttgattcaatctgcaaattcgatcttcctttcttaagtagtcaaatttagaacaagttacatgttatgttagtcccagtcaatcgacagtacaattagtgactacagtctcatactagcttcttgagttaattcgtcgatttcacttgaattgaaacatctattttcctacatgtcaaatagagctcatcaccttgaactatgaagaacagatcataggtgtgtatggcttccagcagatccggtcgagagcaatgacgaaagccatgatcatcgcacaatctacattcggttggacctcaagactgaaaacatcttcagcaagagtcagtgacaacgatgctgctccagccttcttcctcgttatccttgcgacttcctcaccgacgctgttgcggatcttgcaacttcttctcctgaaactgccctcgattgagaagcctggaacatggccagtacgatctgacgaagcatgggtacatcctgacatgtgcacttctgcttcatgactgctttgcataactgagcattttctcattgagaagagttgttgtgatcttgtcctcttgccttggccttcttctgacgctctgtaacaattccattggtcatgcatgctgataatctgttgcaacagaagaaaggaaaagaaaattcttagttcttacttactccccatgggttctattaatggttggtttctgttctttggcccatctgctgcacttgtaataagaggtaacaaaacttcagtcggaaagtagaatgaactagcggataaatcaaactctgtattgtaacctctccattttttaagttttgattttaactctatatgggattttgggcaaattaaagcaaaacagcatcagaataaccgaggctggaacgatgaaagcaatgcattttagtctttggtcagctgattttgtctgcaagtgtttagactaattattttcctagctagatgtattagtggaggtagttgatagcatttgcctaaaaaccgtcggcatgcacgataatttgccttaaatctttttggtgagctatggtatcttttagtatttgtgagacaaatagacgagacaaacatatatatacttgtgatttggtgaatattttgaggaaacagtgaaagcctggagatacattttttaaaaaaaaatcgagaaaatgaaagatcgggttgatggacgaaacactactctcggggctctcggcaaagcaggatttgcagtatttaaaagtcttcagtgaagttttggaagcaaacttggtgatcgttctatatcttgagagaagatatgtaaaatgaagtctacattcggacgaggatgattgacgagcagaatataaacgatttttggttgaatgtatgatgaattgacgatcgatcggttgaatgtatgatgaattgacgatcgatcgacgatcgttcatgcatgctaacagctaactcaatatatcgaccgaaaccgtacgtaaatattatactgattgtcaggtgtcaggtaatactagtatacaaccacaaagatgcatgaatatagcctataggaggtaattaattaattaattaattaattaattaattaattaatctgagatgcaaatgcaagattttgcaggggatgaatcatgaatgattagaagatagacaagtgtatatacctgtggggtgagggcgaggagaggcgagccatgtccatccatgagcagcaggtcgccggagaagagcttgcggcggcgggagtagttgtcaacacggaaggcgagggtgccggcgtggtcgtagacggagaagccgtcggtgccctggaagcccatgctggacctcttccacaccgtgtacaccgccgctcgcgctgctgccgttgatgcggcggcggcggcggcggcatcttggcgttgattcgaagggtgtatccgactcatcgatcttcttcctcgctgcgatgcgatctacctatctatctgcagagagagagagagagagagagtttggcgttggacgagagatgtagtgcgcgtgcaatgcttaactcgtcagtgctgacctcgtcattgccggcctcacctgcttatatatactcctccggtctctgaataaccgatatgacaaatgatgcagcaacgactgatgattccttttcagagttcgaccgatggatggatgcgcctcttttaaccgtgtgtgtgagtcgatcgtgcgtgtacatctatctatctatatatgtggctgcatgaatgcgtggcatctcaacattctgaatgtgcgccatatattcctctgcctgcttgcaaaggaagaacaaccttacctagctagcttctaacaaaggaatgagccgcggaacacggtttcatttggtccactgttaattagtactacttgtgcttgtcacaacgtgataatacttgggtaaactgcaactactcagtcaatgcacacgctgttatactgacaattaatttcttttttactccaacatgcctgcatgcatatgaccacactgacttgattcggtcagttctaactgttatgtagggtgcaattgagtgtcggaaacttccaattgatctttccagatgtcctaagtttaatttcttgcgattcctaccgtccatttcatcttcctacaagaacagttgtcttgtataaatagtccaatgtcactcatttgcactaggctgctctccatcgctgtgtccatcttagcatacatctcattatttccccaagcacgctgctgatctctccttacccagtaatcagtaatcgcttggaataattactcgtgcaattgttaaagcccaagattctgctaaaccaaaaaagaagtaattttgctttagtgggtgggtgaagtggagtattcctagcaaggtcacagtcgcgcatgcgtaacatcgatctggttaattgctcacaatatctcaacagctgtcaataaaccctcgcttttcgcatatgaatgcatggacaattcgctagtggccgtaacttaatccaattctgtggttttggatcctttattgcttgctaattgctctttgaaaaacatggatgaaagctccttctacagctatgaaaagcatgtcctgagtcctgacaatgcacaatttggccatggaaggatcctcctaagtcctatatattcctagccatgaatttgatttcatcataccccacacactcccttgcgatgctcaacaaaggattaatttattcgacaaccaccggcctatgctagtaagttacagacatttctatatctaggttacagaatccgaaacttggaatgttatcttcctcgtgatgatttatgtcaagatctgttgcttgcacacacaaaagttggcactgccacttggcattgataatttgatatgcaaatgatcctagtgacacaattctgtattccatctctcaataacagaaatatctaatgagatgcacttgatagcgcagtagcaaggggtatgtgatttcaacactacggtcccgtgttgaatccacaatacgctcaaaatttctttttttttaaaaaaatgtttggaggaatgtccctccctccaaatctttttttttaatctaaagtaatgaaagtactaaactttcttgcaaagttactatggccacgtcattgaataaacatgagccgtcggatattcactccagacaatacaaaccgttggattgttgaatcggttcacgaaacttctttttacaaggagatccttccacatccctacggtaaaaagaaagagatcttgattccaccgcatcgtcacgcccctacgctcccgaagcccacgccgcgctcctccgcctcattgccgcctgctcaccggctcttctcccgtaaaaaagaaagagatcttcttttttttttttgtaatatctagtgaaaagagaatacaggtttaccaccaaattaaggtttgcgaacaatttgtcgactgatcatacgtactactttcgtcagttgatgactgagatgaacatgccctgccgccctggcatccatgagctatggaagagacagagactcgtgaacagagcataagtgagaattgaaccatttggtgaatcttatgacaaattaacacagcaaaaacccaaatgcacgtctgtgtttaattctgactctggccaatgacaacgagacaagattcgttaagttgcagctctcgcacattacacgcatgattaatcacgctagacaacacaaactccaaaccaaaataatgacaaaaggttaggttgaacaggttaattagagttctaataagtaatcgctttattggatccttttacaacttgatcataatctccttagtttagtaattaccagtgcactagccaaatggttagttagcgcttaattacaattagtgaactagctacttaaatggcggaattcgttaaagatgtggtaattgttatttgcaaattgcagttttaattaatcacatcatctgtcgtatgtaacgagtcggacataataatgatcaattgtcgatgatgcaataacgtgtcgtagggtttattattttgttggtacgattgatcatccattttaggggctagtaaaaaacaggaagcgttcgcgaaaaagaaaacaggcagaagaattggctccatttcgtttgtagaggaaacgtacaactccaaaacagcaaaactgaaaagtctcgattgttttccgaggaaagtcaggaaaatttaaatccgatgttgattttattgtaaataaaactgaataaaatattttttttaaaaaaaaagacttaacgaccatagagtcatacgcactctgttaataaaagtctaatgcgtgtgtaggatcgaatcacaataactaagccaaccaaagggggggtgaatggttggtatacccaaaaaccgaaaacttttagcggaaataaaagttaccctcgaaatcgacggaagtcggtctgaccgggtggatgccgccggtctgaccggtgttgaatctccggtctgaccgccgagatcagctgccgctcgctgtcgccgccgccggtctgaccgccgtagtcccgccggtctgaccgccgcgatgccgccggtctgaccgccggtgtgtcgccggttagaccgccgatacccggtgaaacacaactcgaagaactcttaaagtagatgacgactttattgattctctttgtgtttacaaagtgcaccaacagcactccttacaaaaatttcgactaaactcgaaaccctaactcaaaactcaactcaattgctctccaaaagcgataccgggaagcctcacgctccccctctatttatacccgaggtaggcagcctaaagccacgaaccaaactcatactaggagtcctaaacaccttaggaaaccctctagtacaagaaacaaactttacataaccaatcataccaaatttagactccttccaaattcgactccgcatcccatacgcacacaataactccatcgtatgccatatggaatctctatcaaccacgtgcatcaactctagcctaagtatcccgcatgatctctgaccaccacgaacgtcgtattatcgccaagccgactcccggtccatcaccgcaaatactctcccgaggcatcgagtcacctacacatgaaataaacaaagaaaccatattccgagactaagctatcacaacttgactcattagtagcaaacaacagtattatatacgtatagtatccatctagaagccataatcatgaaataatcacggatatccaaacaaacaacccgaaaccgaaaccgacacaaagtcggccggtcagaccgcgggctggccggtctgaccgcgcgcatatcgtcggtctgactggctaccagagcccggtctgaccggtcacatgaaataacagaacatgcgattcacctgtaaaatccaatcatctccaaaaccacttcgtgaattaattccaaataacaaaaccataatctccaatgccaattgttcatcacagaataataataaaaacacctttgattttacagcgtgtgcgcgtcacttaagtgaatttatcataagcacgtatttacatttcttattatacaccaaaactttttttcacatagaaactttattatacacaaagttttcctcgagaaacattttcgaaatgcatgtatgcggacacatccaattctgatttagctatgacattttagtagaaacttagattctctataaaaactttatatatagaaaattttaaaggtatgtgtgctggatgtgggccaggtggggtaaaagttgtaagccaattttttagtccaactcgcaaaaggtttgcgcaaaccggccggcatgaatctattaaacccatcgttgatactattattaaaaaaatcatttttctacttaaatataataaggtatattgtttcacaggttataattcaaatataacccatgcatgtaaatcttaacgcatatctatctatctatctatctatctatctatctatctatcatattattaaaacaactttgaaaggaggcatcacgttcgctgtggggattagaaattcccatgttattcggagaaaaagaaaaatatatgtgtcgttggatcgtatttgtctagattttgatggtctagatcaagcaggaaaatacgtgagttcaaataaaaaaaacatctagagagactgactaggaattggacatgcatgtatttggactaatttgactaggagtcggacatgcatctatttgcatgcatgcgtatggccatttgagcctgtaaatttgtagtgagatttgcaattggaatcggacattcatatggcgttagaggtaattagagtcatgcatgttcatccacgaaagaacaagcataattaaacgctcaaaggtagattaaaatatattccaataggttatggtaggactaaattacaatgctataattttatctatagaaacagaagataagtgttgtacactaaatctaattatacatgcatgtataataaaatatttatgcgcttaaattgtgctatattcgctctaaagaaattatcacgttaattaaacaaaataaagaaaataccaaccatgcataggattgtggtatacctgaatattaactattaagatttaattaaaatttaaaaagttaaagagatgaaacggataagagtgtgaaaccgtatagcaattgaaccaattgcatgacatcctgacacagacactgaccttgcctccaaatcagaataggaaattaatttttgaagtgatataaacgcgaaagtttgttcacgttaataagagggaaaaggaaaaaaagacaaaatatatttctaaatagaaaaggttttataggaaatacaactatacgactataatactaacagtatataaatagaatagaaatctaattttctctctgattaagctaagtcgtaagtcggtaactgagtagtaatgtaatgacttgtaaaactagcatccgtgtctgtctcatgcaccatacccatgacaatatgatgcgtgcacacatgaaaaacaaacgacgataacacatgcatgcgaggtgttggacgcatccatcttattgactaaacccaattagcacatcaatgagatgctagcagcttagcatgtcatattactctctaaacctacattaaacaaacagtgaggttagcacatattagtatattaccatgggaagttcaattattggaattatgatttattttaatcttcagagtaatctataacacataatgagattaattaattaacatgcctataaaggagtagagtggtggcggttgatgggatatctaaaaactattaataaaacaccaaatggaatgctaatgacgattaaaaggaaggatgacagagaagtcgtgaagcaaaaaacccaatgataatcatatttgatttttaaaatatcaatgataataaaaatgagaggcagcggacgaatcgtacaggagtacaatggcagagctgccgatggttggtgggagttctagaaagtaaaaaataaattccaacgataattatattcgatttttagaatcccaatgacaataaaaactggtcagcagacgggtcatagagaaatatagtggcagcgtttgacgggatttctaaaaatttaaaaaataaaaccaaatgagacaataaactctaaaaactaaaaactataaggtccaatttttaaaggtccgggcttctaaaaagtaaagaaataaaccctaatgataatcatgtttgattttaaaatctcaatgataataaagaaggtaggcagcaggcgagccgtagaggaatacagtgacaaagtcgttgacattttggcggaacttctagaaagtaaaaaaaaagaactaaaacaataattatgtttttttaaaaaatatcaatgacaataaagagaagaggcagtggatggctgtagaggagtataatgatagtgtttgatgggacttctagaaattataaaaacgagcccaatgggataataaactctaaaaacaataagatctaatttttaaaggttccaagaagaataaatagaaatcgtggtagatcgagcaagcaaataaagaaggatatgacagaagtaaggggtagcaactaatgtgacttttaaaaactataaaattaaaaacacgaggataataaggtttggtcttgcaaagtcttaagacaacgagataactatttaataaattttaagtaaaaccatattaaaaattatataattttgtatagtgctagccgcgcaattgcacgggccacccagctagttttcattttattccatccgttttaaccaattggagtaaaaaaccaaattaattaactaaacttatctcatattctcaagacataaggggaaggatataccataccgaaatttgtttaccattgtgttggcttttaatcccatactacgtgcatattaatgtggaagtattcaacaatttacatgctcagcataaaacattctcctatgcatcattaatcaaattgttgtgctgacactcagcagtgtccgtacattatgaacagaagaagaggagaaatagtttcagaattgtgaaagctaaggccattcacagtgtaagctatgaaacccatagccttagcctcaaaacttggtccaagtacacccatcctatagtgcaagcacccatagttagagtaccaaacccacagccggtggaccccacgaaaaggaatcatcgcatcgagtactacttcatcgcctccactttcccgaactgcactcgcctcctctcctcgagtactactcgcgctgcctctcctccttctcctccctcgcagcgacgccgatgggaagcggtggcgggagacgtcgccggcggcggcggcgggagtcgtccccagcagtggctggcgcggcggcgtcggcgggaggcgtccccggcagcagtggctggctgacgagacaggtaggagaaaggaggcggtggacgctgttcttgttctttttgttcattttgttctttgggttcttgatttgtttccccaccttgatttctttcggttcttgattaacaggcatggatttgattggggaaatcttgggatatcggtggagcggacgaatcggtggcgggaggaggagattagctgcggtgggagaggattttttagggtgaatcggggatttcgcgatggggattcgacgtgagggtacgacgcgtctgggtcacgtgctccatagcgcacggaacttgctgcacgtggactcgctgcgagaaagttcctcgcgtccttgtttgggaccaaggggctctgctagggcgcgcgaccatgctccacgcaagcacaaatcctcgctggtgcggtgtagccctggtccacgtcactacactctgagaggcctaactagctagctatttcagcattgctgcttttcccgcgtgattgcaactttcgtttgattgcgttgcgaaccacttgatatatactagtatcaaattaaggccataattaaaaagaaaaaagcagatcataaagaaatcttgaactacgtaagcactgtacctgaagaagttgtccacaacttgtatctatgcatgtcgaaatcaaaactgtttgagcttgtttgagctttttgggaggcaacgcgagtgcatgccactgtgccgagaaattaaagattgaaatgtatagacatcaatggtgcgattttaattattcttttaattataatctcgtgattcctgatcgttcgttctgtaacctctatataattggttatactcctactgttttaggttttaagatgttttgactttggttaaagtcaaactgctttaagtttaactaaatttgtagaaaaaataataacattttcaaccaagacaattttttatgaaaatacgttcaactattgatttaatgaaactaatttggtattataaatattattatatttgtctataaacttagccaaacttaaaatagtttgactttgacttaagttgaaacggtgggaaacggagggagtagtttttttagaaaaagtaaagactaaaatgaattctattatctttaaggaaaaaacatggatagtgtcttatttgttcatatgggctcaattcaaaaggtgaagctttcggtaaagaggaagggctaaggcccatattaatggacaggccttccgtgggccaggccactatatgcagatgggctaaaagctccctactatagtactagtagttaggaaaaagtacaccgaatgtcccttaacttgtcatcgagttacaaaatcatccaccaaccacaaaaccagatatatgatacccctcaactacaaaaccgtttattttaggtcctttggtggttttggccttggtttgtccaacgtgacggctaactcagcgtggacccatgtgggccccagaagtcagagtgtccacgtcatcgccctccctctttcccctcttctctcccttcctcctctctctttctcactcttctcatctgggattctgcagggcggacggcgagtggagaggaggccgcgggtgaggcgggagagcaggagggcgttggcggccggcgacgtgcgacgcggcggtggcagcgacgcaggagaaggggagacggcagttgcaggggccgcaggtgcagaggagggcgtcggcggccaacgacaggcgacccgaccgcggcggtggcggcggcgatgcaggagaaggggaggaggtgactgccgccatggcctcgccctcctcgacgagttcccctagagaagggagaaaaaag

SEQ ID NO: 12385 - DNA, 6630 bp, Oryza sativa
ctcctctccgtgctcctctccgcgctcttcggtgctagccgtgtcgacgacgtcgagtccaccctcgcctccgcggagtcctccttcggcgtcgtccccggccgcgtctcctacaacgtgctcggacgagtgagaacagcaagagagacggaagaaagaagggagaggagaggggaaagaaaggtgacatggacaccctgacatgtggggcccacatgggtccacgctgactcagccgccacgtcggataaaaccagggtcaaaaccatcgaagaacctaaagtgaacggttttgtaagttgacggatattatatatctggttttgcggttaggaaatgatttcgtaactcgatgacaagttgatggacctttggtgttctttttcctagtagttattgaggtaggtaagcttgttttgacattgagttatgtctctcttaattaacctattgacagggagtagtaaaaagcagaggagcagcttgaaacaactcaccctcggggtgaaaatatgtaatacaaactagaaatataccgttgaattatgaaatgggcgcctaatatttgtccgcgttatcgagaataaaaattttactcgtaattcaaccatgagcaaaaaattgtctgggagtaaaattttactctcgatgatgtgtataaatctcaggtgttcatttttagatctaaaggtagtttacatattttcactacatatgtgttttctacaaaatatttttccaacaaacaccgtatccattttgcagtatatataggtgtgctgtacgtggagcactgcaccggttgatccgtggcgatcccggcgaccatacaatacatgatttgtctgcaaacacaaagctcaaacagatggaagttgttagacaaagctaaccattcctcgtagctagttcagatcagtgaaaccaatgctgaatcatcggataaaggagaatttgaatttttatttgcaaaacaacagtggttgctcaggcctgacagagatgtgttttctagggcgatgatcgagttgcatgtcggacacttacagacaggcagacagagtatcttcatcttatatattagcaccttgattgctgtgtgcttaatcgtgctgaaatgagtaccctcgatcacgtatgtttcagatttcaagttaattcagagtaggtttaggcgtttagctgatgagctaattaagctactaacattgtgggtttgtacctacaattcatttgcatttccacctaacaagtgattgtcaaatcaagcgtgtgccggcctgtgactgcccaacttgatttctagaccatccaccttgctgaatgctgatcatttatttggcacgtactgtagtattcaggctttgaaaggggatacaaacaacaacagtgttaggtactagtccaccaatagtcaaacaaaacagcggccttttctctacagtctagctagtagtctacacaaccatatccatacatcaaagtgggttctacagcaattaatcagatcacaccctaaaattaactctctaataagagagaatgcaaaaccagatttaaagcacgaataaattgtttgtggaactggtagatcaagaattaatccctttctgaagattctatatgcagttaaacattcagatatcaacatgcccgtgtcaggaacaatgacatccttaagcatatctagtcccaagaatctctgaaaaaaaaaacttaatacgtttgcaatcgcatcagaaaaccgttgaataattcaggcgcatatgcatattgatcatggaagagatcgaattgaattagcagcagcaagaggtgtgtggtcatggctgctggctggtgcaattggtggcgccacagtcgcaggtgtggggggagaaggcgcagacgccgaagggcttgccggggatgttgcagtcgatggcgtagcagcaccgggtgtccacgcagctgctcgcgttcgacgacgcgcagcaccggcagcccatgcacagctcgaacggctcgtacgccgccgcctccgtgccgatcgccgccggccggtacatcaacctcttcaccggcacgtcgtacttcatcaccatcttcttgtctggtcctgcatgcatgaaaatcaattaatggaatccgatcgacttttggaaggatcaccaagatgcatgatgaagcaggtgaagatgaaggtgtgtacgtaccttgggcggcctggaggaaggaggagctgaagatgaggaagacgaccatggcgaggccggtgagagagatggagacatgaggatcttttgccatggtcaattactttgtctctctggaaagaatggaagaacactgagatgcaatgcaaagggggaaacggttgggttttgggtcagatatactactactaatgaatagtactattgtttggcaataaggcaactcgacgcctcaagtcaatttcactcgtatttatataatctgcaaggcaacgcacctacacatgacatggctaattgatagctccaattccccttgaaaaaaaactgcacacaattttactaatatgcttaaataactagttaattgcatggatgcatgatggttgcaaattaatcaactcggaaatgaaaaatgtgacctgccaagcagcttggcaacaaagctgcttgctgctttcctgcttgcttccttttcagctaacaagatattgctactgcatacatgtgtcaactagctagcggtgtggctgttcaccatcgaaaactaaaaaaagaatcgcggatgatcgatgagatgaccagtcggaaatttctggaactctgtatgcggaaactagattcttgttctgaaatttcacaccattaaagcagagagaatatgcatgggccggggaagaagaggattaaaaagcatcagcgtttcataaagttaattagcagttgacagatgaagcaaccgttatgcgtgccagttaatgagagcgattgatgttcctttgtgtcaataccaaaggggaatatctttctttaggtagagatacgtcatttgctggctctctaaagttgcatatatcagatatcaccagcaaacaaatatggtttgcaatgcaaccttggtccttgtcgcatctgatctttgtatttttcgctcttctgattattttcttttatgaacttagtttaattcattctttgtcctccaaattaatttgtgtgcacagccgattctagtttaattcattctttgttctccaaattaatttgtgtgcccaaccgattctcgccaactctctagcagtaactagataattaaccaagtcacatcctatagagattttcctgtatgttggaacttggaaggatacggttttaattgttttgtgacgaaaaaccttgcttgtcaacaatggaacagtgcacttgatgatttttcttgaaaatgattgctcactgattttcatgcatcttttagttatgacatgataatgcaccaacattcctgtccagtcaggcagtcagtgcaccaacaatttgtgacacttgtttgattaatgagtggttcttcctttccaacttccttccaaggacgacacactttcagattcattaattattgtccttgcagaaaaagctataacagacacctttcatttgctaattgaaatgcttatccctgctctctctcaaaaataaaaacattgaaatgcttatctggcttgatccacgtcacacacaatcttttgccttaattctaaaaccatctcctaatcactccttcgacgcaagtgcgagtgatgatggtgatgatgaccatggctcaagggcaccatgtgaattacagtacaataagagtgtatgtatttttgtgactgaaaatgactaccactgttgtctatatatgcttattactactctttactgcagcattatactaacagacaggtggccatacgcttaacaattttttgccttaattctaaaaccatctctgaatctacttcagacagtatatacatggttatagactcagaaaaataactgctaattaatttggtttaaaatatggttaattagactgaagttttcagttgaaagattaagcggaatctatggttactgtattttagcactctgaagtgctgtttgttatcagtgtcccgactgatgagaccaaacatttatcatagtgctgcatcaaagtcggcatctttagaattaggaatggagtaacatggtggatgacagatgacaagacaatgagggctccttgttaattacaaaagcaaaaaaagagaaaagataatgactggttctgtatacaataaaagaacagaaagacaatgagtgaaacagagtgttgacgtgggaaaacacaacacctggagtgcaaaactgacgcagccttgaatacgagaaacactgataacatcatgataaggtatataggaccaaattatacaatgattcacagcagcaatacagatgaccactacgtcaggaaaacaaacacaccataacaccagcaatttaatatcagaaagtaaagctcaacaaaaaatgcacaaagaaagtaggcaattcatggaacaagatacagatgacagacaacgtttcagtagcatagcaaccatcgttgcactcttagttcagcctttcatttctggggttaaaccttgccggttttggcagggcaaaacacagtcaacaacacataagaccactgaaaattagagggccttacaagcaccaccatgcagagcaaatttacaggttgaaaactgggggagaaagccaaaaaaaaaaaagaaaaaagataaaacccaaaagcacacagcgcaggtgtgcacactcacgcaccatcaacggtttagacttgcaatgtacaactgaacctattccaggagcaactgaaacagcacactctcatctcaccctgcatgctgggacagcaggggagcacttggggttcggaagcgccctacagtggactctgttcgtcattagtctgcggtttactctgtagctcggaaggccactgccaagaacagattgaacagctccatcacttccaccactgccctgcaatggttcaagagtctcaacgacgtcgctcataagaggcctcgcctttgggttttggctcaagcagtagtatgctaggctgcaggctttgtgggcagctctaactgaatactgtccctccagttttgggtcaatgatttggagaagcctcctcttgtcgttcagcttcgggagggcccagtcaaccaagctatgctccctgctgggccgtgacttgtcgatggacttacgcccagtcaagagttcaagaaggacaacaccaaagctgtagacatcacttctagcagtcaagtgacctgcccaataggtatatatacatcagatgaaattgcaagggcaaaacagaaactgcatacttgcatatcacttagtaaactttctggtcacattttgatgaagggtaataacgctattcagaaaaaaaaaatgaagaaaacttaaaaaagataaaatgaggagagtaccagtcatcacatattcaggggcagcataaccatatgttcccatcacccgagttgatacatgggtttgatcgccttctgggccagcttttgccagaccaaagtcagagagtttagcagtataatcctgtgtaagtgcaaataaaagataaatgctattatgaaaaatatttacatattcccaacagatgcatagaagagaaaggaaaaaaaacaagatattggcaagaaatgctactcaactgagtccagcagaatatttgatgtcttgaaatccctgtagataattggcctttcagcattgtggaggcaagctaaccctttggcagctcctaatgcaatcgacatcctagtagcccacgatagtggagtagctgtccctgagaagaaaaatgaaaagcacagacaatgtcaggaaatttcctactctcgaatacaatttcaccacaatgtacaagaaaaaaaatatagttgagcataatctttagtcagcctaatattcagtgttgggcctatttggcatataatttacttaacctacaaatgaattgatgaaataccgtgccaacatttcaaatcatacatgccagtattcaatagtattcatatattttggaagaaaaaatacagaagatatttagcagataagtatgggtagctcgcatactctatgcatggtagttaactatcacgaatgattctattaagtataccaacaaagaaaatcattcagatggttaactggacactttgggcaatcttgttaaaaacacgtcaataaggttttccaagaatgataaatatgaagagggcctaaacttactgagggtctagcagcgaacagttaaatcggttgttcagtcaaaaagctctggacaatttggaatccttgtgaacagcaagtcgaaatgaaatcctaccataccaggttctagagcgctgatcatttgctcatatcaacgatatttaatagaacaacgttgcaactctattatccacaatatggtcaacttcagctatggtgcttgattgcattatagagagaaacatatatatttaaaaagtgtgatcacagaaactattcagccatgatatcattcatgaagtga

SEQ ID NO: 12386 - DNA, 2880 bp, Oryza sativa
tctgacaaagaaacaaaagatgagttacttcttgataattcttctaacataacgacaagaatgaaaaggtaatgaatttccaagttaataatatgcccggaaaactggcaaaattgcttagtcaaattcaatatatcatgtttcgtttatggacatgttgcttattctcctttaaaaaagaaatagaatttcacctattccgagcatgtgtagatacactgttctatttgtagcatgtgtagatacactgttctgtttgtaaacattcaagaaatatgctatttaacagtatgactcagtctacatgcattcggccaatgaaattaatactttagccttcatcaacctatcaagtgtgcacatttttcttcatgatacaagcccaatgaatcattctaactatgacttgtagcttcttgagaaattttctattccaaaaagggaacaaactaagaaacatgaaagcagaattttgcatggtatatttatttgctagcgtacttgttaacttgagtataactaaatgctgcatgtgccattgttgatttgttgtgaaatacatagttagcatcaacaaatatttttccataatttacataattaagatatatcatgttcttgtacgagtaattgttaatgttccgcgtatccatgtacataacggacatcagcaaccatagtgaatattgaacaagttggcaactcacaagccattctctgtgtccttgatgtccatctttgttgagcaccttgactgcaacaggtagtgacttcagaccaaccctgacattctcatctatgtagcccttgtaaacagtcccaaaccctccttcaccaagaacgtagtcagcacggaagctccttgtgatagtctcgagttcaaacaatgtgaagtcaatcacatcattgtatatggagatgttcttggcatcttcaattttcctaggtgttgaaggatcactcatatctgatgagatgcgggtgtgcttcctctctgcaacagcattcttgacaggatgttgtaacaaatggagctgctgaactgagaagatgacatttcaacaataagaaagaaaaaatagttaaggtataaacgaattaaggttaccagaaattctcgtacaaacaaaataaaaggcaagctttttttttcatattgaattttcagcattcacagagatggatggatgaaagagagctaatcctgctgaaatacgtttagggaagctataatcacaaactaacaagagaactactggaaacgagcgttggcgattcctagcaattataatatggtattctacctaaaaatactgtaaaaaagtacatacatgggcaagttgattacagaaagaggtaaacaggaccaggagaccagatctactgcagagttgcatgcaataaaaaaagggctccaaattgcttaaacaatgcagcaaactgcaagaagtgattatgtttttccaacttgcaggatcataactctattttctgttaaactgaaagtcaacagtgcctcagtgaagcagagagcacagaaattgcagcactattgggggaagtgcctgtaaattgtcccgatgaacataatgaagcagaatttctgatacagcaaccaagaagataaggatatgcagcagagaagaaatcacagagcaaccacaccagaaagattaaggggatgagggcttccccgcaaaaaaaggaaaaaaaaagatgttgagcaaatgtagactgtaaaccaaaatcccagaatccccatatgcaacaaacagaaaaacaatgttgaacattcatatgcaacaaacagaaaaacaatgttgaagatttggagcaaatgttgatatcagattttaatcaaacctaaaccggagagtaccaaaatgccgatttggaatagccctaacaagaatgaacatttgcaaccaaaacacccatccaaaggtcccaataacataagtcatcatatatagcaaaaaggaaagacagtgcttttgtcaattccccactgaacccaccaacctagagtcctagagatcaggggaacccagaaataaccaccaagatcaattttttttgatgaaattcagatcatccaacccgagatcccatcccaacaaccagcatcccaagaaaacaatcaccgggaaatcccccaagaaatcaaatccgaggaagcgaagaataccttgggcgtgcgccgcaacgacggcattctcctctcgcgtcccgcagttgcccatctatctacttctcctcctgatgttcttgatggtggtgggtctgtctctatctcttgtagtggaggcccaagctctcattcttgggcgggggcggggtgggggcaggcgatgcctatgccatgcgccgccggtagaggcgatgctgcgtgctcttcatcctccagtggcctgtgggggggcagcggaaacgaagcttgctttggtttggtttggtgttggtttgctttgctgtgtgcgcgtggaagtgggatggacggtggtgggagagcgagaggggggcagcaaccgttaactggaggaggaagagaagaaaaggctgtgctggtgtgcgtgagattgacagacagagacagagatagatgggagcaagagactctgctctctgctgctgtttggtgtgggtctcctttaaaaagcactgccatttcactacactatggattggttggttaatcaccttttaatactaaccacatattaacaagtttaataacccataacggaattgctaaatggctgtcgaatgattttttgagctcaaaatcatgcagattactaaccatgggatttgctctgcgattcgtgctccggcgaccttagctcttctcctccaactccggcgacaccttctccaact

SEQ ID NO: 12387 - DNA, 9738 bp, Oryza sativa
gaggaagggggctcgccggtgccgttgaccccttctggccagccggcgagtccgggcagtggcacgtggggcggcggcggaggcagcccgcatgtgagagagatgcggcagcagcctggaatgacgaggggagggagaggggttagggttagaactgcagcacgaatcttaaagcgatccaacggtctagaattcgcatgatttgtgaggtgtttttctgtcaaatgccatctagacagcccccataacataatcatctacttcctccgtcctaaaatataagggattttaaatggatgtgatatatcctatctagattcatgatcatatatcacatcatctaaaatctcttatattttaatacggagggggtattagcttaaaaaattaacccatgtcatctatagaatatttacctatagatacatattacaccactaatgcatacctcacatttttatcccacataggttattggaactcatggtgcagctggctataaatttgtagtctgttttttctctctcctccacgtaagtataaatatgatgtggcaatatgtagagctcgcttacatcatcttattgtactcgctttgataaacactctcatggtaatatttgtgttttgcaaaatgaaaaatacattattcccaacttctaatatatttttactctaacggtctgtttagttcccaaataaaattttcacgctatcacctcgaatgtttaaacacatgcatggagtattaaatgtaaaaaaaactaattacacagttcgccaggaaattgtgagataaatcttttaagcctaattgcgccatgatttgataatatgttgctatagtaaacatttgctaatgttagattaattaggcttaataaatttgtctcgcagtttcctagtggaatatgtaatttgtttgttattagactacgtttaatacttcaaatgtgtgtccatatatccgatgtgatatgtaggggtaattttttttcccaactaaacaggccctaactttgatttatttgaaattcctctgttcctagataaagtctcactccacgtagcataaatcatagaacaacctacctacgtaataattgagttgatggatttatttggaaaccagtaccatatatgtactacaaaagtacgaaccatgagcaatgggatccaccacctcccaaagattcctcttgttgggataatttccattcacaagtgaagtaacataacttatggatttgatgaaaccaaattaaagggaaattgtgtttattttttctgcaaaaaaagagagagagaatcattggagctggcgctgttttttttagtaaatttcacaaaactacaggtgctttgtttaaattattccaaaactacagatttaaggtgatgtatcacagaactacagatttaacaataaatttatcacaaaactataggtttaagactaagtatcgcaaaactacatatttaataataaaattatcacaaaactacagattttagggcttaaatccttagtactaatgttatgttggacatataattgttcaagtaatgtgattaaattatcaataaacctgtagttttgtgataactttgttactaaatatgtagttttgtgatattacatcttaaatctatagttttgtgataaatttagcattaaacctgtagttttgtgataaattgatcaaaatacctgtagttttatgaaatttactctctttttttttgcctgtggaaacttttattattctagaagattagttgcactgttgttattgtcacatttcttgatatgcaagctctgtagggatgaacaccaaaagctttattgttatcaccatcacaatttttttcaattctttttggtacaacaaaatcggatcatgacttgggaggatgtttcttttccatgtttccccttttagtgatacaatactgtttggccatgatataagccatgcatgcatgatagtacagccacttatttcttgtctcagcagaaataggaaatatggtaagctcaaaatgaaatcttattaaaatgttatactagatttctaagatagagagagacaattgtagtaaatccatttaaactaagaggaactgtatatcaacaagcttttcttgttctcatttatcccttgaacaaaactacaaacttttctgcttctactaccaacaaagtacattgtctaatcttacacaaataagagaatataaaataaggctccttggatcaaaagatttttgaaggaattttattggaaaagaatcctatgaaaaacttgccaacaaaaggaatgccttagaaatagccaaaatcaggattagtaacatgaggttcaacctcatgaaaatatttgtgtctatctgtatccctctcttgtgctccatccaaatgactactcgtgtaacttttccgtgctttatcattcataagatgtgaagtgctaagacattctactcctgtattttttttattccctgttttgagaatcctatgttctaaaatgtgccataagagcatgctgcctatctttgcacacacaaaaatcttatcaaaataacaataaaaaaagaacaagttggcatgaaaatgggagattgaggaaatgtgcttcatgctagcttgtagaaggagcattataagaggaaggaccacagacagaaaaagataagatggtgggcatcggctaatatctgtccatgcaaatatgcaatgcatgtccagcagcatgtgcacacaaccatatcacacgggtgtgtagctgcaggccgagcctaccaccaaacaccagcagcaggcagcagcaactggggactgatcaagctaaggtggtgtttggatccagggacttaactttagtccttgtctttagacactaatttagagtattaaatatagactacttacaaaactaattacataaatgaaagctaattcacgagacaatttttttaagcctaattaatccataattggagaatgtttactgtagcatcacataggctaatcatggattagttaggctcaatagattcgtctcgcgaattagtccaagattatagatgggttttattaatagtctacgtttaatatttataattaatattcaaacatccgatgtgatagggactcaaaagttttagtcccatctaaacagggcctaagccaagtggttgcaggctgcaatatatatcatcttcattttcttctctttcttttggccatcaactgcactccacaaccacaagtggctgcaggctgcaatatcatcttatttttcttctctttcttttggccatcaactgcactccacgatcacaagagggggagaggagcaaaggcaacaagacgagcatgcagtgcagcagagagagctgcatggatgcatgtgagagcatgtacaatagcaggctataagccagctataaacatattttaaagagataaaagaagagagaagagaagtaggctacaaatttgtagccagctgtagcacggactctaagacgtaatttatgtatgacaagtaagatcaagtattaatagtataataagcaactattatatgaattagctattacattggttatagatgatttggagctagtagttgactatactattaaacttgctctaagaaggaaaggagatactatcaggcaggagatcttctaccttggaattagcaaaagctacccaacaccacctgcattcttatcacaagttaaagctgctatactgcatatgcaattgcagggacactccctctccgatgaaatgaacaaatcaacttgtgtagttaaacattgctgtcatgtgcctgagcctttaaagtagttaagcttgtaaatggcactcgtgtagatcagatcatcagggccagggtctgtctgaaactagagattctttaattgcacacaggaatcttagaaaaatttcgaaggaatccggcaaattcttgcgttttaaaggagtccaattgaactcttatgaagtggatctccttatgtactaactgggttcttatgtttcgtttttgctcagcatttagtcatggcacaagatcacaccatgaataaactttagcaccaaaactgtcactacgttttagttcatggcctttacctgtcaggcttaaaatacagtagtaatctagagcaaaaggttaagctggccatacgagacaaaagaaataaaaaagatggccgagtagagcatctccaactgtctctccaaatccaactctccaaatatttatttggctaactctccatctaatttggcaagtcaaactcgttgtttactccaacagcctctccattcaccctctctattctaactctatgacagtgggacccacgtgtcagcctctacaacccttctttttcttcctcatacttctccattttctctccattttcctcacgatcctctttatcctctctggtggacaacgcggggcgatggcgacgacggatcctcgccggcctcatcctcctcgacagttgctggaggaggagacggcgagcttccagtcgtcggagtagcgggatccggaggaggcgcgcagcggcagcgggcggcagtggccacgcgcggcgaggcaccgccccgttcgctccgctcgctgcgctgaccagtcgaggtggccgctgccggtctccgctctgctcgccaaggtaccatctcgctggcggcaatgaagccgaggcgctccttcttgacctctataaaatctccaagcgaatcagatcaccgaccagccattcccatatcctcctccgattcgaaaccctcgtctctctctctgtgtgtgtgtgtgccggattccatggtgacagcagggagcagccgaggaggaagggcgggaggggccggaatgcactaacggcggtgctggacaacgacgccaacatctccgccgggaaggccgacggcgacggtgagctcaggcagaagatgcaagatagcgacggcgcgcctccttccccatggtggcggcatgcacaagcagagggaggaagggcggccgcggcgtcggcgatatgcaaagggagggaggggcggcagggcagggatggtgcggctagtggggagagaggagaaaaagttggtggggcccacggatggccagtggctaatggtggccaaaggctggctaagtttggctagctcgagcccatgcttggccatggctatcttttgtcaagtgggatagccattctactggagtgtggctatctactggagtgtatttttgctcaaagtagctaaaatttagtttggagagtggaatggagaggctgttggagttgctctaaagaaatggctggagcacagtgacagttgaggagaacatgcgagggctccgagcaatgatcatttgcttacacatcatccataatttttctttcctaagatagagatcattttttcttaccctaggatagtgatctatttttctcagtagctatatgtgcttggaaatgcagaggagttgattgaacgaggaacgccaaaggcaagattcatctgtatctttgttaaacctagtaatggagccaatgacattgttgagtatggatgtacaacggatagcatttttcggtggttggccacttttttacagcatacataccataggcagcactcgggcagtgcaaccgtcagtggcagagctcaagttacagcccgatctgctcaggagttggctctgcagttggttaaaccccataattcaaactaataaaaatttactactgtcagccgaactagctagcatagcatattttagttgtcactactataagaaacaaatatatcctctttaacattcagacattcagatttgctattttttcataaacttttctacaatacaattgtatacaaatcgagttgcattttagaaaccgtatcaatgtaaaagcgtcacttgtgattgaagggagtgattttaggcttttctactcctataaaaagggaaccagtagttacctcatgattaagcatgtgggaatccatctctcaagccgatcagacagattgtcagcgattattgtagatgaatcatccctagatgcatgcatagctacatgtcaacatgtaatgagaagggtcatgatacgtgtgaagtgattggacggtagcggctacgtgtacctccttgtgatggattagtagcgacaagtacgtgattaggcctgcaagtgcgtgtctgcacatggttgtaagttttgagagttcttgggatatgttaattagtgaagtaattaactgatgtgatatcataattaactagtctgatcgatccacgccaaaaagctcttcgctggaggcttttaggccctccaatgttgtgagtcatgaggtgcatgcttagaccattcccaacccaaacacactatatatagtttccataaattttacatcataaaaaaactgtactagacactactcttccaatgcaaacaccactattttatatttaaatttaatgctacttatttcacatgatgtcttggatattgtgtagaaaccatgtctcatgcaagacatgattttcttttctttcctcatttattcacttaccatatcatttttcatcctaggtggcagcttatttgatgttatggacatcatcatagttattgggttggaaatggccttagccatagaacaaactaaagctgacatgcattttattttattttttttcagtcgtcagatgcggtctcattggattatgcagcagctcgatctcttcaccttgccccacaggatcgcattcgcatggcgacaccatcaaaacacttgcacatttcttcattttctcttttcatgtcacgctctacctcaagttcaagtttcaactccactccatatacagttcagtattccaaaattccaattcatcacaggggcaagctacattctcagctaatcagcttggaacatagtagaaaaattcatatgaaaacagactggatctcatctctagcagtaaccgcaaaggataaaacctcaactttgtacatctggggctagaaagtgcatgcctccaccaagaaaaaaaaatgaaatggtgtaccaaacagaaacagacactcgagtccatcaagtcacgcgtgttcataacacgtagtactgttctatttaccatagctctgcaggtccattcacatgtgagcaagatggagtgataaacacacaaaagctactagacaggtgtcacagtccaaaatcaaagccaagccaacatatattggcaggcaaatcaagtgatcagcggccagaagaaacagtgtaagttgcttagagcgggtacagtaataggctataagccagctataaatatattttaaagagataaaatagaagagaaaagaacagcgggctacagatttgtagccagctgcagcacggactccaagacacagtgtgtgtatgacaggtgggaccatgtattaatagtatagtaagcaattattgtataaatcaactattagattggttatagatgaattagagctagtagtggactatactataccattgaacttagctcttacaggagagcaggcacaggctggcccggagcctcgtgccccggctgctcatcagtgtgctactgtttggagatcacaggtagcgcatccctttccatggcgatttgcgtgtcccacactgaaccagcagactgcgaccatttggcagcctgctactgcttgcaaccattttgtcaatgtccagtgattcacacatcaatgtgtatcataataaagatcccaactgtcaccaacccagccttgaaaaaacatccagattctagacaaagttgctgtcaccgacccacacaaatatcagtttgataatgttcagtaccagatcataacagaagtgtaccaatatatatgagaaaaggactcataagatcaagatgatgccacatataattggcaactccgaaataaagcatcaggaatagttaatcaagcttaacattcaaactctacaacaatcctgaacaaaaaatctacccatctcaaaataacacagcttgtattggcagccacaaagccccatatacagggaaatagggtctccagtatcacccaagtcagcaccatcatcaaggttgcatctgaagtttcctaagctatatcagcaacaggagatagtaaccacaagactgtaaaattgtggatcatctacccgctgcatttgtgccagaaggttgtgatataaacttctgggcaatagcattaatgcaagacctgttcctaagttactctccattgacaaagcttttactgtcgtagtactcgttccgtttctgcaaaagcaacgccacagactaaggtggtgtttagatccagggacttaacttccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaatttttaaacatccgatgtgatagggacttaaaagttttagtcccatctaaacagggcctaagggaaagtctaataagagagtaagcagccatctattagatacttactccctcggtcccataaaaaagacaaaccctggtttccgtgtccaacgtttgaccgtccgtcttatttaaaaaaattatgaaaaaaaattaaaaagacaagtcacgcataaaatattaatcatgttttatcatctaacaacaatgaaaatacgaattataaaaagatttcatataagacggacagttaaagttggacacggaaacccagggtttgtctttttttggccggagggagtacatgttatttccatatcattaaagataatataaaaattaaccgagtcattaatttttttcttaatgtgggtcaagccttggttctctctcctagactatctaccaatcacagatgctctttccatgtgggcccaccttaattatctctcacctaatcttttcaccaattacagcatccatcgccagcatgctgtgtctaggcgcccgtgcggagccgtcgtcaatttagtcgaccgcttctctctctccactccctctttcttccagcaatgcaaaaggagctgacataagtggctaatagtaggcatattttccctattacacttgccctaaaactgaacaaaaccatagcacatcaatggaccagaataaataaatgcaaactacccaccaccacccgcattcttatcacaagttaaagctgctactgcatatgcaattgcagccttgcagggaccctccctctccgatgaaatgaacaaatcaacttaaggtagttaacattgttgtcaagtgcctttaaggtagttaaggttgtaaatggaactcgtgtagatcagatcatcagggccagggtctgtctaaaactagagattctttaattgcacacaggaatcttagacaaatttcgaaggaatccggtaaattcttgcgttttaaaggagttcaattatactcttatgaagtggatttccttatgtactaactgggttccaatttatggttcacttttg

SEQ ID NO: 12388 - DNA, 3461 bp, Oryza sativa
aaatgcagaggagttgattgaacgaggaacgccaaaggcaagattcatctgtatctttgttaaacctagtaatggagccaatgacattgttgagtacggacgtacaactaatagcatttttcggtggttggccacttttttatagcatacataccataggcagcactcggcagtgcaactgttagtggcagagctcaagttacagcctgatctgctcaggagttggttaaaccccataattcaaacaaataaaaatttacgtcagccgaactagctagcatagcatatgttagttgtcactactataagaaataaatatatcgtctttaacattcagatatgctattttttcataaacttttctacaatacaattgtatgcaaatcaagttgcattttggaaaccatatcaatgtaaaagcgtcacttgtgatttaagggagtgattttaagcttttctactcctataaaaaaaaggaaccagtagttacctcatgattaaacatgtgggcatccatctttcaagccgatcagacagattgccagcgattattgtagataaatcatccctagatggatgcatagctagttagctacatgtcgacatagctaattaaccagtctgatagatccacgccaaaaaaactcttcgctggaggcttttaggccctccaattttgtgagttatgaggtgcatgcttagccacaacacaagctaaagctgacctgcattttattttatttttgttcagttcagttgtgcatgcatgcaaagagggatcctttgatggcctgatcaactgtaaaattgtttataaacatggttagtaatatagaaatgacagagatagattccatgagttggtacactagtggagcttgacattgtagggatcaaggtggagcgtaaattcaaaggtgaaaaagggaagagcaaaccaagcgaacatgtgaggtacagccttatagcggctgatagcatatcaaagttaattatagtcgccgcaatcggcattggtcttgggttaagatttcgggaagaggcattatgcaccactgtcgtcgactggtgtataagcggcttttctattgcgtcactcaccaattttctggttgtgggcgtgaagattcgccaccaccgcctggaagagcagtactccaatgcaagggtgaaatagagcggtgctatcgcggacaagatttttccaatgtccgccaactctatcatcttgaaattggtgaaaataaaagatgaaatgtgtattaaatatatacttacgagtcgatagtatatatagcgaacaccgatatgcgtcgtcatcgagtgatctaattatgccgttagttatttaagcatgcgagccacatgtggtgagcatatgatggcaaccatagggtgtgtttggttgcctgcatgtgttttggctcgcacccgcccatgcaacttcgggttgtttggttgcctgttcgaagatcttagccaagccctaaggatgcaggattccctccacagccaggctctagaggaacgcggggaatgagcttcgctcctcaacctggatgagcggatgcaggggcgggtgcctcgcgcgatgcaacgcctgcagtccgctcacctccactgtctcatttgctccttccccatcctctttcctctccttctcattgtttcccatcttcctcctcttctcgtcgaagccaccgtcatcttccagagcactgtcgactctcctcgtttctgagtcgccggactgaccagatctggcggccatgagctcctagcaccatatccggcggccttgacctaatggcaactcacaagccattctctgtgtccttgatgtccatctttggtgagcaccttgactgcaacaggtagtgacttcagaccaaccctgacattctcatctatgtagcccttgtaaacagtcccaaaccctccttcaccaagaacgtagtcagcacggaagttctttgtgatggtctcgagttcaaacaatgtgaagtcaatcacataacgtgtatatggagatgttcttggcatcttcaattttcctaggtgttaaggatcactcatatctgatgagatgcgggtgtgcttcctctctgcaacagcattcttgacagagagaaccgctatacatacgacattttgtttacgattgctttacgatcaaacgttctctactactctctgttgacgattgcaagtttcggtcccacgcgaaaaaacatacacagatgacacggcgttagatcgtacttggatcgtaacaaaagatcgtacgtatagtattttccttcttgacaggatgttgtagcaagtggagctgctgaactgagaagatgacatttcaacaacaagaaagaaaaaatagtcaaggtaaaaacgaattaaggttaccataaattcttatacatataagataaaaggcaagcttttttttcatattgaattttgagcattcacagagatggttggatgaaagagagctaatcctgctgaaatacgtttaggaaagctataatcacaaactaacaagagaactactggaaacgagcgttggcgattcctagcaattataaaatggtattctacttaaaaatactgtaaaaaaagtacatacatgggcaagttgattacagcaagaggtaaacaggaccaggagaccagatctactgcacagttgcatgcaataaaaaaaagggctccaaattgcttaaacaatgcagcaaactgcaagaagtgattatgtttttccaacttgcaggatcataagtctattttctgttaaactgaaagtcaacagtgcctcagtgaagcagatagcacagaaattgcagcactattgggggaagtgcctgtaaattgtccctatgaacacaatgaagtagaatttctgatacagcaaccaagaagataaggatatgcagcagagaagaaatcacagagcaaccacaccagaaagcttaaggagatgaggcttccccgcaaaaaaaaaaaggaaaaaagaatggatgttgatcaaatgtagactgtaaatcaaaatcccagaatccccatgtgcaactaacagaaaaacaatgttgaacatttggagcaaatgttgatatcggattttaatcaaagctaaacccgagagtaccaaaatgccgatttggagacctaacaagaatcaacatttgcaaccagaacacccatccaaaggtcccaataagccataggtcatcatatatagcaaaaaggaaagacagtgcttttgtcaattccccactgaacccaccaacctagagtcctagagatcaggggaacccagaaataaccaccaagatcaattttttttgatgaaattcagatcatccaacccgagatcccatcccaacaaccagcatcccaagaaacaatccctgggaaatcccctaaagaaatcaatccgaggaaaaggagaaagtgaagaatac

SEQ ID NO: 12389 - DNA, 4903 bp, Oryza sativa
cttattatcaagcctattaaaaccttttattttggaccctatagcaactaaaagatgtacatatgcacccctaaacaccaccggacccactgtcagcctcttccctctcttttttattccctctgcctcccccctctctctctcccccgagccctctcaccgtcgtcgccctttcttttctcccagtcaacccgccgttgtcgccctctcttttccctctaccttcggtggcagatcagtgtcactcgagctctggcggtggcggatctggcgaaggcggggagcagcggtggcggtggatctggcggcggcaaggagcagcggtggtggtggcggggagcaacggtgagggcggatggcttgacgccgctgtcctcctcacgaccacggcgagatggctcgacgccgccatcctcctccccccacgacggcgcagacgagctcgccgacggcgtggcgagcttggcggcggcgggctcaccggatccgggtgcggggtcgccggatctggcgaggcgacgacgaccacggcgaagcgacgcgagtccggcctccgcaccggcggcggcggatctggcggcgatggggagcagcgacgacgaccacggcgacggcagcggatctggcgaggcgacgtagcggcgacgacgaccacagcgagatggggatttggggtaggtgcacgggagaccggacgaggcgacgctgttaacgaccaaatttggtaatctaagtatcggagataaaaattagattgaagcggaatccaagatcaagattgggaccagatgaggcgacgctattaacgaccaaatttggtaatctaagtatcggagataaagattagattgaagcggaatccaagatcaagattgtttcagaaacagagcaagaatcggctggaatccaaatcggctacgactaggatcggcagagttcgagtcagacagggttagccgattgagccgatcccgacaatacaactcagtgtacgtcatcggattgaattaatgtgcttcgcatggatcaccacacttggattgagtcctgaataggcaattgtatctattaattaggatattttatgtaatttccttagagataagtgtgggcaaatgtctgccgcaaagatttatggtatgttagagtttgttagagataagagtcgtgtccgacaaggacatattgtgtaatctcgggtataaatagaccccgagccccatgtaatacaacaacagacgttcaacaacaatctcggcgcatcgccacccttttactttcattttgtttcgacgagttcttgctttcaggttgagctgcatcggtttcgatcttcaactagaggtaaaacttgttatggcggcttgcgttctcgggattagtgcttccatctttatgatactctaatcttgtttatgtaagttgtcgagttatcatgtatcttatataatctccgacaatatcgttatctaacctccaatcggctaatatctatcgttaggaagcagccgattaggttaaatatcgacgttggcttagattatataggatatctaccactctatgaagcttccaatagcttgattgtctagatattgtctttctttttatacttatggctgcattagttgagtttgatctcataagtcgtgtttagaactatagtctcaagcctgcttcttggttgctgattagagtagcatcgagctttcagccgatcttacctgatttacctttatgtcttatatgctcaattgttatgctaaatatgccctttatgttaagatcctattgcatttaggtttattaagctctatgtttggtatattttacttgctttaatatcttaatatagagtagtatcagagtattagccgatacacgctagatctatctgatgggctatgctatgagcatctataatctcattgttaatatttatttcgatctaagtgatttatactgcctcggtatggtgatcgatctatcccaatcacttgatttaagcatatatcaacataaaaattatgtactgttaacatctacagctgatcgaatagatttagttttaacttactcattcacaactgccgatcgactcacatatgacattggctcaagaataaatgatatgtcatcggtgactggccgatcggctatcatttatggatttaactgcggtttctttgtctttatttcttgttgattgcaggatcaaatcaactggcacgctcacgaacctaaaaggcatgattttgtacctgcactggagttaagcagatctcccagacctcatgtttttcgcatcaacacgtttttggcacgcctggtgggacaatagtttcaacgacttcttcccgatggccgaaaaaccaccaccgtcaccagggacaggagtcaaacctcccgttaccaaaacgggagctgcgaaatccatcaactgaagtgaaccccagcaacatagttccagttacattggataacctgacggctgaacaaaggggtgaacttgaacaaatgatgagcaatgtaaaggatcagcttatgaattcttttcaagaaacccgcagaggcacaatcgtccagaagtacaagctgaaggtagttgcagccgatgaggttggctcaagctcttctccaggcaatgcaggtactgcagctggctcaggcgacaaaggtaatgtctctcaagatggtgcagttgaagatcttggtgaaaatggcaaccaagagcaattacagtttaataactttcaagatcggatcgactacgccgtccaacatgctctgatcaaccaatccggtgtgctagttaacactttgacaaacatggtgaagactgtggtcgatggtacgatagctgagcatcaaactacagggccagtttatttaccaggaggtgtttttccgaacttttggccttcagtcacaggaaatcaacagggtgttactagtgtaccaccaatccagccgatggcatcagtttcaactactgcaccaactgcatcatcatcggcaccaagacagatggtcaatgctgaaagtgcattaatcctcctagtgagttttggtgattaatgataaatgtggttaagggactaatgagctcattgagtagctttcaggtgcattagtccaaggtgtggaagatggatgcttgaagaccccccaaaaagtacaaaatcaaagcggaccggaactcaagaagtgcataggatagtttatcttttgaaatcgagtttttaagaaaaaccgtactattaagaggggttccaggtgatgctctgagatatatcaagtgctcttagtgtgaaccaagtgtcaagtttcccttggagtccttttttgcaaatactccatctgtccaagttccgggcctgggaggctggaagttctggagttccttaccaggaagttcctggtctgtttgaactttaccgcggtgatttgtttttaagtttttagggacaacctattcaccccccctctagtcttcatcaacgcgttcaattggtatcagagcaaggtgctcttgattcaagcttcaccgctttgagtaatccacgatgtcggatttagggggaaagaacggggaaaatggaaatgaagatggagcgagcagcaagggaacttcattatccaagggagctactataccttttgattacagcaaacttaccattccccctcacaactttgtctccgtgccttccgggcgtgctcctcaatttgatgggacacattacgccgcttggaagcacaagatgaagttgcatctaatctctttgcatccaagtatttggaaaattgtttgtacaggtgttgatgtaccccatgatgacatggagctcacttcggagcaagagcaactcatccaccgcaatgctcaagcttccaatgcaattctctccgccttgagtccggaggagttcaacaagtttgatggtcttgaggaggccaaggagatatgggatactttgcaattggctcatgagggatcacccgccgttcgtgaggccaagattgaattattgtaaggaaggcttggaagatttgtaatggatgacaaggagacaccacaagagatgtatgataggatgatgatccttgtcaacaagattaaaggacttgggagtgaggacatgacaaatcactttgtggtcaagagatttctccgtgcttttggtccaagaaatcccactcttgtatcaatgatacgggaaaggaaagatttcaagaggctcaccccaagtgacattcttggaagaattgtgtctcatgagatgcaagaagtggaagctcgtgaagtgaggcaaatggtgaagaatgccgccatgatcaaaaatcaagaagtagctttgaaggcaaaataagaagaagagtcaagttgtgaagaaagtgaagatgaagaaatggcttttattgtcaagagattcaagcactttcttcgcaagagtggctatggcaaagggaggaaggatgatgacaagggaaagaggcaatcaaagagagcttgcttcaattgtggcgaatacggccacttcattgccgattgtcccaagtcaaatgaagcaaaggctaagggaggcaagaagaagccggagcgtgctcatgtggcggaggcacacatggcggaggtgtggtactccggagatgaagaagatcccgaggtcaagcccaagcccaagccgaaagacaaggttgaaggagaaggtggtgttgctaccgtcaccttcaagtcatcttcttcaagcaaggaacgtctcttcaacaacttgagtgatgacgacgacgactcctaccactactcttgtttcatggcccaaggccgcaaggtgatgactcaaaagccctcttacatctctcttgatgttgattctagtgatgaggaaagtgataatga

SEQ ID NO: 12390 - DNA, 14145 bp, Oryza sativa
  unsure (1)..(14145): unsure at all n locations
tacttattcttgagaagaaaagaaaccttgccttagaggagagcctagctaaagaatgtgctaaaaatgaacaactagctaatgagcttaatttggctaatggttctctagctagccttagggatgtcaatgaaactcttaaagagaaatttgctagtttagacaaaagtcataaagatcttgaagttcaatttgacactctttggaatagcacttctcaaccaaatgtggtttctaattcttctaatccatctactagcaatggttgtgctaggtgttacaatattgatttgaactcttatgctactaatgttgatgctatgcaagctcttaagaaagagaatgaaaggttgggcacattggagaaatatggatgcatgaagacataccattcaaaagaccatcaccgctcatcctaacaaggatggacacgggctcggattttctggtggaagtcctgtgtctaagcgtgtgatggtaaatgggaaagaatgcttgatgtttgtaagagaaggaaaagctccacaagcaagtgaagtgacttgtcccctcactggtcagacacccggaagttccgggcaaaatgaccggaagttcctgccctgtaagacaggaagttccggacattttgtcaagaagttccgggcttctgataggccgaagtggctggccagaagttccgttataatgccagaaagttccggccagagggtctttactatgattcatatgtaatttccaaaaattcagagggcaaagtggttgcttattttaatgggaattacaatgatgagtaccgcacttgtgtgtgggtgccaaaggctttggtgactaatatcaagggacccaaacttagacaagtttgggttcctaaatcccaagcttgatttcttttgtaggcatactcctctggtggctcaagttgggttgtggacagtggctacaccaatcatatgatgggagagaggagtatgtttacaagtcttgatgaggagggtggaagtcgtgaaaatattgtctttggagatgatggtaaaggaaaggtaatgggtctcggtaagattgccatttccaagaatcaatctctatctaatgtcctccttgtcaattcattaagctacaatttattatccgtgtctcaattgtgtaagttaggatttaattgcttgtttaccgatgtggatgtgactgtttttaggtgagatgactcttccatagcattcaagggtgtgttaaagggtgatctctatctcgttgatttcgacgtagatagagtgaatccggaggcatgcttgattgctaaatcctctatgggttggctatggcaccgtaggctagcccatgttggaatgaggaatttggcatctcttctaaatggggaacacattcttggtctatttaatgtttcttttgagaaagatcgtgtgtgtagtgcttgccaagtcgggaagcaagttgggagtccacatcctataaaaaacatcatgactacaacaagaccactcgagcttcttcatataggtttatttgggcccgtggcctacataagcattggaggtaacaagtatggtttcgtcattgttgatgatttttcacgcttcacttgggtatactttctccatgacaaaagcaaagctcaagatgttttcaagcgcttcacaaagcaagcccaaaacctctatgatctcactatcaagagggtgcgaagcgacaatggaggagaattcaagcacactcaagtggaggaatttcttgatgaagaaggaatcaagcacgagttctccgccccctatgatcctccccaaaacggcattgttgagaggaagaaccgaaccctcattgacgccgcaagggcaatgcttgatgagtacaagacttcggatgtctttcgggagaaagccgtgagtaccgcatgtcatgccatcaaccgcttgtacctccacaagatcctaaagaaaacctcatatgagctcttgagtggtaagaagcctaatgtttcatattttcgtgtctttgggagcaaatgttttattttaagtaagaggcctcgctcattaatttctcacttaaggtggatgagggattcttacttggctatgaatcaaatgcacatgcctatcgtgtcttcaacaaaacctccggtattgttgaactcactagggatgtgacatttgatgaatctaatggctcccaaggagagcaagttgttgtacatgttgtaggggatgtggatccaaatcaagctataggtactaaggctattggagacatacgaccagtcgagacgcaggatgaccaagaagatagggtcctattgaccggaacctccggacatctctagacccggaagttccgggttctatagtccggaacctccggatcagtggcagtgaagatgtgccaacggcacaagtggatgggatcgatgttgagggcactttagagcattctgatcaggctcaggtcccccagtgcaccatccaaggatacatcacactgtcgaaagagatcatcccgtcgacaacatacttggtgacataagaaaaggggtaactactcattctcgtgtcgcaagtttttgtcaacacttctcgtttgtctcttctttggaaccaaccagggtggaagatgcgcttggtgatccggattgggtgatggctatgcaagaggagttgaataacttcacccgcaatcaagtatggactttggtggagagacccaagcaaaatgtcatcggcaccaagtggatcttttgcaacaagcaagatgaacatagggtggttgtaaggaacaaagcccggttagttgcgcaagggttcacccaagtcgagggtctcgattttggtgaaacctttgcacctgtcgctcgcattgagtcaattagaattcttttagcctatgctgctcaccatgatttcaggttattccacatggatgtcaagagtgcctttctcaatggaccaatctcggagttagtctatgtggagcaaccaccggggttcgaggatccaaagttgccaaaccatgtgtacaagctccacaaggcgctctacgggctcaaacaagcccctagagattggtatgaatgtctccgagattttcttttgaaaaatggttttgaaattggaaaggcggatactactctcttcactaaaaaatttatgagtgatttattcatatgccaaatttatgtcgatgacataatatttggttctactaatgcctctttttgtgaagaatttagtagtatcatgactaaaaggttcgagatgtctatgatgggcgagttgaccttcttcctcgggctacaagtgaagcaagcactagagggcaccttcatctctcaaaccaagtacgtgaaagacatactcaagaagtttgggatggaggatgccaaacctatcaagacgtccatgcctactaatggacacctagacctcgacgataatggtaaatgtgtggaccaaaaggtatatcgctccatgataggatctttgctttacttatgtgcatctcgtcccgacatcatgcttagtgtttgcatgtgtgcccgttttcaagcggagcctaaagagtgccatttgattgccgtcaagagaattctaagatatttagttcacactcctaatcttggcttgtggtatcctaagggttgtgactttgagcttttgggctatttcgattcggattatgctgggtgtaaggttgatagaaaaagcacaaccgggacttgtcaattccttgggcggtcccttgtatcttggtcctctaagaagcaaaattccattgccttatccaccgccgaagccaaatatgttgccgccggttcttgttgtgcccaactcctttggatgagacaaaccctaaaagactttggctacaacttcaccaagatcccactcctatgtgataatgagagtgccatcaaaatagccaacaatcctgtccaacactcaagaaccaagcacatagacatttgccaccacttcttgaaagatcatgagactaaaggagacatatgccttacccatgtgagaaccgaaagccaattagccgacatttttaccaagcctttagatgagaaaagattttgcgagcttaggagtgagctcattatcttagactctcgtaacattaggtgatgggtggttggctaattcatagccaaacatgtgtcactaaaatgtaaattaaaaaaaaattgagcttttgtgtcttgagatcacttcttgtgtagaagatgatcttgataccatgaataaagctcaaacattccctctattatccaaaaacccttttgtgaaattttgcgaaaatttttgtgtgcgtttttattgcgaaaatttggtttttatcccttcttgtgatgtatattgaccattgttatgtaatgttgattgttggctggtcatatacatcataagtctctttatgtccataggttttcatttccaaatcattgaattctcatctattccattgaacttgggcctgactgccctctgttttgtcaggccagaagttccggtcaccccagtctggaacttccgggggtcgggggtataaatacccagggggagccgagcctggtcacttcttctcctccccgattcccaaaccctagccaccgctacagtgctcctatcggtgattttctcttccaaccatggaaatttgattcctctccgtggaatcaaccacattggtggctaggaggttcatcccgtgatcgatttgcgatttcccctctcaaggtagcacttttgatcttctcttttggttcatcatgtttttgccccgatctctaaatatgtgaacctagggagaaaaccttttagatagaattgttcctgctaccttgtagattgccgatctataggattttgtcacatgcactggcctggttaaatcctctgttcttcagttttgcaggccagaagttccgatgttgttggcccggaacttccggtctctgtccagacagccagtaaccttgattctgctactgtttcttttaaccattgcactccaaccttgttgattcttgttgcagtggtcattatgcctcgtgagaagagacataagctttctcaagatgttcctgctgactcgagccccccggttcgtggtcctagggggagattgggcaaagaaaaagttggagatttttacagtgggagtcagatccgatccattccaggagggctggtagcattgtcattcgtgatgcactccgctctccctctccagctgcatctgagtcagatgatggtggcaatgaggatgagcctggttctgaaagcaatcctttgaggctgtacaagacaagggctgttgatcctgatcctaaacgcccaagagtgaactatttgaagaatctactcaagtgtggaaatgacagaatggttagtcctgatactctgccagctgactttcaggatgacagattcaggacctttgtgcaggttgattggtataactctgtgatcatgggaagatctcatccagtggtagagatgaagtggctagactggcagtacatgtcctcaaagaacaacatagtcttcaatgaggtacgcaaggtgtgtgagcgcaagcacatggcagatttgttggccttgcagtattcatggaatgagtaagtgattggacagttctactccactgctttctttggcaccaccaagaaggggcttgtttttgtgaagtggaccatcaggggtagcagtatagggtctctatggcacagtttgctgcagctttggggttagatgatgatgacctgagtcgtccacatatctttgtagaggatgctctgtcaccgaccagcactacctttatgtatgagaaggatgctcccaaggattgtttggggactactcgagggttgcgtccatattatagagtgttgtactctatcttcaggtggtctttgctccctaaagtgggagatgctacagctcttccaggtaggcatgcgctcctcctcagtcgcatgcgctacaacaagcccgatttcagcatcatgaagcttatctggagtgagatctatgagacagtgtgtgagccaaagaggggctgcatctatgctccttatatcatgaagatgattgaggccaagactgggatttgttatttcaaggacaatcaacgcaagcctttccgtgctcatgctcccactactttagctactcctaccaccagagtgactcgtgcttccacctcagctgctccttcttcctcagctgcacctcaacgttctgagtcttcttctcccataaagaaggctctcagggctatcttttgcatgtgtgccaagacagctaagaaggtaaagaagatagtgaggcatcaaaagnaagattggattgcagcaggcaaggatgtctctgacatttctgatgatgaggagtttgttgatccttttgctgcttatgagactgcccgagacattgctagtggtgagagtccctctggcacttctcatttcttcaatgaggagtcctctcactccgaggagagcagtgacgatgaggagtcagatgcccctattgagaatgttcctacagatcccgatgaggcagtggatgccgccgggcaagacatcgactctcctcactcgggcgacactgagatcattccttctgatggcgataatgatgaggcttgatcctcttcttcccttgtgattttgtctcttttcggtgccttgatgccaaagggggagaaaattgcaatcgaagcgggtcaaaattttgtttttgatgcttgctgcctgctatctgtataatccggaagttccgaacctggtagctccctcgctttattgtcatgtcagcttgtccggaagttcctggtattttatccggaagttccggacctggcaatcctttggcccctactcttaacaactcatggacatgttctaattctctatttgtgtgaatgtaatgtctgttagatgctcttagctgccctttatttattctgctcttcatttatgctatgagtgtcttatttgttgtttgtgatgtgatgttgattttatctttttgagtgctcaccgtgtcgtatcttttgtatataatatctattcttactgcttttcgcatcccatgaatgagtagggaggaaggaaactctcctcggttgctcccatatatatatgcatatgagctccactcatatctttcatatgcatacattaagggggagtttcattcacctctaaccattcaaatcaaaattcttatcaatcttttgtaacctttaaccatgttgtcatcaatcaccaaaaagggggagattgaaagtgcattaatcctcctagtgggttttggtgattaatgacaaatgtggttaagggactaatgagctcattgagtagctttcaggtgcattagtccaaggtgtggaagatggatgcttggagaccccccaaaaagtacaaaatcaaagcggaccggaactcgagaagtgcataggatagtttatcttttgaaatcaagtttttaggaaaaaccgtagtattaagaggggttccaggtgatgctctgagatatatcaagtgctcttagtgtgaaccaagtgtcaagtttcccttggagtccttttttgcaaatactccatctgtccaaaaatgcaagtccagaacttcctgtcttctaggtccggaagttccggtcttgtgaaaaagattttcctaagtgtagtccggaagttccggtcttccaggcccagaacttcctgtctagtttccagttcaaatttgtgagtaacggcaagatgacgtcacctagccgttatacatatacagctcgtttctagctcgttctttggcgattccactttcacttttcgaacgtagagctattgctagcctctcccaagtgtttcttgccttctccactcaatctagagcctaattcttgtgagagagattgagagggagaaaagaagatttggagatgtgtgaagactaggatcttgggtgagcacttggaatatctcatgggctgtcatctcggtgcttattactcttggagatgatctcctagacgattaggtgtcgcccgcgagaatccgttgaaaattgtggatgtctcgggtaagtttgtgaaggatttcctctcctccaaaagggaacgaggtaagttagtgaagttcttgtgctgagattctagaggctttcaaagtagagcaacccacacttgtggtggatttctagaagtaggttgagttgaatcttggtggtcactacattctagaaatttgcctaggggtgtttggggttgaaggctgtggatttcctctgggtttttgcacaagtgaggcaaggggttaatcgagacccagctcttggagctcctcaacggagagtaggatcacaagattcgaacttcgggaaaaaatcgctcttgtctctttctgtgatgtttctatggatgattctgtgatatatcctctgcttagaatacctgtgcaccatcttgtgaagattggcttagtctcttgtttcgaaatttaaatttcatctctgttttgttacccggaagttcctgtattagaacaccggaagttccgggcctgggaggccggaagtttcggagttccttaccaggaagttccgggtctgtttgaattttaccgttgcgatttgtttttaagttttcagggacagcctattcaccccccctctagtcttcatcagcgcgttcaaatcctagattgttgaccagagaacaaccacaacatgctgggcaaagtgtcaatcggctgactcaggagcaggttgctgcaatgtttttaccaaatccaccaacagccgacccaatccagtcaatgccgattcagcaaatgttgccaagacagccgatggttcggccgattcaacagcaaaacttgcaacatgcatcggctaggctgaggaatcggccaaggcagcatgctgcaaatcaagtagttcatgagcacttggtccataatgtgcaggccaatcagtcagtcgtacctcaagttgttcctgaacatttggtgcacaatattcagttgaatttctagaattatcaaggaggtaatttgaattatcaatatcaggctccgtcacctcatgttcagtaccggcaaacaaaattgcctcaatttgctcctcagtttaatcagttcgagccgatacaacagcaaacgcaaggaatacctcagcaaaggccatggtctgatatgattgcagatgtgatgagggagcagtttgggttaaagccaaaggacactggaaacttgtatcggcatccttaccctgagtggtttgaaagggtttcattgcctagccgatacaaggtgccagacttctcaaaattctcagggcaagacaatgtttcaacttatgaacatgtcagccgattcttggctcaatgtggtgaggcatcggctgttgacaccttgagggttagattgtttcctttgtctttgtctggatcggtgttcacatggttttcttctctgccatataattctgtcaatagttgggccgatctggaaaaacagtttcatagctatttctacagtgggattcatgaaatgaaattgttcgatttgacagcaatcaagcgaaggcatgatgagtctgtgcaagattacattcagaggttcagggagatgaggaatatgtgttacagcttgtctttgacagattcccagctagccgatttaacttttcaagggttgataacaccacttaaggaaaagttttcatctcaggactttgaaagcctatcacatcttgcacagaaggtgactttacatgagcaaagatttgctgaagttaagaagaatttcaagaagatcaatcatgtatatccttatatgtatgattctgaagaggatgatgactccgaagtagcagcagccgaatgggtcaggagcaagaaagtcataccatgccaatggctgaggagctctggaaaagaggagaggtttgactttgatattaccaaggctgacaagatcttcaatttgttgcttcgggagaaacagattcaacttcctgctggtcatgtgattccatcggctgaagagttaggcaaaaggaggtggttctcattctactaacgactgcaaagattttaggcagcaaatccaggcggccattgaagggggaaagatcaagttcgatgattcaaaaaagccgatgaaggctgatggtaatcctttccctgttaacatggtacacacttctgggaggacagccgatgggggaaaaaatcgaaatatccagatgaattcggctaaaattatcaacaaatatcagaagaggcatgacaagcagcaggaaaaatattatgaagaagatgatggtggttttgatcctcattgggaatgtgagttcttcagattttgttggaatgaaggtatgaggcttgcatcaattgaggattgtcttggatgcaacaatgattcagggagttcaagccgatccagcaatagaggtaatcggctgagtcagaagagggtagctgttcatcagaggttgggccctgtgaatcaagattatcgccatgatgaagatgaaaataggaatacacagtggtgtcctacaggcattttcaccaagaatcagaagagaaggatgcaaaggatgaggaacagggagcattttcaggaggtgcaacaggagattaatcatcggctgaggaaaacaaagaccaagcaagagtgacgtgttaagagcacggttgcaacagctgatgagatcgaaggtgacaagacaaaaaggttgcttaagggcaaagctggtacatctgcctcaataaatatggttttcatgttacctgcagaattcgaggctaggcaagccgatgttgatgatgttgaagaagcttcggctaaattggtttgtctcgagagcaagcagtttttgagaagccagaagggacagagaatcgacatctcaagccgttgtacatcaatgggtttgtcaatgggaagccgatgtccaagatgatggttgatggaggagctgttgtaaatctaatgccatatactacattcagaaaattaggtaaaaatccagatgatcttatcaaaactaacatgattctcaaggattttggtggtaatccatcagaaactaagggagttttgaatgtagagctgacagttggcagtaaaactgttcctacaacattttttgtcatcgatgggaagggttcctatagcctgttgcttggaagggattggattcatgctaattgttgtattccttcaaccatgcaccagtgcttaattcaatggcatggtgacaagattgaaattgtactagccgacaggtcagttaatgttgctaatgccaatctagctctttgggagatgtatggtattgattgcttatctggaaaagtttgggatggagattttctaaaagtgtccgattgtgatatacaactgattgaagatggagagcccaaattattattttgagggcgtcgtggagggttcaaatgtctacaccaaggacacagtagatgatctcgatgacaagcaaggacagggtttcatgtcggctgatgatttggaagaaattgacataggtccaggagatagaccaaggccgacattcattagtaagaatttgtccccagaattcagaaccaagttgatagagcttttaaaagagtacagagattgcttcgcttaggaatatcatgagatgccaggactcagccgatcgattgtcgagcatcggcttcccatcaaacctggggttagaccatatcagcaaccaccaaggagatgtaaagccgatatgcttgaggctgtcaaggctgaggttgcacgtttgtgtgacgctggttttatacggccatgccgatatgctgaatgggtttctaacgtagttccggttatcaagaaaaatggcaaagtcagggtgtgtattgattttcgggatctgaacaaagctaccccgaaggatgagtacccaatgccggtggccgatcagttggtcaatgctgcttcaggacacaagatattaagttttatggatgacaatgcaggatataatcaaatctttatggcagaagaagatattcataagacagcctctagatgtccttgtgcaatcggcttgtttgaatgggtcgtgatgactttcagtttgaagagtgctggagctacatattagtgggctatgaattacatattccatgatctgatcggctggttggttgaagtttatattgatgatgtggtagtcaagtcaaaagaactagaaaatcacatagccgatttgaggtaagtttttgagagaaccaggaaatatggcttaaagatgaacccaacaaaatgtgcctttggtgtgtcggctggccagtttctgggatttcttgttcatgagagggggattgaggtgactcaaaggagtgttaatgcaattcagaagattcaacctctagaggacaagaagaagttgcaggagttgatcagcaagataaattttgtcagaaggtttatttctaatttatcaggaaagttagaaccctttacacatttgttaagattgaaagccgatcaaaagttcacttggggggcagagcagcagaaggctttgggtaatatcaaggaatatcttagttccccaccggttctgattcctccacagaaaggggtgccgttcagattatatctatcggctggtgacaagtcgattggttcggtattgattcaagagcttgaagggaaagaaagggttgtattttacttaagtcgtaggctcttagatgcagaaacaaggtattctcatgtggaaaagttgtgtttatatttgtatttctcttgcaccaagttaaggcattatctattgtccaatgaatgcactgtggtatgtaaagccgatgtggtcaaatacatgctatcagctccaattttgaagggaagagttggcaagtggatatttgctttgacagaatttgatcttcggtatgaatcgccaaaggcaattaagggacaagctatagccgattttattgtggatcaccgtgataactcaatcggctcggttaacattatgccctggacattgttttttgacggatcagtgtgcactcatggttgtggtattggcttagttataatttctcctcggggggcgagttttgagtttgcctatactattaagccttatgcaactaataatcaagttgaatatgaagcggttctcaaaggattgcaattgcttaaggaagttgaagccgatgctgtcaaaattatgggcgattctttgttagtaatcagtgaattaacaggagaatatgaaggcaaaaacgatatattgatggtctacaatgagaagtgccgagaattgatgagtgggtttcggctggtaactttgaaacatgtttctcgagagcagaatgttgaagctaatgacttggctcaaggggcatcgggatataagccgatgttgagaaatgttgaggtagatgttgcaacgattacagccgacgattggagatatgatgtatttcaatatttgcaaaatccatcccaatcggcttcgaggagattgcgttataaggctttaaaatacaccttgttggatgatgagttatattatcgaacaatcgatagagtgttgcttaagtgtttgagtaccgatcaagcaaaggttgtaataggtgaggtacatgagggaatttgtgttactcatcaatcggctcacaagatgaagtggttactttggcgtgcagggtatttttggccgacaatgttggaagattgtttcagatattatagaggatgtcaagattgtcaaaaatttggagcaattcaaagagcaccagcatcggctatgaatcctattatcaagccgtggccattcagaggatggggtatggacatgatcggccagattaattgtcacgtcccaaaacgactctaaaatatatcccttaaatgatgcctagaataattaaaatccatgtgaaagcctccaacaattaaaatgtgcaaagttaaaagccaaataagacttagaggatttttgtaaatttcctaaaagcctaaaatgcgtaaataaattttagtggaattttcagagcacaaataataattattaagaaataaacaaagttaaaatgattttataaaaag

SEQ ID NO: 12391 - DNA, 1695 bp, Oryza sativa
tgcacccctatttaaaccttccccgcgcctccctcgcccgtttccgccccttgccgcaccgtctccctgccggaggcgagctcgcgccgtcgccctctctctccttcgtcgccgacgacctccggctggccttctccgcttgccgggaccgtctcccgccccggcgtcgcctcctctggctgcgccgcaccgccgtcgaccccgtccaccccctcgccgagtccgccgaccgccagaacaccgtcgaccccgtcgacccgagccgcgccgctgccttcctccgctccggccgcctttttggtcgtcgccgtcgacctagggtgagccgtggaccgccgcctcttttccccctttccttcccctctatcggccgccggtccgccgtgcctatggccgccgctggcgaccataggggcgcgggcgccgcctcccgccggtcgcgccgagtggccgccttcgggcgcgccgagtggccgctgcgtggggcccggccgtcagccgcccgctccctcgggtgcggctgacgcgtggggcccacggcgccggccggtgcgagcccgggtgcgcccggtccaccgtggaccgtgaggctgccacgtgggccccactcccgtggacccggtccgcgcgctcactcccatcggctgacgcaataaaccctttttaaattaaaatttaaatgaagaaattcgcaaatattcatttaaagaggatataaacttcaaatggccataacttggtcatttgaactcggaattggaccgttcaagtctcttttttttccttaagaagtcaagaacccatttttgtgctttgttactgcttgttatatggagtttattagagtaaaagcccttttattttccgttggtcgtgtagacgttgcagcttcggaagatctgctcttcgtggaggttgaagccgacgtttgggaaagtgagcaaggcaagtcacattatccttgaacatattgaatctcagtttataaaattattttgatttaaattattgcattatccctttatttaaattcccgcgttatcactgttttatctagccatgcctatttacctttgttatgaccttattattgttattgttattactaccttgttcaccctagaataaacaaaaccccaactagtggacactctactcatgtgtcacaccctgaagttctcctcctaagcctaaaattgaattaataagagaccctaagaaaataccggtgcaaagcaagagtaaaccctattgaatcaatgcaaataataatcagaattggcatgtggaatttttcttgagttctacatgttgaaattcactaacaggatttttagtggaattttcagagctctcgaaataattttaaccatttaaaatcaagcatgcaatattttaattccacggaaaatctttttctcctttttctttttctttttcccttccctttccgaatgggccgccggcccattctctcctttttctccccctcctccccgctgggccggccgcaggccgaggcccagccaggccgctccgcctccctcctctcacggggtcgccgacaggtggggcccacctgtcgggtccttccccaacctcccgccgcccgcgccgggcaccacccccgaaaccgccgccgccgcgccccacctcccccctttccccgagcccacgccgcgtcgcccgcgccca

SEQ ID NO: 12392 - DNA, 4307 bp, Oryza sativa
  unsure (1)..(4307): unsure at all n locations
atctccctctctataatctctctctcttccttccttagggcaccccgaaacccgtccgccggttgctgtcgtcctaccgtggcttgccgtcgacgttcgccgtagtcttcctctgcgccggccaccctcggtgaggtttcctctcccatccattcccttccctctccttcctagccgccgcttggcgccgccgccttcgcgtcgcctttgcgccgtagcgtccgccgccggttgccgtcgccggcaacgcgttcgcgcgtgcgcgctgtcgtcttcgccgcggccggtaggccgagcttgagccaagccgagccgggtcgccgccgcccgtccgatcgaccccaagggcgatctgggccgtcggtcctgtggaccggcggtggaccacccgcgtggtcccggtccgcggtgaaccgccctcccccttgagtcgctgaccggtgggtcccgcgtgccggcgcccctttcctccctctcccgagccgctgaccggtgggccccgcatgtcggcgccgcgcccccttgatgacgtcagccctgggatttattgcgcaataaatgatttaaggtttttcttttatagtaataaacacagtgaatcttctaaaattcataactaattcatccgagctccgtttaagcccattcaaagtctcagtaaatcaagaaaaatgtgtagaatccattaaaaatggttttgttccctgtttcagtagtcttatagcctgtttgcaatgtttgccttgtatgtcgcgagattccggttccttcgacgctccagtgtacctcgaaatagtcgccgaggttcctccagcagcagagcaaggcaagtcatgcttgtcacttgaacatgttgatcctatattgcaaatgctctattgttttctttcaaatattgcattgttttataatgtgtctatggggtgtctacctattgtcatagccatgctattgttgtaccatgtctctttgtcagcttggggttataacatgactagagattggactagggattgcttagccatgcttagttcaactagtgcacaatggggagaatcctattaatgtttagactgttggttctaatggtattgttggattagtgccaccagtttggtgttggttaattaaaataaatcacatggtgggctgtgggtgcatggttttgctggtcgcacccatggcagttaaggaccggttcgtgggatgccctggaagaacttatcgtacttaccacaagccagcgtgggcaacggctggggttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtatggtgtgcttggttagagggggttgtgcgaagggtcctgtcacggcctctttccggtatgtcgtggtggcatgtcggcgcacggaaacgtgtcgtggggctgtgtcttgtgggtacagttgtacacctctgatcggagtaaaactattcgaatagccgtgcccgcggttatgggcggtcaaccagattcaccgtgattagtctcaccctagtgtaatcttttgaatttggatagtttaggtggatggttgggcctgttgcaacgtgggataacgttggacagtggatagttaatattaattaattattacaactgtttaattctttcaacttctgtttataagtgctcgctttatgcaaatgaaccactttagctctcctttgataattccctgcatcatacccctattccggtatgacttgctgagtacagtgggtagtactcagtcttgctctatttttttcccccaaccccagagtacgagtatgtgtcagatggaggtttctccgaggagtaggcttcgtccgtgccgtcgaggatgcctgtggagtggtgttcccactgcagttctagtcaaggcttagctcctgttgtctttcttttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacatcatggtaccactagtatgattttaggtagatgcttcgctggttaattaggcaacattaggtggttttacaactctagactttgggaatattcatatcacctggacactatggaatggatggattattgtggaattggattcacccctccccctctattcaaaaccctcaaaatggttttaggctgggcttggggtgcatggttttgatagtagcacctcggccatataaggatcggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccagtgtcctgctgctaggggctcagtcctgcctacctgtccccggggttccggccgtaggtggggttgggtcggtactcttgtctatggctaggatgggttggaaactatgtcacgtcttccgtccgtataccgtggtggtatgtggcacgtggttacacgtgagaaagatgtgtcttgtgggtaaagatgtacacctctgatcagagtataatctattcgaatagctgcaccctcggttatgggcaagccgagcaatgtacccaagttagtgtttttaattcttaaaacctgcttaacaactaaaatgtggaatggtaggcctgagttggcttgggacgagctgggacccagggtcgggttgccagttcggtttgaatcatcgtaggccttgggttaaggcaggttcgtgtgggttcacggccttggttaataatattgtatagctctaggaccgtgtttacaaaatagctttgagcaactaagtgtcttttaatgctgtttactgcaaaccctaaccccttatattataacccccttgtactcccttgcatttattctgcacttatgcgtgtgtcttgttgagtacggtggttgtactcagtcttgctcaatttttctcaaacccagaagaggagcccctggatgatgaaggctttggtgtctagctcgtgcctgccgtcaagcacctgtggtcgtcgccctagtcttcgccgcccatgtaataaagtaactatttacgcttccgcttgataaactctgaaatgtatcaacttttggtgtaccttgcctcctgggacaaggaataatacacgcacgtaaggaacccccgttgggttatttccggtcgtgacattaatccaccttccagcaaggggcatagatttatattggttgcaactgattatttgaccaagtgggtagaggctattcctttgaaaaaggttgatttaggatatgctatacaattcgtcaaggagcacataatctaccgatttggtatttcccagactattacaactgaccagggatcaatctttgtgtccaatgagtttgttcagtttgctgatagtatgggtatcaagttgttgaattcttcttcatattatgcacaagccaatggacaagccgaagcatctaataaaagtttgatcaaattgattaagagaaaaacatctgattatccttggcagtggcatacacgactgaccgaagcattatggtcttatcggatggcttgtcatggatcaattcaagttcctccttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12393 - DNA, 15087 bp, Oryza sativa
ctggaactcatttcaatttaggagttggcttcgttccaggcctgacctatttgaaacatgtgatcggtgcttcccaataaaaatagagcatgcttagtttgttaccattttcaatcatactaaatttgggcatgccaaaatttgacaagcggaaatccaaacatgtcttaggccccgatagtttcctccatataacatcagcagccgccaaaatttgatttttcaactaatttttgaagggttttcatcgaagtttatttttcagtattatcatttaaatcgctaagaatacatatgtaaaacttttacctataaattattagtagtttgctattatccgtatttggccaaacgatgggggccttatatatataaactctggtaatatgctggaaactttttgacataacttcatgcaaaaatatctcgtaaggttaaaactaaaaaacaccgacttacctatcttatcttacccaattttggcattgataagctttacaagttttgtcatattttttccattttgtacaatctaagactcactttcgttaaattcatgtgttcatgagttaaattactggacaattggagagaaaaaacattcacatttgaaaggcttaattttggcccaaaaccaaaagcactccaaatcttgtaataatattaaatagctccatcgtttgctctttagtttatcgatcactgtcgaaacgtgaattttaaatcttaattttagaatcattttgattttttttattttagtttattttagtattggtttttaagtcattgaaatatatacataaaaaaatatttttttaagttgctataagtattaccgtttataattaggttagttgctataagtattaccgtttataattaggtgtaggtgaaactatggaactgtggtggcaaaaactatattagtaagctttggccatgacaatttgtaacctatatcatgttaaaggaaccatatgcgagttgtacacgtgttatgactagagaaaaggaataagaaaaacagagtagctaggagaggacaaatggcatccaagtaccacatcaccctgattttccaaatctacaaatcgtcaatatcgtcatttctgcgctctagatctgatgcaagacctcaggccttagggtgacatctcgacagtaacctttaagccaataattcttttcaaaacctttaagccaataataatctaacagtaagaaaaaataaaaataaaaacaagacaaaattgatgattcatatccatagaatcaaagctttttggggcatcttgtgaagtggatggcaacatgaaagggacctccatttcatcctagagatcagataaagtgaactgggaattgtgatcaaaatcttactgaagatatgtgaataaacaaacaaatcaataagtgtcacatgtttggtctagatgctaggatcagaatttctagcaaaaaaagcaggatatatgtaaaaattcagttgatgcactgctaaagtgctactaatatactatgatttgttcttgatgctttattctggaagtggtgtcaagtgaactgtgcaccttgcacactttatgtagaccagtcatcagtttttcaatcctgtcactggtcatatatatagctgaagataataacatatgtcagttctgcctgtggcaacattggccttctctgattggcctgtacttgatgatattgtgatcttaattggatgactctactaatgcaacgagtttccctcaaaagaatactcgtagcattttaatcactttaagtgtgacatttacaatttccgaagaattaatcttcaccttgcgctgccattgtgcatttgatttgaaatagtgtagtaataaatttaccatttattttacggtaatgctaaacaacgtatttcgctctacctattaagtaccatgccttgcagccacccatccatcccgctcccctccctcctctcctcattcccctcccgatgttaaaacaaaaaaaaaaagttactctcaattttacccaaacgttggttctgtcgttagggctttactctctcctcctgatgtaaaaaaaatactatctatttggtgtagaaaaaactatcccgtcccgtccccttccctcccctccccacaccctctctcttttcttgatgtaaacaagttactcttgatggaaatatggtatatgttttggtaactcttatcccctctaccccctttccttctaatgaaaaaaaaaacactccaggggtattagacaaaaaaaatcttggaaatttatttcactagaacatttattctatgctttcccacttccctcccgatgcaacaagaattattctcaccccttcggaaaagggtacgagcaatttattttacattgtaagaagagagtgggggaggggatagatgaagagcctagcataacaaggtgtaagtaactgtacatgtgggaggcgggaggcgtgaggtgcactattgaagctaaacaatgtgctacactctgtatattagttctagtatatttcgtgcataaatattcataatgtcttatctaggctcaaggccatttgaagggaaagcatatgaatttgataggatttcattgtcataggattttttttttctaaatggatctgaaacaaagaaaggacacaatacctctatacatgcaaattttggagaaaatttaatgagtttcaacctcataaaatgtgtcctttcaatctctatcttttcgtaaactcctatgtttttcgtgcgatctaaccaaacatatactcatgtattttttccatttcgtagaatctaagactcactttcgttaaattcatgtgttcatgagtttaattactggacaattggagagaaacaacattcacattgatttactgtactactgtaggtcccacacaaagcacaataactataataaaaatatactccatccgtcctaaaatataataacttttagcattcaaaatttgtcgcaaaatataaataacttcaccaaccatatttccttctcgacaaaccataaacctccactattcaaattcttcaccaacttttatttcctcgaaaaatcgaaaacttcttccatttaattctactaagtattcttgtgtaaggtggtgtttggattcagggacttaactttagtccctgtatttagacactaatttagagtattaaatatagactacttacaaaactaattacataaatgaaagctaatttgtgagacaaattttttaagcctaattaatccataattagagaatgtttactgtagcatcacataggctaatcatggattaattaggctcaatagattcgtctcgcgaattagtccaagattatggatgggttttattaatagtctacgtttaatatttataattaatatctaaacatccgatatgataggaacttaaatctagttttagtcccatctaaacagagtctaagtctaatacttcttgtattgtacagcgggatgtagccacccacaactagtactaattataattagtattttttatttgtgatgatgtcataaatacaagtggcgccacgctgcaggtggaatacaaacggaacagcacgtgccacgcgtccccgctgccaactcgactcgactcgagtccgaccgagcgagcgagcccgactcgccgcgcgtcgccgacgccggacccgacccaccccacgagccgagccggatttattcccgtttcccgagaagcccatttgctactccacctcccggattcgctggcggcccacaacccaccagccctgctgacgaggcgcccacctgtcagttactcgcagagagggagccagcggatcgggtcgggtcgggtggtgggtccaggcccggatcgcgaggcaggaggaggggtggcccaccgcagcagcgcagagccaaggcacagcacgcacgcacgcacgcgcgcgggaggcccggtcggtcgtcgcggcccaccggctgcggccggtcgctttgcctggctttccggttttaccccccgtaaaaaggaaaaatgttcagaagatcgatatgcacgaaatcaccctggattttcgtgaattcttactttcttctattgcaaatgtacgatcaactacacggtaggagtatagtgccgatcaaatttagtatggaacatgtttttcttttttttttaccatccttcttttgggatagttacatatgacgaggtaaaaatcgatctcaaaagaaacagcttatgaaccaagaatagggtgtgattatgtttgatcatttttcctgtttaaaaaatttagtccaaatataaaaatgaataaatcatatttaaagttcctttaatgataaaaagtcgcaatgaaataaatagtgctaaaatattatagttttttcaataactgatggtcaaacttgagaagttaacaccatcacatgttataattataattaaataagtagaattaataaatatgattaaacatgtggatcggataaattttaaggaattttagagggatataaataattatatgaaaatcctataaaattaaaattcatgaatcccaagggagactttagagctactccttgcagtgaacaaagcttctactgtatgcctactagcatgtcttgtgcgcatttacttttttgcgtggaggtttgtttacttatcatggagatgagctggtaattccatttactccctaattaaaatctgatttcataattttactgcctttagactattcccaaccaagacactagacatagttttcataaactctacatcatcaaaaaactagtactatacattaatctttcaatgcaaacaccactattccatacttaaatttaatgttgcttatctcacatgatgttcttggatgttatgtagaaacaatgtctcttttctcacgcaaagacatggtttccttctcttttctcatttatttacttgtcacatcaatttttatcctatgtggcagcttatttaatgttatggacaccattctaatcattgggttgggaatagccataatactactttgcatgtttatattcttaattgcatgcatgcttcaattcatttgttcctctgtgtggagctgcactttcaggaaaaagtcatcactagatcatctcagttgaaaatcttgttccatcaacgtatcgtctgacagtttggaaaaaatgtagtagcagcttactagctagatttggtcaaaagactttaacgtcacaaaaacaaattaagtcatacaaacagataattaattccactctcctccatatcagttaatcaatgacatttgacactttccagaccatattctttacctaaaacatctaacagttttttttttcatcgagcaatagaaatctatccaccagagtggtttcttagcttcatctcgatcctacaaaaccaaacttaatcttcttttagcacgcattccaaactactaaacgatacgttctgtgtaaaaaattttatatgtaaaagttgttttttgaaatatcaaatatatccctttgtcaactttgtaataattaaaacttaattaatcatgtgttaataactttctcgttttacgtgtgccaacttaatcttcatattcgtccgttccaaacaccaccttaaagccatgaagatatatagcatggaagaaatagtttacttatagaaatcgaggatgctgctagcgctttttaagacaaaatatatataccatttattgtttattatcatctactaggctgtgtttagatccaaactttagatccaaacttgtaacttttttcatcacatcaacctttcatacacacataacttttcagtcacattgtatcaatttcaacctaaacttccaactttggaatgaactaaacacaaccctagttttctgtctgtatttcttttcagatgaagtataccgatcatttccatagtcatctaccgctatgtactaatgaacatgtgctttaaaaagtttagaaagtcaaaagaaagaagctggagtagtcttgttttctcatgaaaccagctaaaattcaatgcaccacccaaacttgaccactttctcccatctcatccaataagcatcaaaaccttttcacctccatcaaaaataaaacccacccttctcacctctttggttcaagcaaaattgtgacaagcctcaacaaaaaattaccttctctcaaggtgcaaagctgtaaaaaaaaactgagtaaaaaccccattttacccttgttcccataaagcaaagagaaggggaaaaaaatgttgtgtgtgtaagtaaagccaagagctcactaaacctagttttgcccaaaaacccagagagaggaggctccaaagcaaaagcctcactccctttccccatctcctccctcctcttcgccatttcgtcgaacaccttctccgatcgcgcgccgccgccgccgatgggggagcctgggggcgccgaggcggccgtctccgcgaggctgctcgagctggcggccgacgacaacgcggcggggctcggggagctcctcgcggcgtggccctccctcgccgacgagcccgcgccgtggtacaccccggcgcggggcgcggagccgctgaccccgctcatggtcgccgccgtgtacggctcggtgggctgcctcgacgcgctcctctcgccgccctacctcgtggaccccaaccgcgcctcggcgtcgtcgctctccaccccgctccacctcgccgccgcgggcgggtccgcctccgcccccgcggcggtctcccgcctcctcgccgccggcgccgacccggccctcctcgaccacctccagcgccgggcgtccgacctcgtcgcgctcccgcccaactcgctcccgctcaagaaccacctcctctccctcctcggcgcccgcaaggagtggcctcccgacccctccctccccgacatcaagaacggcgcctacgcctccgacgacttcaggatgtactcgttcaaggtgcgcgcgtgctcgcgggcctactcccatgactggacggagtgccccttcgtccaccccggcgagaacgcgcggcggcgcgacccgaggaagtaccactacagctgcgtgccgtgcccggagttcaagaagggggccgggtgcaggagaggggacatgtgcgagtacgcgcacggggtgttcgagagctggctccacccggcgcagtaccggacgcgcctctgcaaggacggcgtcggctgcgcccgccgcgtctgcttcttcgcccacacgcccgacgagctccgcccgctctacgtctccacgggctccgccgtgccgtcgccgcgcggggcgttggagatggcggcggcggcggcggcgatggggatggggctgtcgtcgccggggtcgtcgtcgttcacgccgccgctatcgccgtcggccggcgggggcgggggcgggggcgggggcagcggcggcggcggcgcgtggccgcagcagccgagcgtgccggcgctctgcctgcccgggagcgccgggaacctccacctgagccggctgcgcacgtcgctgagcgcgcgcgacatggccgtcgacgagctgctcgccgcggcggcggcggcggcggactacgacggcctcgtcgcctcccccgcctccatccggtccgcgagggggaaggcgcttgtgccgtcaaatctcgacgagctcttctccgctgagctcgccgccgccgcggcgtcgcgctcgccgcgctacgccgaccaaggcggcgccgcgttctccccgacccgcaaggccaccgtgctcaaccaattccagctgcagcagcagcatagcttgctctcgccgcgggcggccgcggtgacaccagagccggtctccccaatgagctcccgcctcctcgccgcgctggcgcagcgggagaagatgcagcagcagacgctgcggagcatgagctcacgggacctcggcaacgccgcgtcgctgctggtcggctcgccggtgagctcgagcatgtccaaatgggggttcccctccggcaacccggactggggcgccgacgacgaggagctcggccgcctcaagcgttgctcctcgttcgagctccggtccggagccgccaatggcaaccatgagcctgacctctcatgggtcaacaccctagtgaaggagccgacaccggagaagatgatgacgacgacatcggcaatggattccattggcatcttgggacagaacacaagccgtgatcacatcgtcggaggcgaggatgacactgccggagtcatcagcagctggcttgaacagctccagctcgatgagatggttgtctagaaacacaaaacacaaacacaaactgaacaagaaatgcgccattcttttagatgtgcttcgccgattgctactactactcactacttgttgctacttgctagcatcaatcttgctattgattaccggtgatacattcttttgggggtgatgagaattatttagcggagaaggtgatgaggaaattcttctaccatttagcattgcccgtatgtaaaagaatcggaggaatcggagcctagtcaaattgtatcaaattgccggcttgcctaggtgaaagatttctcctttgtgtttcttttcgatttatccttgtattaatctttttaatctcttttcgctgtttttcttttctaaaatgtgactgaggatcatgaattatgttatctatttgcccccatcctttggttgtgaaggagttggaggggagggtatttacatcaaatgttgcttagtcctaacaaagctcatcattgatgtaatgccctacaaattgtacccatgattcatgattgatgtaaaattcctattgtagtaccaagattgattaatctcccctgtttcctgcatttcttttcttttcttcagaaagcatcatatacatgtgccctttatcctgtgagaattacattatcgcatactccctccgtcccaaaatataagaagttttggttggatgtgacacattctagcactacgaagctggacatgctgcctgtccagattgtccagatttatagtactattaggatatgttatatccaaccaaaactcttaatattttgggagggagggagtatcatttcacctgagatggcattagttttaaaatcacatggattgtgttcagttgctgttctgatggttgcctgatgacaacagctgttggcatgggcttagtttgtgcagtgcttgactctgtggatgtggtcatgatcacaggtcggcagatcggcattgaaaaagattggcttggcctggattgcttcccttctcctggaggcattttgaaagggatttggatattaagatggttaacatcatcgatcaatgcgaggttaatgtttaatgtgttctagatgacctggtccctcactgatgcaccctgtcagaataaaacaacttggggacggtggctcggtaagctcgcctcttgtctttgttcacagtgctgacttgtactgtgacctggaagaaacatgggttggctactattttcatgtatattgtgtagcgtaaaatttccacgaaattgctatggtctaagtaaaattcagattgttgcatatttttattctagtgaagtgtgaatgcttgatgctattgtgatcctggttaaggtagctcttttaatagtataacactgagtttcttggtctttctgtttctttttttagccattcttagttcctaatttctacaaaaaaggaagttgtcttagatgttacagggtagtttctggatgtttaatgatgcattcagatggtgacagtattgaaactggatggaatattgcaatggatgtttggtttgcatttcatctacttttgatatatttggatacaaggccagatatgtggctttattattcatcatgtgagttgttattaaatgatgtaaatattttttttaagaaacagttaggtccataatggctatgattagaatatgggttgggttagggaacctacctctctctgctgacattcaggtgcatctacttaagctaggtcccaacaattaatactcttttttgtaaaattgtcatctcaagcataaattggtgcatagtaattgcatcgcaccatccctactcttgatctattaaatttgccatatgattagatatgtctggaggcaattgatatcggcacatgcctgtcaagctataatagtacatcaatataaaatggtaaaataattaatttgtctttgaagaaatgtttcatggggcccttgagcaagtggatctcgttctattttccacaataaaatttagtgagcaagctaataggcattatgcatatatagaaaattatccaatgaaatgcagccttcctttctctttttcaaatgtggtttggttgggacttggagaatggggattggagggtggtacacaagtgacctcattcagatgttgatttctccattctgagataactaatgttgctatttagagttgatgtgacatcaatataatgtattattaaaaactaaaggggcaccaatctattggtgcaaaattgacgggtaggagggtctgcatcagattttgcatctcctttgcctacatagtttgtatctatacatgatggtgatgtgctcttctgtatataaaatgtttttttctcacaggtatataatagcattctttgtcctactagcactggtagaaatttgttctgaattgctattgtaaatctattcaatatttatgttggacaatatcatcttcggcgaaaaacatttcaggtggctagaactaatttctgcaccaaggaatgtagtatttctatttccgattttgccttttgattaagactttctaggggataacaaaagaaaataagataaaaacaaatgtcatgtatcatgtgtgtcatggtgttggcttcttttttgacatttgttcgtcttgtgcggaatgctttttcgcaagttgcgtccttttggttttggggttgtggatgtggaatttgtcgttatgcggtgtctaatttatttctttgttttaggtattgaatcataggttcattaaagaactatatacatagcataagtagcaaagtctaattgtatgatgcatgaatgcaacaaaaaaaatgtctacataaattatcctatgccactaaaaattttacacaattccttattttcagactagtttttgggtgactaaatatattataagtggcaaaatttgctgcaagacattcaaaaaacttgtaggggacactgcaagaatacgtatctattgtggggacaccgtaaaaaactagtaatgatacatggtgtcggagctatatgcgagccgcacatggcaggcatgagcaaaattgtactttcacgattatttctctctctatttgcgctagatataataaaataaagtcgtgggtgtccaataactaattaccattttttgtggtgtcccaagatgaagggatagacgagtagctcgtcatgccactatcactggtaaaccctcgtttccacattcccctctcttcttgccttccccggtttcctctctaatggacagggggtaggcgactcaatctaatggacagggagtaggtgattgcgatttgccgcctaaaatctagagccccatcggttgccctaataagccgaagacaaaaatttaaattttcaaacttaaaatttgaaaattaattttaagatattttaatgtagtttcttttttagcattgacttttaaatcgttaggaacacatatataaattatttttacttataagttaatttttatttcctaataagccaaaatatgagcaactgatgactcccctagtagcatttttccatttaccattcatttcactgaaatatgcgcttgagcccacataattgaggctgttgctgaaggtttctgtgattcatcaaggtttctgtgattgcagactggatggcacagcaagtcaggaacagagtagcttggcccctggctcctggctggcctgatcaatcttgcagggatccgatggccacgtggcagaatcctgaccctcaacacgtacgggcatgagctcgatctgcaccactatactccaaacatctgcacgcgttgctgcaggcaataacttctttgtctcgatggaatttactaccgtcagaggaattcagtaaatgaacagtaaattcacatttttctcattggcatttttattgcagtagaaaccaaaaggttcagataagtttgttgggttaaacaagaagagagatgtccataagcttattgatgtttttaaataaaaaaactagtagtgttatcttgagctttatcatggccaaaatgatggtgaatcttgacctttttttgcagctgaaaagttgaaataaatttattggattaaacaagaagggagtgtacttttgttccttctttaattaaactatttcagtgaccttgagctttaacatgataagaagagaaggatagtccatattgatatgtgggtccaaatgtccaatacatgccacaagtcggtcaattagcttctagatgcattacaaatgtcttacaaattcctatttgtaagactagaatactagaccttcaagtctatgaatgacaaacagttcattctacagtatttttttcttaaaaaaaaatcattcagtttgaaactagcagttgatgaaatttccatacaatagaatatgctagaggtgccaacaacacatgatccacaaaattcttcacccaaacagtatgagaggcaggaccactacatgagaaaatgtttctgcagttcagtccaaccagtagacaggctactgaaatgctgccaaaattgaatggcagcttttagccttttatggtttgtttgggatgcaaaaaattcatataataccagagaggaaaccttgctgcaaatattttgataagacccataaatctacagtatatcagtatgctttgaattatcagtagaaattagtatcagtattaattaactggagaagaaaatgattgccggtggaatacaatttcgcgcatattttctaggaaaagcttgggattgcttgcaacactggaaagagtacagtggtgagaccaggagatagtacaatcctattttctttagattgatcacttccccatctcaatctatcatgttcagtgagaaaaccaatcattttcatctgatatagagtatcatgcttagtgagaaaatcagcatggcagcaccatttccttcatctgtcattttcagttggaaaaaccagtcagttagaggcaccaacccatgtgcatacaatcactctctgaaaatctagacaaggtatattttccctctcagctgatcaatcaactgaagaaaattcagaacacagccattgtcaccaggtagcaagtgcatcacagaattaaccccatgtatgaggatctagtcaagtaggtttagaaattaatcttcgtgtgaatgaatcagcaggcaactaagcaggaaacaatgcaatgaataggagcagatgagcaggaagattcagagattgcagcgtagggtgactgaacctgaaaggagtaatgtgtctgaatcactgatttttcagaaaacacagggatgctcttgaagaagggttcatgcttggcttgtgtcattttccatgagaacagacacatggctttgtagttctgttggatatggacattgagaaggactactctctggattttgagctggatgcagccatgctttctaggataggttaacaatctgctttgctttgaggcttggatcgaaaggagtttgttctaatagggactaaactttaggaaggataaatgcttcatggaagatatggaggcaagttggctgtaactgtgatctagattactgtgttcttgataagtcatgcaaaagcagatagcatctctctctccctccctcttgaagagaagaacaaaaataaaatagaatccatttacagtgtttatgctgttggagaatgactccatcctcgtagcttgaaaggcccacaatagtctcaaagaaacaagaacaaaaataaatgcctgaaatacactgttccaggccctgttctattattcctcaactagtacaaaagtttcgggttccctcaagttggatatatttatcatctgcactctgcaggacatatcattagcaaaacttattcagacaaaaggagaaccgcatcctatcttaccataaagttatcccccactaacttcttaaatttaacatgcaaagataccacatcatcatccactaacaagatgccacatcatcatccactaattaacaagataccacatcatcatccactaacaatcatcacatttaaacatcatgcaaacatgctatatctttatagttttataatttaagagcttatcaaatacaaacatgttaaattatcatccaacataattcacataatgtttcaatgtatatctttcaatgtaattcaaagtatgaattaccccccacccgaattatcgcggtcgtctgagttacccccctgaaccacaaaaccggacattcttcacccccaactatacaaaccagacgaattacccccctcgacccaatccacggtggttttggtatatgtggcgtacacgtggtagtccagtcagcgttgttttaattaaaaaattgtgggacccacatgtcatacactaatactctctctctcacccttttctctcccgcgcaacgcgcacggtgaggaccagcgcggggggcgaagcgtggaagcggagcgcggcggcgcggacgtcggcgctcaggacttcggcgcggaggcggcggaaaagtgtggcggcgaaggcgggcggaggagcgtggcggcggagcgcggggaactgagccagttgtgggtggcggaggcggcggaggagtgtggcgcgcccccgccgaagaggacgcccgccgcccacggtgcgttcccgtgagcccacgacgaggatgaggaagccgccgcccaccgcgcgtccctgcgcgcccggttggcctccgcctccatcgcaggccgtcatcg

SEQ ID NO: 12394 - DNA, 4614 bp, Oryza sativa
ctccaccacgctccgctgccacgctcgtccgccgcctccgctcgtccgccgcctccgctgccacgctcctccgccgcctccgctcgtccgccgcctccgctgccacgctcctccgccgtctccgctcctctgctgccttcgctcctccgccacgctcctccgccgcgctttgccgccacgctccttggccgcctccaccgcctccgctcgtccgccgcctccgctctggcgccacgctcctccgccgtgctccgccgccacgctccgccccccgcgcttgtcctcgccgtgcgcgctgcgcgagagaaaagggtagagagagaatagagagagagtatttagtgtatgacatgcgggtcccacaattttttaattaaaaaaacgctgattggactgccacgtgtacgccacgtagaccaaaaccaccgtggattgggtcaaggggggtaattcgtccggtttgcataattgggggtgaagaatgtccggttttgtggttcagggggggtaattcagacgatcgcgatggttcgttgggggggggttaattcatactttttcctttatgatatcctatatacttatatagttcatcctcacttagtgcttaaatgattaatctatggtccaaattatctttctccttttttcctctaattaagtcatatcacatcgctgtaaaaaaaagtcatatcacatcaattgtttttagcctttagatgattaatctacggtccaaactatctccctacttttcttcttctataaagtcataccacattactttttacgaatcaccattctacatactatttaaatttaaattatcataaaccacattaatttacttaatttgatgttatctagctatcttacacgttatatttttattgttatcatactaaattcccgcagcaatgcgtgaggtttcacctaattagtttagtttttgggctctctgagactagtgaaatcgtcattaaaacagacaaaatggcatagattgtgttgagattatgatcacactctgctacaaaatataaatattgctgcacgtttccgaaataaaatgtttatattttaaaacggaaatataagtatttctgcacgttttccgaaataaaaatgcttatatattttaaaacagaaacggaaggagtactataacagaagccagttaaaagagcgatagagtttaagaaaaagatgggcgattcatttggtgtgagccaaacattgatatactaacaatttgcttgtattagcttaccgattactaatagacaattagcttgagaatcaggatggacgcacagcataatccagcaaatggattaactattaatgtttataggactacatgaattcttttacttcactgataaaggagccctcattgtactccgttcaacgaacaaaaaaacctctcaagaacaatgaagcaaacaattcctcaatgatacggtacaattcctcactatgatttcacctagttcaggtatgatgaacctagtagctgatgcctctccggcaaacaaataacaaatggaaatgaattccatgttttttttatttcctttgtcctagggtgtttctgaatctgttatctcaagcaggttgatcaaaagtttctcgtcagtgcttctgcaatgccatcagcaacaatgttttgagttatctagttaaccggggatatcttgaggccccttgttcgtccaggagcacctcctgagagagacaagtcgagcgataacctgtaggaatacaaatagagaggatcgtggaatcaactatcattagcttgaaaataaggtgaatcagctatcattaccatacataaaattagggggaaatggcttacaagtttgtggttcctttctctgcttcgttagtctcagattgcaacaaaatttctgagtttgttttggacaggattgagtaacatgcagtttctttcccgtccttgatgactgatcccataatgaaagttactatcagatttatgatgaaacactaataataataaaatggaaggaaaaatgtaaaagctcatgtttcttacaagaatcatttgaatcttcgtggtcatcatccaaagaaagcaacttctgcaggtcacaggtaaaaattaaggaacagaacagcgtattgcaataagcatctctcacaaggaaagtttatgcagccaaggcacaaggttaattaccttcaaattttcataacaagcttcaaggtcatcatttaccaaaagatgatcgaaaagacctggtgaattggactggtcaagctctgcacgagcattcctcagtcgcttctggatttgctcctctgtttcagttcccctacatagccagtgcataaatcaaaaagtttatttcatatggtcaggaattgaataatcaagtacatgagcttaggctatcactgcattttgtaaactacaaatataccgtgcccgaaggcgcttctctagttcctcgaacgatggagggcatacaaagatgaatattgcttcaagagaagaagccctcacagaacgagctccttggacatcaatgtcgagaatacacctcttcaatgaaaaagcaatggaaagatgtagcaattcacctttcagaagttttcatgaaaaaagagtaataactttaccttcccctcatcagtaacagattcaactgcttcaacgctagtgccatagacatttccatgaacatgagcaaactcaagaaatttgccctcacttatctcttcctcaatcttgcttcgttctgtgaagtggtaatgaactccatctatttctttctcccttggagctcttgtggtgtggctaacagaaaatccaaactttgatggatattctttcattaattttgcaattaatgtccctttaccaacaccagaaggcccgctaatcacaattggcttttggccctcaccaattactcccttgctccatgcaacaacaactgtgcccttaattttgctctgctgcttaacaaaaggagtgtctacctaaaataaacaaagcagaagaaaccatgccatctcagtaaggtgaatattggaaaagcaaaagaaaaggagataagtatactgatcaagtgcactgagaatacaatatactcctaggcctctagacagaaagcacacagaaaacatgaaacacaaatagaccccttgtgctggcatctagtgaaagagaaaccatgctttcaggtcaatgcagaaaatatgaaacacaaaaagacccctgagctagcatcttgtgaacgaaaaatatacactttcagattaacaaactggcataatgcaccacaccagcagattaacataataatgttatgacatgaataaaagaatagacttctagcttacaagtaatacaagagacggaagtagcattattatataccatatattatataactatagaacaatcaatatgcatgagagtctacaggaacagcaagaaaattattttcttgttaagtttgtatgaaaggaaaccataagagtatgcagtttccttggtgctaactaaaaactaattactttccgtaaattaaaagagaacagaagtaaagaaaagaagagcgcttgcatcaattttccagctttacctcaaggaaccagatagaatcattcaagggaacacccttctcaataatcagtatcttctcattgtttacgagaaccgctgagtgtgagctggttggatttggaggtgccccaagtactgtaggtacaaccctgcataaacacaatgggagtgactaactaccaaaatgaaagcacagtaaatagagatcgcaaaccaaaatgacagaacacgtaccaagtctgagttagtttgtccaaaattttgatggtaatcgatgacttggggtcatctgatctgctgataacatactgcaaaaagcaagaacatgctgttacaatataaatttagagtactccctagtaagattaacaccgattgacaatacacaggggagtatgctttacttacgttaaatactgtcaatagtactagctggtccaactaagaatgagcaaagacagatataaacttgacttgatattaggaacattatcagtcatgttcaaaagaaaaggcaacactatcagcatagttaattttaatgaatagtggcgctatttatcagtggtgacagattgctacgaacacgttttcttaaactcaagcaacataacacaaagtgacagcacacagcctagcatctcaaacaaggaggacaaccatcatgggtatgtaaaatcaaaccaaagttacagtacataaatgaacctattaattcaacttaccgtcttatcgcctatatctatggcattctgcaggcagtccttggattccaaggcgacgctctcgacacgaaactccggagcctcttcaccctgtggccaaatcaaaaccagagcaagttaagcatgcgggtccccttaacaaactcttcttggcatccacacataataagcagcacattggcaagcccctgaaatatccaccacagctaaactcaccataaaatgcgccgtgatcagggcagacgcgcctccaatcctatatacagaaataaaacaaccgaccaatta

SEQ ID NO: 12395 - DNA, 2212 bp, Oryza sativa
cgccgcggcggctttatacgactttttcttctcttctctctctctttttttttcttttttttttgtgggcttttttttattttgttttttttaattacggattcggtggatctggtcgtcgtttgtaaaagggaggggggaggatgcggaattgccgactccactccaaaagcggctttttccctgtttgcacatcactccaaacctaaaacgtaaaacgtaaagtggcttttctttatggaataaatagttgacctatctcgtttattatgggtatttagaaaaatttgtaaaggttggcttgtgttgttattagtgttactggtatagttttcggtgattctttaaagtcatttgattgtaaattttatcagaaaatgcttctaacaaaaggtaaaaaatcgagcgttgcacttaatgccctcgctccacttgctcctcgaggcaagtgatgtaggtgtggtagagccactactagatctcatgcttctctagcatagtgaggttcttgttacgtgaccgagacgctctggaaaggtgctcgtaggagaggggatgccgagaaagggcctatctaccagtatgagttttggataaggatgggtcctattaggtgatggagagaccagagcaggagactatgatggtgacaggtggccgtcgtgaagggtaagcagagctcgaggatcagtacctggaggaggcggtggggtgggatccacatggatttaaaggtggacacaattcatctttgatcgactggaacaacttgactgctaattttattttgtcggattagacgcacaatgttagtcacgcctactttgttcgatagctaagctattatagatcgagtcatatatgtttatgagtgccaattggtctatttcatgagtttttcttatatataatataaaaagattgaaacctgaatacaaattacatcatgatgatgaaagtgccaaggctaaaaattaccctaattaaataggtagtgatgtgacaaaacaagtgttgaagatgtatgtgtatgtgtcatgtgtgagggtgtgtttagttcacgctaaaattgaaattgaaacaatatgacgaaaatgttggaagtttgtgtgtagaaaagttttgatgtgatggaaaagttgaaagtttgaagaaaaagttgggaactaaatcaaggttgagtgacttgcaagatatgtttacctcgctagcacaacttcctcacacatctacacctaactgacgaacaaaaagattttacaaaattccatgccacacatgcatatggctggaaccacacacttacagctcaacccaactaaacaattcgaagatggtgatttctttttctatcacattaaaagttcggacaaatactagtgtgttgtttggaagtattgtatcatggtcacacatcatagtgtaaagtagacttctactccacaacgtagaatgatcattcgaaagagaaaagggaaatgatttggtcaatgaagatgacgtagaggcaaatcttgagtcgtttctccgaaggtgccacacaactacacaagactaattagttaattaggcatcaatgaagatgtcttaatcatcttctctaacatgtagttacgtgtgcatacgtacgaaggtatgatgacactttccttcttttcttaaaaaaaataaaaacgagccacgtaagagattgcgtgattttatatgatatagcaggaaaaaaaatcataagaccatatccctggtctttcagagtgggcagccaaatggaagaaaacaaaacatgattatttgggaataaaaacgtaacaatgatggagttgttctagattaattggatcgtacaaaacaaaagaacaaaaaaaaacccaccaatcactggtggagaaaccatctttgatcggtcggccaaatttcacaatagtcccggttctaataaaaaccgggactaaaaagcatctttagacccggttggtgttaccaaccgagactaaagttcatttttagtcccggttcaagaagttgaggggttcaagacagatcccgattatttttactctcggttggtataaacaaccaggactaaaaacagatctttagtcccggttatttataccaaacaggagtaaagagtaccccgaaccgcgcgccagatattatccgcgcgccacaaaaataattgtttataccaattatttttactcccggttgg

SEQ ID NO: 12396 - DNA, 4825 bp, Oryza sativa
aaccgggagtaaagagtaccccgaaccgcgcgccactcatttattatccacgcactcctctcgatctcctcccctctcattactccttctccatcccttcctctcccccttcatccccttcctctcccctttcccctcccgttcctccccttcccctctttgagcggcggccgagcgggagtagcggcgcccggcgggagcggcggcggccggccgtctgggtgcggcagaagggcgggcgggcgcggcagctggccgggcgagctcgcgcggaggccgcaaggacggtggccgggaggccggcagcgccctcctctctgctaccgattttttttgaatttttgattcattggatttgatctgtgatgtatgtgatattggatctaatctgggaattgtgatgtatttcttttaggatttgtgatgtattttttgtttgagattttgtgatgtgatgtattgtgatttgtgatgcatttctttccaatatgtgatgtatttctttccagatctgtgatgctactttgatttggggatgatttgggaatatgatcggggatatttagggagcagatcgatttgagaaaaaaaaaataaccgggactgctcgtaccaactgggactaaagatagatttttagtcccggttattttacccaggactaaagatgggtatctttagtcccggattcgtagtcccggttgtataaccgggactataggggggttttcaaccgggagtaaagcccctttcttcatcagtgaataatatataagcaccgtagaagtgttggtccattggaatttctttgaactttgagggaataaatgatcagttgcaatgtggagccacaggttcattgcatgaaggcaatatatagattcattgattctgatgtcggcatcaatttttttctgtttctgctacatgtaacactcatggaagcaaggccaacctttaccaacatttgtctctggccaagaaattgcctcttagattctcaagtattttttttttaaaaaaaactgaacagtttgataggcatgagtgatgaagaaggcaaagaaagtgacctacaaggcaactgcaaccactacatatataactgatagtgacatctatttaattatatagtatacttttgtaaatagctttgattttatttttccaagccaatatatgtaactaacttatttctagaaacagacattcatggaattccaaggtttattttttgcaaggctggaatgtatgctcatggttgtctgcatcgcaacaatattcatttggcaataaggttacattgttacgaataacggttattatgcatgtttatttttgaagataaaatgcctcttcgatttgtatgaaaaatatagtagttttagaggatttcaatcctatgaaaaagtttcctgtaaaagccttaacaaaggattgaatcatatcctatcctttaatattcttatagaatgggtaattatagattgtagagaaaagttggcaagaggtccaacctattgaaaaaatttctttggatacatctctctcatccgattcatatgtttttcctgtggtccaatcaaatggtcacttatgtgtttttttactatgttttgtaattctctattttacactagtattcatgttggaattacatggtttagagaaacgcttggggtcttccggctagctccacaaggtggtgggctagacgatctgggttcgaagtctcaccctttctaattatttgatattaggttcttttctaatattcgtgtcttttataattacttggtttcccttttctcgtgcaatatgtttgatacgggacaatttccagttgccaactagtccatattctctgctagccagagccgtgctgcatcaaaaatctgatctgatcagagagaatttggttcaaattcaagttcattgcagccactcttaatgcatacccagattccattccagtcaacatttattgcataaaaagattcacctatcactttgccatatatgtatgtatgtgtgtgtatatatatatataggtaaattattgctacatggagtatgggctccaagattcaaattgtatatacccaatttgaatgagtatgaaatttttttaaatgtttatatatgaacattaacttctttactaacaagttcaaataagtttaaactgagtttgaacatttttttgttagattttggttctaggtatataacactcaaacatataattcgttaggtatgtaataatgaattgtgaaataaagttgagtttgagttgtttcgttgttaggtatatgtatgaattaaattcatatacctaggtatatactcacaatttgaaaatttttcaaaatttgagagaatttgtgtgttttataccttggagcccgggcaacatggagtcccatatggatatcatatatatatatatgtatatatatatatatgtatatatatatatatatatatatatatatatatattcttgtctaattacttatttcagagctcaggatactattttagcctaggaaattattttcctaaggatttgtttggttaattcctcctcataggaatggaagtctatgcggagagacgtgaaatcaaacgtcccttcccctaaaaataaattccttcctgtaggaatttactgaacaagccctaagggatgcccatgaaagaattatccatgagtcatatcaaataactcacattgtattaactatataaccaggttaaattattatctagtgtaaatgttactccctccgtcccgtcccaaaatataagcatttttagcatagtgtgaaatcaaacatttttaacattaactattagtagaaaaaaaattaaaaagaacaataatgtaaaattaatgttactagatttatcattaaacaaactatcataatatacaactcttttttatttaaaacatcttactttcatagattttgttggtcaaaatagtatctcaaagaccatgtcgaagtctaaaatgcttatattttgggacaaatggagtactaattaaacaagacccacgagactatgatgcatatgctagctagttgatcataggaacaaattagcacacatctgtgaaagatatgggtaccggggtactgatacatgggtaccggggtactgatacagcctacatatccaactacagataggccatgggggctacatccatgtaataaaacatagagtagcactcagttgccatgttgtcttatgttgcgaggcagggtatagagtctcggctgaatactactttatatagattaggaaacagaagccgtatctggttaggtttctcttctcgcaatcctgcttcccaacctatataaggtgagcatgaagccccctcaagggaaccagattgaccagacaaaagatccatgaggacaacacaaccaagatcaccatgatcaatcaatatagctgatccaatccaccaaacaagagtttgatgttatctctcatcaaggaggcttgaaacatgtctaaactcttgtctacttgcatccatccactttaggtctcatatgctaccccctttattatcgttgataaatacatcgatagctggtgcagcaggtaggggtgacgctgagtttcccgtcgagaagtgcgattgaatcaatcttaggaatcgttggattcatcttcgccccaaggcaaaccttcgctttggaagtttcgtcttctttaacgatgactttggaaatcactcctctccgactcggattcaaaccagtctggaaggctcagaccactttgatctcatttggtctcccaaacaccgcgaaggcctgttccaagcttgttctctccgacacaggctcaatctcgtcagggagatcaaccttggcgagtttgatgattaaatctccgatgtcgctgcgtttttttcccttccaatttatcattgtttattagattgatttctaatcatggatgaatctattggtgttttttttattgttcatatataattccacggcactactgatgtgagtgctagcgattgtcgactcgtggtgtcactatgtagtcaaccggccatggggtcttccctggcatgcgtactctgtttgacctcgctttcacggctgctcgactccgccgctactgatggacaacctcgtattcaccgctggcttccttcactaccacagaccgctaacctcacaccttcacggttggcctactaaatcaccattgatgggcgacctcgtcttcaccgctggctgcctccacagccgtcaattggtaacctcaccttcacggttggcctactacgccgccattgacgggtgacctcatcttcaccattagccacctcctgccgtcaacgggtgatatcgcttccatggctgaccagcttcgctgttgctgatagacgaccttgttttcaccgccggttgtgtccactgtcgtcgaccggtgaccttgccttcacagttgtcctattaccccaatgctgatgggcaacctcatcttcaccgccggttgactctgtcgtcgccgacttgtgacctcgccttcacggctggccaactttgccgctgctgatgggcgacctcatcatcatcgcctattgatgcctcgcccctacgccggttgacttcgctacacactgatgggcaactttgtctttaccattggccgccttcgctacctccactttgccgaccctggcatctcctagaattccgacatccctacatgcgccgccagacacgatgccgtactaatctactacaacaggtggtgccctaatcttttagcttta

SEQ ID NO: 12397 - DNA, 8224 bp, Oryza sativa
ctgcagccctctgctctctatagtttgacttagtatgggtttgagcttaccgagttcgggcctagggaggttggagtcatcaaccaatcaatttagttcgattactaggacggcaactactctcctccacgtgaaacatcattaatcgctacaacaccaagttctactgccaccgatatgaagaaagatgcgatgcatcaatcttcgtaacccgcgcgctagaatcaagaaaattactcgagcttggacatcttctcaatagttcattggactattgtcactgatgtcaccgcaggcacctttcccattggtacaaccttcatctctggccaactattgccaaccatgttctttgcttcgggatgagtgacttcgtcttcaccaccggctgcctgctgccaccaacttgtgacctcgccttcacggttggcctactccacgccgcttatgggagacttcgtctccaccaccaattgactctattgccccactgactggtggctttgcctccacgccggttgactccatcgctccactaatgggtgacctcgccttcgccacacaaggtcaacctcaaccgtgacagaaggacaagcgacatgctctggggctcaccagctcaaacatgaggatcacacattcaatcttgacttgttctagatacgtgcaatagtaattcatacccatgagcctatttcctatgcttaaggtatggaccagtcattacaccccacgagggccaccgactgagtacttgtgccagttgagactcagataccacctttatttcactatgccccatgagagataaagataaaccattcggatcagaagacactcagatgagatgcacttggtccatatcaccgaagagatatgtcattcgagagctgacgaaaggagcgatacacgtgtcattttatcttgattttatcgggcatggtgggcctagaggctagtgtgttcgtgacccaataactaccatgcattgtgaattaagcatgtcctactattcattaggtggtgttgttccaacaacccacgtgctatttaccgctttttataaaactcagatgttgattggaaaagacccgattatataatcaatatatcactcgagtcatgttactctagtattcacatcgtatatactgcatcaaggtttaagccactcggctagcgggggtattacatagtcgggagctacaccttttaggttcatctattcgatgcacttgtttattcatttatcgacggagccctccacagtctctttgcaagatatcaaaaaagagaactcaagaaagaagcacttaagaagccttcatagcaaatatgcagtactcagtattggtcataaaccatggaaaaactacaattcgactgtgaaggtctcggggacaaccgtagaagatatgggtactaggtacccacacagcctgtatatccgactacagataagaagtgaactgcatccatgtaataagatatagaataggactcaatcgtcatgctaccttatgccataaggcagggtatagaatcccatctgaatactaccttatatagattaggaaactgaagacttgtctggctaggttttcctctttgtaaccctagcctccaacttaaataaggtgggcagggagccccctcaggggttgaccagacaaaagatccatgagatcaacacaaccaagatcaccatgatcaatacaatccgaaatatccaatccatcaaacataaataaagtattatctctcattgagggggttaatttgaacgtgtctaaactctcgtgtgctacccctttattctccacaacatcgatctttctccacaagcatatatatcgggttaaacatattctccaaagaagaaaataaagccatataatcttatatatatatatatatcttcaggacatattctctacaccatagtgatagactagtttccacactataaaagcacggcaaatatcaccaccatgaactcaaagagccaatagcgccaccaacaaattattgacactacatttgagacaaaaaaaaacacttagacacataattaaccatgtctaccaatgggagcagcgtgatgatcagccctgtggtgcaaggaaagatgcagcagggcgtcatgaacggcatgcaggtaatcacttaaattaaacccggttaatatctagagagaaagattgcatttgacatttcgtatatttgccgtaatttaataaacctaagagattaacgaaccatacatgtttttcttctcaaattagaactctaacatcggcaacagcacgagtgtccctgtgtctggctccagcttcaatggcactgccttcctcagtggcaactatgctaatgcacctgcaccggctcggcaggtaaaagaaaatacagagcgaattcgttcatttgggccaataattttccataaattactgctgtttgtttcatttttaaccgattattaactaattaagtagtgatgttatttcattcaggttccaagtttttctattactggcataggagggaacgcaaccttctaagcagctagcctcagatggcaaaaggaccagcatgcataattaagcttgaacgaacgaatgaattatgtgtgctgcaaccaaataaaaaaccgcttaatagcgtgtttgtaatataatcctatatatgtatgattaaataaaatcatgggcctagctgggactaagctaaaaaggcattttaattgatacatatggattaatggattaatggatgtctcagtgtatgactcagaagatataccttgtttacatactccaaatatgttgttatttcgttgttaaatatacaagtcatttcagattgtgcggatgaataagttgtactagctaacttttcaatgacctttagttatactaaacgaatgtgtgagtgtgaacaatctaagacagattacagaacagataactcctggatataaatgaagtaacttcaaacaaaccatactgtccatacataaaggaaaaggcactaaaaatatgaaataactaggggagaggtgacatttcggataacatattttatttgactgtaagtcgataaagaaaaactacaatgattatacttgttttcttcccataacaaccacaaactgatcagcctttgtattctaaggagaaaagttaaaaaaaaaactcatcaaacaaatacttaagagcctcactatggtgctctctactggtagtagaaaccattgatttcatttcattgatttcatttgatcaaagggtttagatctatttatactactaccctaattagcggtaatagaaatgtggaggggcattattataaaaaaaataggtgcagagggtataatcgtcaagcagtgactataccttttttttcctttttttttggattttttgatgatatatgagcgatgctaacgcaatgaatgatcatatatcaatttagtcgggaaagaacataaataacaaagtaactcctcattattgtaataataaattattaatttaccgctaataatactggtagtataatacgaccagtagagaactctggagcatcgctcaatacttaacgtatgaaacacatgttgcaacaaaggtcgacagaagtgccttttaagtggattataaaaatcatgtcaccattatcatatttcacttccttaggaagataactgagagaggtagacaatttttaaagtatttttctattatctctaagtataggtagtataaattaaactaggaaatatagtaactttcttgaaaaaaaatagtactactacctccgagtacctactcaaaaataccgtgaaattacaaattttcagaagaaaaaattcaatacatagctcataaaacaatgcggtacaagaaaaaaaagcacaaaaaatttccgttttcgactagaagcacatatgccactgatttttcttcgattccgtcgtggttgcagttatgtagtcgagtgtttagccatgagttgacacttacaaataccaatttgcccttgttctatccctatagcatagggaacttggttggctgctctagctccttttcttaattattagttcggtcgtgcttgcaagttgcgaggtgatctccgaaagaaagggtgatgacggcggctgcttctaagagcaagtttaatagtcaatgtaatagccaattcatataatagttgcttactataatattaataccttgtctcacatatcatacacacattatatcttggagtctgtgctacagttggctacagatctatcgctagctgctcttatctctccctttatctatttaaaatatgtttatatagctagattatatcctgctattgtatctgctctgaggcgtcacgcgccgatcgaggaaaagggcgacgatggtggctgcttgcgaggcgccgcggggtggggcgacgacgggtcgacgacgtccgacagtggcgcgcggccgacggcggtggcctccgtctcgaacgtacggcggcggcgacgccacccggagacgaaggacaaattagtgcgagcataaatttatctactctgatctaaacgacgtctagcgttcgtttgctcaaaataggaatggtgtgttaggtatcgaaggaaaatcgatggctggtgtttctagtcgaaagcgaaaactttttatgctattttttggtactaggttattttttatgttatggatcaatttttctttttccacaaagttgcggtagaaattaacttatagaacatcaatgcaagagtctgatggtaattcaaaattagaatgctaaatttattaccgtgagactcttgcataagtcttaagtcttatgcaagacttaagaagagatacaagaaattttaagacttaagttataataagtgtttagaaggattaagtgtgtccactatgtatgaatggcaattgcctagtattgtgctatagaaactaataagttattattataatctagtgtgcatgttactaaacgagatccacaaataattaagacttcaaggtacgtgtacgctagctgatcctaggaacaaatgcacacaccattcactacaagcatatatatcaagatcaacatattcgatctcccaagaagaaaaaatgaaagtcatatatgcaatcttatccaggacaaattctctccacagtaacgatagatgagtttttcgcactataaaagcacacacaaatattaccaccgtgaactcagagagccaagagcgccaccaccaaattaacacacctacaaacactcatacaaaaaaaaaaacactttaaacacataattaaccatgtctcgcaacgggagcagtgttatgatcagtcctgtggtgcaaggcaagttccagcagggcatcatgaacggcatgcaggtaatcaattgattaaacatggtaaataactagagtatatatatcagtgaatttgatagtaatttaattaatccaaggttaatggagcatatttttcttcttaattttgttaatgttagaaccgtgacattggcaacagtacaagtgtccctgtgtctggctccagcttcaatggcacttccttcctcagtggtaactccgtaaatgcaccaccagctccagaggtaaaaataaaatacatatcattttcattcatttaggccaataatttttccataacttacttatgttcgttttattttatttgaggatattaattaattaagtatcgcaattattttattcaggttccaagttactctattacaggcatcggaggagatgcgaccttttaagtgctggcatacaacgccaggagggctacaccaaaataaaaccgcttaacagcgtgttgtaataatcctatatccatgagattgaataaatcatgggcctagctggtagtaagcttaaatggcctgctaatcttctatcttctatctatctatcttctatctatctattatctattatatatactaaaagtccattaaactttctataaacgctctcaagccgccacgtgagactcctaccaacgctcctaggccgccacgtggctctatctaatctaaccgttgattttcacttaaattggtggacccaatattttagaccattagattatattttcacttaaatcggtggacccgatattttaggccattagattagatgtattttattttaaagaaactaatttcttactataattcgtacgtatacaggagaaacatcatacgtacgtacaacgagggaaccaatgaagcttaccaattgttggcgtcagaagaaaaaaaaaactacgcacaaaattactataaaatcaataagaaaaaaaaacatacgtagttagtaccatgcgaaaaaattgatgatatttaaaataggattttctattatttaaagatataaaacattttactctataaatttacgtaaatatcaccattgattttcatttaaattggcagaccctatcgatgttttagaatactagattagatgtacccattataaactaaaagttcattaaactttttaaaaataatcctccatatgacatcctacaaacgttcctaagttggcacgtgatgctctaataaattagtgaattttttaaaatttctaaaacaatttggtgaacacattatttacaaccattagattaattttcaagaaaacatttctctcctatacccaggcccacctaagcctgtatgtataagttaatttttttagaaaaaaaacaagcagacgtatgtacgcctcctcttccttcaattcatatctccacacttttacctattccttctccttttttcatgctttattagttagataagtaataattttgtgttaaacaattaatcttctaaatcatacaactaatgatccacgtaaatctctagattatttataactaaatttatggttgaagaccatatttcactattatttagcttaaaaaaaatatcattttggtttatattttctgacttttgcgtaccattcaagcaactaaaaaaatatataataataataatacagattttttcatcatacataacttcgtaataattaaaataggtcgacaatcgtaaaagaaaaatgaatatattatgagtaatatctccaaagtatgttagttaggtagtaaaacttatgtaaaaaataagcaactataacatctaaatcaaacaactagtatttgatcaacttatgtctttagattgttttacatttaaagacccatatccactgtaatatcaactttgagaagaaatatgtcactttggggctatattttctaatttttgtgtgcttttcgaacaattataaaattatagaaagataattacatagaatttatcaccatatatgacttcggaataattaaatttgatctatatggaaaaaagtatgttttaaaaactactcccccagtataacattagaataagtcaaaaaaacattattacaatataacattattagattgtagtgttcgtatttttaatatctactgtgaatatactggaaaagacaagcaaaaaagatatattttaatcaatcaatagaaactaagacactacaaccccgtaaaaggaaatattacaattatatgcacgcgtaatctcttcccttaaactctctcttcctctcatctctcatttaattcctttatctcctaatttttaactaagtaaaaaaagatcaataattagaaagctaaatgattataattattaagttcaataataattttcacttatttgaatttttgttttatttataattaaatagataatttaaaatccatgttacccatatttcactctataaaaatgaaaatacatcatttaacatagacaccgttcctttgcatcgtagccaaatagaaaaaagacaacataatacaaaatgaaaataagtattatattaccataaatcattgtacatcctctgagcgcacttaagacgtcacgtgttacgccttaaataaaaataaaactttacgaattggaagaaaaaccatctgaccatcagtttccactcaaataggtagatccatcagatatacttttaggaaaatcttaagccgccatgtgttacgtcttaatcattagataaaatagaaaaaaccacccctccacttcaccctcccctacacatactcacaacacgacactactcgtcccatcc

SEQ ID NO: 12398 - DNA, 9688 bp, Oryza sativa
  unsure (1)..(9688): unsure at all n locations
cctttgggacaaatgattgggtctttggaattcctttgaaattcctattggaatggcatgtttcatgggaatcgtggaggactcctagcatgagctccaagctcttggaatttttttctcaatgtctacctctctcttctgaatcctatgtttttcctatgctccatccaaagcggttttattgtgtagttttctcatgtttttcattccttagctacgatgacatttaaatcctgcattttcctattcccgtgtttagagaatcctatgtttcaaaggagccctaaattgaatttcaaatattctaaaccttaggaatttttcctacatgtgttgttaggaacaaaggatttgagcatgcaaaattcctatggattgctatccaatgcaccaattccataggaaattttaccgtgagttcatcattcttaaatccgtgtcattcaactgtgcatatgaattaattgtagcttaatgacttttcaataactttcatttataggagaggggggggggttgatgtactacatactattcaaatgtgtgaagctctacattgattagtgtaaacaatccgagataaatttcataaccctaacaactaatggcccctttgaatcaaatgattgagaaaatggaggaatataaaaaacatagaattctgattgaattctactgcaaaacagaggaatgttaaatgcagaaaaaaatacaggaatgattatttgattgagacacaggaaaaacttaggaattaaatgagaaagataggctcataggaaactttctatgagggtagatctcatgttaaaaatcctccaaaacttgtatggattgaggcatttcttaggaatttcataggattcaataatttttaatcctttgttacaaacggctatataggaaaaaattaaataggatcagaatcctacaaaatttctatgtttttcctttaaagcgaaggccctaactcttgtatatatatgtaaacaaagagacttcaaacacaccatacatttaggaaaaggcagttagtcctaaaactatatatatatagactacgggagatttgacagtgaaataacatacatatattttatttgacttaagtcagtcaaaataaagtagaaacagtaatatcttttccatagcaacttaggccctgtttgtttcagcttaagattattgtaatctaaattattaagccagattaatataagctggattataaaaagccgacatagaataagttgttaactgtttgtttctctagattattagttgtatgttagccgttagccacccaatattctagaaaatgcacctttacagtggattaccagattatattaatctgacttatagattgtaataatttagcataataagctatctgtttgtttcagcttactcataataatccagattataataattctaagctgaatcaaataggtccttaaaaggtgagcacaacacaccataaaatatatctcgatagcgtattatttcatattttaaatgtccacatatctttctacaaacttaatcaaagttttgaaaaaaaaacatgacttatttctataaatttagacaaagtttagaaatttggcttatgacaaaaattaaaacaccttagaatatagaacggaagggtgtacatgttgctaaatgagaccggtaagacttcgacagttacactatagctaatcacgcacaccattcactacaagcatatatatatatatatatatatatatatatatatatatccggttcaacatattctcccaataagaatataagccatataaccctatccaggacaaattctctagtacaaacgtagtataatagatgagttttcaacgctatatataaaagcacggccaatatcacacaaccatgaactaaaagaacctagagtgggaacaaaattgacgcgtaattaaccatgtctggcaacgtgagtatcgtgatgatgcacaacgttgcaaggccaataccagcagcgcgtcatcgatcatgagagacatgcagataatcaatcaatgaaaaccctggtaaatatatatctagaggggggagaaagacagatagaatttaacacgtgtatctgtagtactaatttaattaatctataaaatccgcattagtcagattgtccctaactccttatatgtccgtcacatgcttccacagcactttcttgttcagtggcaactctgtcaatactccaatatacaccactggctcgggaggtaaaagaaatacatttatttaggcctcaagttactgctgtttgttgttttattttattttaaccgaagttattaataaccaatgcaactagtgtccaaacgtttcattgaaagctatgtcctctcccttgctgagattaagcaacacccccaagcaagtcctgagaaggggaaacatgttgtggatgtggttcaaaagaagtcgcacagcatcaaacggagtcgagaacctgttcctgacaaatggtcgaagccactcccaggaagcatgaaactgaatgttgatggctcattccaggagagtgacggcaagggtggtataggcgctgtgttgcgcaattgcacaggagaggttatttttgctgcttgtggacatgttgatcgctgtagcagtgctttggaaacggaactccttgcctgcagggatggtcttgccctcgccctacaatggaccctgctaccaatagtgattgagacagactgcttggcgatgatccatcttttccgcgatgcaacaggtgctaaatcggagctggcgtttttagtcagggagatagattctctcttggtgggaaatagggatattagcttcagtaagtgtcttagaagtcaaaatcatattagccactatttagcaaataagggccgttgtgacaagatcacacagttttggccggacaataagtgtacttttatctcgcagtttatctgtgaggaggctaatgagtaattatccctttcccctgaaaaaaaaaactactccctccgttacataatataaatgattttggatggatgtgaactaggatctataatattatatttataggacagagagagtaatcaagtactgctattattacatttaggttcgaagttactattctatatataactggcaacggaggaaacgagctgtcaaatgcagaatgatgaatgagcttagacagacgaacgaattgatgaactattagtggctacacccaaataaaatcgctaaacagcatgtttgtaataatcatgtatgcctgtaattgaataaaatcacaggcctgttgattaattgattcattatggattaatggacgcctaagtgtatgactctaaagaaatatattcatcgcatatatacttgaaggtcccgttcttttttttaacaagagttagatgaagattatgattttttggcacgctttttaaattgctaaacggtgcatttcgtgcgaaaactttctatataaaagttgctctaaaatatcatattaatctatttttcaagtttgtaataattaaaactcaatcaatcatacgttaataccacctcgttttgcgtaaaaaaaacttaatcttcatctttagaagaaaagaacaccacccaaatacacacacaggcaaaagtgcccgtgcgttgcaccgggtgattacaaagtgtacagtgaacaaaaagtgttgtttggtttagacatctaatctggtaaaaaattgtttgtttttagataaataatctgctttatatttgcggaatatacattatgtttagtttggatgatttgtagcatgggagaaaatggatggatgaacaatgcacgtgcagaaaaaatagattatttatttggagttagtacattttttttaagaaaaaattcatgtgcgttgcaacgggaaagatttaaaagaacaaatgaaatttggaattaaaaatataaagaatattgaaagatgggtttagagttcatatagaaataatatttagaaataatagaaaggaattaaaaatataaggaatattgaaagatgggtttagagttcatatagaaataatatttagaaataatagaaattataatttacattggatgagaagtctagaatattctcaaaagaaggtagagtgcatataggaatacaatttagaaaaagaattgaaattcgaaataaaaaagaatattttttgaaaataaacagtcataaacaattaaaatggtattaatgctatttctgaaaattacaaaaatacttaaaatcaataagagagaaaacttatttaagctcggcccaatagagcggccttctgtgcttcgcacgtgcggtcggcccataggatggcccaaaagcacggcggcctaaaacgtcgcccggcctgacgtgggagaagcatggaccgtccgatctgatggatagtctcgattagtcctgacctagataaataccatactctctcgtaaagcaacggtggcggcggcgactattccaacgggcgacgacggcagcggccttccccaccgagcagcgacgacgacatccttctcccccgcaagcgggcagcggtgccctgccctcctgcaagtggcggtggtggtggcgccgttccatctccccactgcaggctccttctctcctcgtcaagcggtggccgccgcctcgctcctcgccagatccggcgggtcgacggctctccaatggcgtggcgctcgggatttggctcctccctctccctctcggcatccagcgcaacgatggattggcagcttcttagcagcgcgatggcacagcggatccctagcgcagcgtcggtcatcggttcagaatctagccccccgagtttgcgacctccactgcagcgaggtggcgagaatcagcacgcgacggcctcatcttgtgttaatatttttttatgttctttgatttcgatttatatttggactgtaattttgtttttatttgggttgtgatgatttgacttttcaaacaatattttactattcattttattcaattgtgtaaataagcaaaagcataagtcatactaaaaatatctttaatgataaaatcctaataattgagctgagtcagccgagcgggtggggcccacgcgagtagataaggatcgatctcgatccatccagtcgccgccccctccccatctctcccagccctccgcccctcagccccctctccccacttccctcctgctccgtccccctctctgagccggccggccggcaacttccctccccctccaccccctctcctagtcggccggccgtttccctccggcgagcagcgacgcatgcggcttctccccttctctcagcttccccacttctccccccactatctctccacttctcccccctctctctctctctgcggcggcggcaagaggggcggcgatgccctcccctccgctagatcggggagaggggaggtgcggcggcggtggcggcggacgtcatggagggggcgggttggacggcgtggaggcggccggctgggcctcgcctccgccagatccagcggcgtggaggcggctgcggcccggcgggggcgggaggggcggcgggccagcggaccggaccttgcctccgccagatccgacggggacgggagaggcggcgtcgtcatctctttctctctctctctctctctctctctgcatggtggggaggtgcggcggcggtggcggcggatgtcatggaggccgcgggtcggacggcgtggaggcggctggccgggcctcgcctccgccagaaccggcggcatggaggcggcggcatggaggcgggaggggcggcggcatggaggcggagatgtcgtctctttctctatctctgtgcatggtaccggtggaggttcatgtgttcttggttgaaagtttgttatgtgtgttattgatggaatgtttcatgtgtgttcttgatgaatttcgactggaatttttcctttggggaggggggcggactaaaaatccccgcatttggttgtgccgattttgggaattgtttcccttgtatccgattgtgagagggattggggattttgggaattgtttcccttgcatccgattgtgagagggattggagggattgggaatcgggggctgcgggcgaaggtgcaccgcgagggacgaaggcgcccttcgtccgacttgtgacgaccggaaaaatccgaatagttatattatatatatatatatatatatttcatcttcaatgatataggatattaagctctaattgtagccaagttacttttcaataaccttcatttttactacttggatatggattgatggttttcgttggattaaagcctcccacgacctccattttaccgaaataacatgttatggagagatttttgaaagttacatacaagttacactatagttacagtgtaattacatgcaagttacagtgtaattacactacgattgtactgtaattacatctgtcaaatttttggggaaaaatttgtcgacaaatatatagcaaaatcgttttctctttaccaaatcgttttcggaggagtttgaaccagttcgcacaaaaaatcatacatttgtgtgttcgaaaggagccctattcttggatgaaatattttattaagtaaatttcagaaatctaaatgtactttgatcaaattattagaaagctaccgatttaacactaaatctatcatacaactacatatttaaggtgaaataccacaaaactatatatttagtaacaaaattatcacaaaattaaaggtttatcgataaattaataaaaaaattgaacaattataagtccaacataacattagtgctaaggatttaaaccgcaaaatctatagatttgtgataattttattattaaatcagtagttttgtgataattagccttaaacttgtagttttgtgataaatttattattaaatttatagttatgtgatacatcactttaaatatatagttttgtgataatttgatccaagtatccgtaattttgtgaaatttactctattttatttcttccctagaagaatccattggcttgtttagccgaaatgctaatggttaaacgtttgagggtagcgaatgttccctccaatctagatatgttgtacgcgatgacgatgacatgtttccccttggccaaacgagtttttcccctttgtccctctgccaattgaaaatagggatctatattgtcaaaaactcgctgtctgtataaaaacacgattcatagcttattcgccatttgttagtacaaaataaattaactaataaaattgttacaagcggaaaaaaaaccttcttgccctagcccacttgcatctctaaattaaacccgttgcaacgcacaagcgtctcactagtgcttgtaaaaattgaagcgattgtacacacatcatgcggagaaagatgcacgagggaaccgaagggtgataaggtttgtgtttggatggtgcccttgtctgaatgctctagctgaggctagaaattaaacggctgagaacgatgcctaaggtggtgtttggatccagggacttaactttagtccctctatttagacactaatttagattattaaatatagactacttacaaaactaattacataaatgaaagctaattcgcgtgacaaattttttaagcctaattaatccataattagagaatgtttactgtagcatcacataggctaatcatggattaattaggctcaatagattcgtctcgcgaattagtccaagatttaatagtctacgtttaatatttataattaattttcaaacatccgatgtgatagggacttaaaagttttagtcccatctaaacagggtctaaattaagcgagattctcagagcatatgatccaaagaggtgctgaatctttgacatttaagaaactgtgtgtattacagctagtgcaaaacaataattgagttgaatttcaatatttcatctataattttttttcaaatttctggtttgttttttatttgacatgattagaatcattaattttgacaataatatatataattagtgtacagatggctacttttccatgtgtttccattaacaggtcttagcagcttggcccctgatagattttattgaatcacacacatataggattacatatacacgccattaagcggtttttatttgggtatattatatagtacatgtaatcgattcattcgtttgtaatttgttctttgaagctcttgtcggtattctcttgccctcgctgggttaaaaggttgcgtttcctcttatgccagtaatggaataagttggcatctgcatgtaataacatcagtaatcttttgttaataacctcgattaaaattaaaaagaaatacagtctatctccgttttttaatatatgacgccgtgttgactttttaacaaacgtttaaccattcgtctaattcaaaatttttgtgcaaatataaaaaaagtttaagtcatacttaaagaacatttgacgataaatcaagttataataaaataaataataattactaagatgaatgatcaaacatattttaaaagataaacggcgtcatatattaagaaatggagggagtagtaattaacttgcagaaaaattattggcctaagtaaaaggtatatggaccttttttctttacctgcggcggcgttggcgcattaacagagttgccactgagaaatgaggtcccattgaagcatgagccactcacagggacactggtactgttgcctatgttgtggttctagcaaacatagttgaggaggacacatcatgatccactaatatcatatattaatttaactacgtactgtaagtatatatgccaaatactttctnntctcgtaataagagattttagagggatgtaatatattatagtccaatctggatgggctctccatccagatttagagcccctttgaatcgtaggaatgaaaaaacagaggaataggaaaaacacaggattctggtaggaatacaattgtaaaacagaggattgcaaaacacaggaaaaacacagaaatggccatttgattggaccacagaaaaaacacaggaatcagatgagagagatacatggcagaggatatgttccaagaggttagacctcttgctaactttcctccaaaatgtgcataggattacccattccttaggaattttgaaggattggataggattcaatcctttatttcaaaggccttcataggatttttttccataggattgaaatccaccaaaattcctacatttttttctacaaatcaaaggggcccttataatattaggatgtgtcacattctttcaaaaccctttattttatgtgacagagggagtagtattagtcatatatgcaacatttaatatatatgttgattacctgcatgttgttcatgatgtccgtctgctccttgccttgcaccactgggctgatcatcacactgctcccattgtaagacatggttaattatgtgtcaagtgttctcttttggtctcttctatctgtagtgtttaatttgcaggtgtggcactcttggttctttgagtttacagtggtaacattggccatgcttttatagtgtggaaaaaaaaagcatatatcatagtggtggtagagaatttatcctggatac

SEQ ID NO: 12399 - DNA, 2023 bp, Oryza sativa
atagaaatctagtatggtctctatattttagaacgaagtagtatttagaaattaatggaggtagcattatagaagtcacttcttgtgtatccaacagttagctgtcagtgtcatgtaatttgtcttggaatgtttacagtaaagagcaaaggaggagctgctgcaatgggaggagctgttttgaccatggctcgtaggcctgattctatggccattcttgctcttatagttgcagttaccatcgcgataactatcgtcgtgcgcctatatgttcctctgcaagcaacatgatcttcagatgaacccacggtaagttcgcaaaacgcaacagagttcttctctgatcacttcaaattctaagctgtatgtatggaaaatcgacagagttgaattgtataagacgggaaaaggcctactagtatgagttctactagttcatttcctagcctgaatgccaggtgtatgatgaaatagcaaggcctggtaccaagaggcaaaagaagataagaggttcagattaatagtttttctcctaagtggtagattgctagtctttcttttctgtagggtacgtcactgcttcagtgctgaagaacatcacaaaggttgtgacagggcaaccggcaacaaaactatgttgaaattgtgatgaacaacatggcagtttatcttaattattcttctctcttatcattatatatcacccttgttagtaatctgtagtttatcctctactctggaaatgaatcaataatctaagattagccgattattctacagtttctgtgtttgctgccaaaacagctaacaactgatgaacaagaaaagttattatggttcaaatactcaacagcacctgctttgacaaggcatatactcactgttgtgatgtcttgacatcaacgttgtggcatcttttttcccacctatttgatactgactggatgtcaattaattgttactggacgtcagtgttgtggaatctttattactagtattttcttccatcgtgctagactttgatgaagtgtttttactggatgtcaattcttgacagccaaatgttatcctaagtcctaactaatcttaactctccaagtaaatgcaagaaaacatcaaaacacttacaaatctaactacaatcttccagcctttgttgtgaattgtgatagattctcacaaaaataatttgaacagacgggatcttagaaaaacatatagctcacgacaggaataataacaatggtgtgaaatagacgacacgttccatgagcaaaagctttaaaacatagggaatgttgatctttttgtgggttgtgacttgataatttgcttttgcaaatctcttgccttttactggacgaaagcttgtggtcttttacaatgtcaaacccaatcaaaggtgtaaaataataagagccagcaaatgtaataattcatcatgttcacaatatagataggaattaaaaaaaacatctataaccaagtcactcgcatcataatatatatgccttttttttttgttgaaacaattcattgaagtacatacaccaaaacaataatgaatatgaaacactgctagagcattagagatttgctgcataaaaatgcagaatcagcacccgttcatcctcaatcacaactctaatgaaccttaccaatgtcatgcagcgcattctgggtggcacagactcctaatagctcttgcagcttcaagcagccaaaccagctatcctttttttcttacatggatatgcacatcgagctcttgtataatacattaaatatttaaaaaatataaacttaacatataacttaaaacaagtgatctaacaaatgcagtggagaatatatatttcaatccgtggagtaaataatccatttcaacaatcccaccatgaataatatgaaaactaacagggtcttatatcttcttgcttgaattccaaataacatagtactgctctttatagagagccaactaaacaactccattctaatttcatggaatggaaacaaccaa

SEQ ID NO: 12400 - DNA, 15997 bp, Oryza sativa
  unsure (1)..(15997): unsure at all n locations
aaatcttgtttttttttaatataaccattatttacaatgagatgtcagattacgtaacatagttgacacttgactgcaatggcataaaagaaatcatctcaatataacaattctcttacgtaacgatatagggggaggggaaaaaaggaatgtataactaggagtaagaagttgattgcacgctgatatgctaacgttcataaagagttttttggttttttttaagataatgaataacctggcagctgcatcaaagacgtacataggccatcatgcattactgtgcaccaagcaaagacagaaaaaattaacgttcataaagatacatcatacgagtattaaacgttgagtgggaggcttggtggacctagcattatataatggctagtacatgaaaaaaaaggttgttgattaggggaagaaatcagcttagtacctgagttagttcatcatcatcgattgtattttgagcgctgcttgattaggatagtccttaagtgcctcttcaataacagccttgctgtcatcatcaaaggaataaatggttgcatgccgaagggagtagagattctccaaacctaaatcatttaagccacccctccttagtctggtccaaatagaaagataaagcctttcaaggtggggcatagctcctggttgaaacgatggcatcatggagctataaaactgaaaatcttttaaactccgaaatgcacatgcacctctgtggatagtgagcttttcctgtagttgttccgaaacaaatgctaactgtagcctgagaaagcgaagagatggaagctcagcgaggcgatcaaggtggtcagactggagatattcgaaatccagacaaatggataaggtggtgaggtgggagagcatcaatgaattgatccaacatgggaatgctttcataaacgaatcgggcatgaacaacctttggagaccggaaggaacctgttgcatgtctatgatttcttcaaaactaatattatttctcaaatctaggtcttgcaaattggtgagcctttgtatagacgtttgaatggattcctttaactcaaatgttttttcactaccgaaaacgatcctaagagtccttagctctgtcaaattaccaatctcttttattacctttcgggtagcttctattacaagctcctgtaaagatttcatattccccagcatcagaccttgcgccagcttcactctgccagcatatagccgcaacagtttccttagtttggcaaaagacattggaaacagtaccttatgagatttaaaagaacttggtttacgtgcacctcttatgtccaaggtttcgagagattccagtttcccaatgctttcagggagctcagtggcactatagtgccctagacgcagaaatcttaggaggcgtagcttatcgagatgattaagatggttcttgtccattccactgcagtcctcaagctgcaacacacgcaggacatgaaagctcgacaagggtggtatcgagtcgaccttgccgaagatagtaatggaccttactttggacaattgttctcttgcttctggtgaggcataggatttattgctgttatggagagataatcggcgaatcttcttcttttgtgctgtacatgtatgtttacctgtttgttgaccatctgataaatacgttgtaacaaaatcttcttctactgacagctgatttattagctcaagcaccatgtcatgtactttgcatgcatgcaccttaccatcttcatcccaaaaaacatgcaccttaccatcttcatcccaaaaattgtcctcactcatcggctggatcaagcttcgattgatgagctcgttgaagtagctctctccaatctcctgcaagcttgtccctacaggtcgtgtttcatctgtaataaaaccctcagctaaccaaccccatatcaaaacatcttttctaattagttcatcctcaggatatttgcttagagacaacaagcaagtcttcaaatgaaaaggtagatcgttgtaactgaggcttaatatcttccgcatcttgtccacatcaaggttgttctcaagccccaaactgatagacttattgaccttgtcccattcctctgaattccttggtttgctagcaagtaggcatgctgtagtgatgattgctagcggtacaccaccacatttcttcaaaattttctcagtgacaccacacaaatcagcaggacagtcatcgttagagtcaaatattcgtttgcagaacaattgtctggaatcatcatcagataagggtttcatttcataaacaccactgcctgcatgttctgcaacgaccttgtttcgcgtggttacaattattttgctaccaagtttagcatcttgcacagcaagtttgatagtatcccacgctgattttttccatacatcatcaatcacgcacaagaacctaaagatggtagcatatacacatgttattgaacctagatataaatcatgtgaagcctgtccaaaaaagataggaatatgtatcttgcacattgaatatcgaaaatgatgtgcagctttaaatgtgtaattttccaacaattttgacacaataagtgcagctttgtgaatttctattcacaaagttacaaagatacttaattatgcgtaaatagggcagatttctgaataactatgtgttccattggaaaaccaaaactttatttacaagccagttatattataatagtataaaaacttgagctaggattcccggttatattagaatacaataaaaacttgagccaggactcttattcgtacaacaaaaggtatcttcaaataatgataaaaggtaggtataacatagaaatgtaccttctattgttgaggaagtctctaattttgtcgatgagctgcttcgtttcccatgtttcatctatgtgggaatacattttctcatcaagttggagaagaatgttcttgagaatcttgtttatatcaggattcaaggacaccgaaacaaaacaatagctgtcaaattttgccttaagctcctgaaataatgaattggcaagagttgtctttcctaagcctccgaatccaacaatagaaattatatttgattgttggctggatgagccgtcatattccaagagttgcttagttagctcattttttggcttgctaatgccaatgagttctgtcgcctttcggtacatagcttctaggcgagaatcaacatccacaacagttggcctggcagcattgtcgtcgactatgtacctatcacgacgttcgctgaccttcttgacctggtccatgatgtctttcatgacaccgtggatctgatggttggttttgaacttgttgaacaaattggtgaccttcttgaagctcgtggcaggttcatgccccttgcactttaacatgaaggtgtcgatggcatcctcgatgtcgtaagatagctctctcacctcgctggcccagatcttgacctgctggtcaagttgatccacaggtgtctcagccaccttgtggagtgctgcggtcatacctttcaactctttctcaagttcttcgatctctcccttgacacccttttgcagcttgtattcgccaaccagcagctccccaagcttggggaggagggtgttcattgcccctgtggcgatgttcatcttggcctatctgatgttgaatgcctgcacgggtacacacagatgcacttaaatgagcctcttgagtttattagtatgtatcaggattcaggaatgatcaagcaaccgcaaaaacatggagaaaaacgacatctgaataattaagctgctatgtagcatgtcaaatcgagactagattgaggtaacaaccgtgtgctgcatcacctaatcgatccaagcaaagctcatcaccgtgagcagcgcaagatagcgacctctcaacgctgtacggtatactagtaacaggaaggaccaagcaacgacgcccaaacacacatggagaaaatcagcatctggatcaaccgggccgtaccggaatcggaggtcgatcgggacagtggatgcggtcgcgccgtcgctggctccgctccgctccgccccgcccttgctgcgccgcgaatcgggtccgccgccactcagccacgtcgcccgcgatcgatcgatgccgtggtggaagcggccggcggcgagagtaggggagctcgggtcaacgggtgggagacctggagtcaagcttgctccagccgaagaggatagaataatgagaggataaccaacggactccgcttcagtgacttagctaaggcaagtcacagcgtgacataccatgtatctcggccgtccaaaacgaatccaatggagatggcgcttggtcccgcacgcaggcaaaaaaaaatctccgtttcggcctaacaggaagcccgcacgcgcacaggacgcgcttaacctcgccctcgtccgcgtacaccggcgcagcctgagacggactcaacttcgcctcgccctcaggtccgcgtacgccggcgcttcatctcgccctcgtccggccgccgccgcgagtcagctgggaggcgcgtcgctgcgaccggagaggcaccaggctgccctgccctgccgccgcgaccgggggcgcgtggaggcggccggccgccgggcctgacggcgcggtggtgcaggcgggcagccgcgcagcccgagcccggcgcgtggaggaggccgcgctgctcctgccgcgccacacgtcccgatttcggcggcctcaactccacgatggatttcagcgtccgagcccgcatccagagcccgcaccagtcggccgcccacttcgtcgccggcgagaggtgacaccgccgcccggcttcgtccaaggtaggagtcactggtggttgagtttgtggagaacgacgcaccttttcctgtgcccgcgaggtgtttgtggaaatgacctgccgtctgggatgatgcagagtcctgattgaaagtgaattgttattgtttggctttgtgagattagaagcaaattgattctgtaatctttgattgagattgatttggttgtatgactcatatatgctgtaatttgaatgaatgaatgaataaatcagtaacttctgacgatgttttctaaaaaattttgagatgtttgagatgttgcccaggtccatgatttgttcaggtttaaagtctggaatggacttatagtattgtctggtttatactggacatgagttgtgctgccatttcctccttttcgctatctctgctgtaaatttttagttcatgctaggtgggaggttccatgtcttgttatgatcagttgtcctatgcagcaatgttgctctgaatctctctctctgaagatgctgaatggagtgccgtcgttactgtagtgctatcgtgaaatttcatggtcagtagttcctgtgcatggtcgccctgatcaatagtgggtaggacatctttggagctgtttttatgcgagattcctgcaaaattcctagtacaaattcatgcgttgcaaacaagcccgtatgtctccttcatttcttgatacgatagggatggattgtgttttggttgacaaaatccaaagagagcaattttgtgcatgaaatgagaatgccagaatggggctgttgctttgagcgatctgatatccatcgtggagttgaggccgccgaaatcgggacgtgcggcgccgcaggagcagcacgacctcctccacacgccgggctcgggctgtgggccgcccgcctgcaccaccgctctgtcaggcccggcggctggccgcctccatgcgcccccggtcgcggcggcagggcagggcagcctggcgcctcccccggtcgcggcggcggccggacgagggcgaggtgaagcgccggcgtacgcggactcaagggcgaggctaagcgcgtgcgggcttcctgttaggctgaaatggggattttttttgcctgcgtgcgggtccaagcgctaccttcgttggattcgttttgaacgggcgagatgcatcgtatgtcacgctgtgacttgccttagctaagtcaccgaagctgagtccccaacggaccacggtagttgagggaatgataaaataagacctgtccggggtacggatgcaagcgggtgggcaagcaggcttttttttccctgtttattgcacttttattttatttttttcttctaaattttatactactatgcgatagataaactagcaagcaggtttttatagagtagcgggactacccatttgcatccctagtccgggggaggaggaaaaatcgtcctccccctccctcccctgacgctcacatgtccacatgggccccaccatgtgtaactgtccacctgccacgtgtctcacacacatattccgttgcaacaaatcaccctctattaaggaaattcgttttattttttattccaccaaaaatattttacctagtggactcacaatgtttcactatgtatagatctaatattgcagtagattaaaacattcttttctaacaaatcagcaacatattaagggaattcattttattgtttgttccaaaaaaatgtttcacatgttttaccatgtatggatcaaatgttgcagttaattgaaacattctttcgttatttgctgaaacattgtttttatataaggtgaaacaatgccaccaaaaatgtttcacctagtgtacttataatgtttcactatgtatagatcaaatgttgcagtgagttgaaacattctttcactatttgctgaaacattgtttttatataaggtgaaacagcgtccgatttaaacgattggaacattttcgatctacttagtgaaacaattccgatatacttgatggaacagcatgcaacatttaaaaataattcaataataagctaaaaaattcatctgaatatatacatgtgtggtcttgttttaaagaattaattgtaacgaatttaatagtgcaatcggatcataatttggataaatattttaaaagaaaaattagtttaaagtggttttgtatgcatgcgtcatgctgacgtcagagctcgattttttttaagcccggatcgggcactcgacgggtagtgcctccccaatataattactgttaattcataatatcagtattgtacttatacgaataatatgaattggtacttgaatttgtttacttgtaattttatttatttaatagcaatatagtataactgttacaaatatataggactatagtttttttagttacactagttagatatatatcagtgcaatatatctgttacaattgcattatcagcacagaatacagaattattcacatatacagaatacatatgaacgaaatacaatccattcacaatccataatactcactaattaattagcacaacaatattaacgcaaaaaacaaaatacgcgggccgatgggatcgacttggaaaattttcgctggctgaatccgtctatgcggtggcaaaatacatatgccaacattttaagataatatttaaacattgagacaaaacttaaacattaaaagtaggtatagttttattttttttattataaacacagtccaaaagcaagtactaacaacgtcacactcacctctatcaacagtgtgtttggttgagttatggcttttggaaaaatagcagtggccagtggcttttcgcaaaacagctatggaatatgggctgtggctttttgaaatgactagtccggtttacaagcgggtcccacgtgtcatacacactggatcttatctctcccctcttctctcttatcttatctctctctcccctgcttgtggccgaagcgggcgacaaccagggtgggcgcacggccggcggagtggggcgagtggcagccggagtgggctacgggcgaggcggatcggccagcttcgccgctcgcgatggccgaagcaggcgcagagagggatgaggcgaggaggacggtgagcaggggtagggtgcggagggaggagatggggcgctccgcatcggccgacgccacccgcgttgaggcagacggaaacaatcatgtcataactttcgcagtaaatcaccattatacgataattcatttaccgacgaaaacgtctacttacaacgtagtagtaactcaattactgcattatgcgaatcacctcatccagaaacaacaacacatttacgacaaactcggtcaccatagttactaaacgagtaacccatttattagctatggcaaacaatttaactacccagtaaatcgattaccacaagcctggctgtgacaaggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaataaggtaccgatttcctaaatctactttacaatcttatcaaaccaggactttaggccgttccataatatacagggaaacgtaatacccaagtcatgatctgttacatattccatacatatatgttatcccctattactagtcggataaccatgccgtgtgggtatggggtacccataatctccacagtagcccctgagaccttcacagtcgaaaatataatcttctctcgaactagattactctaaagccgagtgcttcaatcatcttcgccatggtctcccgagtacttttaccaaatctgaagactgtggagggctgaaaaataaagtcaggtgcatcgaatagatgcacctaataggtgtagcccccaactatgtgattagctgaacaaactaaacatatagtcaaggaataaattatccaattaaccgagtggtttttgataattatagtcaaccaagtgacttgataccaatatatagcatatgcggtgtgaatccccgaataatatgatccaagtgatataccgactgcttggcaaaatatgatgcgtataacctaaagttgacaacatctttgaaagttcacatagcaaaacaactataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccccgagcatatagcttgtccttctgtcatagtcaaaattgtctattggcaatagctgacgcagtcggcatggagatgaaatgaccaacatgaagacgaaattgctcatcagaagtaacggaagatgtcagcggtagtaaaaacagtgacaccaatcaaaggtaatgaagttgcataaccatggaggcaaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacaaagtttcccatcaacggcagcagagtaggctatgttgaagaggcttgacaagatgttgatgaagatgacgatgtcggtgatccagtcaatagcgatgtagcagccgatgataacgatgagatcctctattggcagttgcgtagtaggccaaccgtgaagacaaataattggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgagtgaagataaatattgaagattggaacaccacttgttgtaataaaataacacggtatcatatttggtgacgtatgccgaggtgtcgaaacactggtagtcgtcgtggttgatgaagtagcaaagcttgcgaagtagaggcaatagagtttgccgatgccgaagataataaaaatgaagttgctccaccatggtgacaaagttgcatagtcgtgatgaagtgaacacgagtcggcggcaacagaagcaaaccggtagtgaagacgcgcagttgtgaagataaaagcaccagtcggcggcggcataaccaatcggcgacggaagacgatgatgtccatcagtaatggtagctgtataaaccagacgtagaggcgagggcactagtcagcagcagacgagacgaccagcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacatagacgcccaacaacggcggcataaaggccagccgtgcaggcggaaacaccagtcggcagcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataatagaccagccgtgcaggcggaaacaccagtcggcggcagacgaggcggccgatcggtgaagacgtagacgcccaacaacggcggcataataggccagccgtgcaggcggaaacaccagtcggcggcggtcgaggcggccgatcggtgaagacgtagacgcccaacaacggcggcataataggccagccgtgcaggcggaaacaccagtcggcggcggtcgaggcggccggtcggtgaagacgtagacgcccaacaacggcggcataataggccagccgtacaggcggaaacaccagtcggcggcggtcgaggcggccggtcggtgaagacgtagacgcccaacaacggcggcgtaataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttccctattaacccacagtaattgatttacctccagcggtgtatcttcaacaactaccccgaattcaaatatatctaatctacatagaacgaacatgggcaaccgaacacggattttgcagactctgggcgcgacgtgcggtgctcggaacaatattccatgcgcaagcgctaccgttaacacaactcctttcagcccagtctaactcttttaccactcatccgatcaccaattcaccactaccccttctccgtacatcaatagaaaaattagtacaatttcatgtgcttttgacacatatgtatgaatgttctatatagatatttgcaaaataaaaatattgatatttcaaaattttaaagttcaaggaagttacaaagacttgaaaaatctgaatacatgaaaacctaatctaaaacaacattttatttgttagtggagagtaagtcatagtgcatttctgtttcgtaggtatgactacaaccaaccgtccgaatgggatttctccataccaagttcacataaaatactgatttttttaaaaagaaaattcaaactttttaaaatttaattttaaaggaagactatcgcaaaagaggcctaggatgtagaagatcatgacatgagcgattcggcagattctcattttcaaactagaacccggtttaggaataaaatttgggagagtatattaaaaactaaaagttactaaaaaggtttttaaaaaaaatctaaaatttcatcaaatttcagatgggccggattactcgtgggcccacatgtcagccacacgccacctcgcacgtgcgtcacgtgacgggctcctcggcccattacctcgcgtaccctcgcacccgtctcccgcagacagatccgcctcgattcttcgccgccgcgacgagctccctccatggcgccgccggccgccgccgcgacctcctcgtcgtcctcctacaccgacacctcgggctcctcctccgactcgtcctcgtcctcggggagcgaccgacgccgacgccgcgcccgccaccgcagcggccaccggaaggatgccgcggcggcggcgtcgtcctcgtcgtcggcgctgaaggcgcgcaaggaccggaggtcccgccacaagcggcgccggagggagcggcggcggtccccgtccgacgacgacagctacaggcgaggctctccccctccccctcctcctcctcatccttcctttctaggtttcttgtgctagggttaggcccagatcgatctctgtgaatgaattttgctcgttagctcctctgatagtttatcttgacccatgattgacgctacatcaggagtggtattaaggggataacgaattagttgcacaaggacgtgaagaattttcggttgttttacaactaacaaaggatttatttgttcagtttggtttggtcgtgccttacttgagcaacgagagccctaaccgtgagaaaaattttaggatttcacttcaacttgatacttcatccgtttcataatgtaagattttctagcattgtccatattcatgtagatgttaatgaatctagacatatatgtgtgcctagattcattagcatatgtataaatgtggacaatgctagaaagtcttacattatgaaacggagggagtagtaatgagcactgaatgctagctcgaatctacatggtttggagaatttctgtgatgtactttttcaatgtgtaacaatcgcaacagtagtaggacaaagcctcattccttcctagtttaatagtcagtgatcggttctatcagcagtaggacaaggatttcttagatatgatttgagctcactattgaagatgagtgttcgcatctccatttaaaattccttttcagtcagttaaatattctgtaagcctgagagggtggcaatccatggcatttaccggagctatgatgctttgttcttttgaattcaatttatctgtgattaggagttatcatggcatcaagtttaggcagctaaagcatagttcagaatctaggtaccagggaagttttgaaacaaaaaatgccatagtcttgcattacattgttacggcttgaatcattcaattggatgacatggatcggcatagcaacaagtttttccctagttttagccttcaagctgtcttggctttctctgctacactgaaaaaaatagagatattttgcttcttgcgaaacttatattcctgtttgctttatgccaccactgttattttgaagtttctggtgctttttgtagtagctcaagctcttacgacagtgaacatgagggcaaatcacgcaagcacaagaagagcagatcatcaaggaaggtactgccccatcaatgcattcatatttgatttctcatttagattttttctccatgcgtcgaatatgtggcctcattgtatttacttacctgacagtctagggagagggagcgaagcaaggataggcattctaaacgagacaagagcaaacataaagaggtaaaaatcctatttattcagaaaatacctttttcttggtttaacttttcagtgaattgaatctgtgttgcatgtaataatcactctctagaaatcagcaagtgttggttgcatacttgcgtttgattgctgttacagtgccatgctatatctattaatagaaatctacagggtcatgtcttatgaagtagatatgtagacttaaaatatatgtggtttacatttaaatacaagaggtccttatatatcttgctgcctgtttctgggttggctctttgacattggagctgggattcgtgaacgagtgacaacatggtggattggcttgctggttggcttgttggttgattggttggttttgttctcttcaatgcgggagctctacacagaagaaaatagtgaacgtactagtggccccgtgcagctctccaaggtatattagatacttggctttacatttttcttttctatttgttttatttaacatatgaaacattctttattctgtaaatcagtttcttggacgtgacaaggatgaaggtgttcaaaggagtgcaatctctggtaaaaaggtgagaatagtctcttgaccacttcaatgtacaccttttgaattgtacaatagaggggggtaagggggggggtgcctgttgaaataaaaaatcttctgatcaaagtaaggttatgaaatatgaacaatttttcagtatccaaactgttccatcggttgttaaattcaataaaacagaatgggctacctcgcatatgcccccctcataacaaattattttaggaaggcaaaagatttgatgcatttgcattgacagataatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12401 - DNA, 4611 bp, Oryza sativa
cctctaaccctaatcccgccttcctcttgccattgccgctcaacaccgaatcttctcgccttctccattaccaccgcctctctacccctgatgagcgacccctaaccccgtcggcgtcctgtcgtcaatggcaccagtgaggcccaacagactggcctcctcccttcctgtcctctccctacccctcctctctccaagtgacagcaatggcctattctcgtcttcttccttgtctttggctcccacagcgccccacctcctatgtactctaacgagaagagtttcacccgccaacaccaatacaccttttctcattttcttccatggctgagacggcgccgttgcgtcgccatcaccttcgtcctagccatccctctaagctcgagaacacctcccacttccccactccaaaatctccttcctctccctacctcaaccctaaaaacctaatccataggtcctctgccggattcatcaaagatgaagccgaaacatagctattgaagcagatttgaaggttagaaattcacacagtttcctctaaaatcacgtgcttgatgtatagtaaaatctttctttttttttcatcagaggtttcatatcatacaagtcaaggagccaatgaggtagtgttgtttattttactcccccccccccccccccggcgcaaaatttgctattggacaacttttctaagggtactgtgccaactttgggacttgtgtcgctgcgggtggggccggcagcatttctagagggcccacagacagcgactcgtgccgaccttgtgcaagttttgcttctaaagtggctttcgatgttatctatgactaacacaaaacgacggtcaactagatgtttgttttcagttggaaggagcactcggttggcatctacagagttcagacaccggagaaagtcaagcacaagctgcccatgttcaggcaagctacgccagtaaacgtcaggtacaaaacttgagcgaaattcgccattttgaacttgaatttctgaaaaagatggcaaagaacaagaacaaaggcttctccaaaataaattcagaacaaattgtttagctgcaatgaataacatggcttctgtgaaactgtaaccaaagctcaacatgtttctgtatgatttttggaaaaacaaaccgtattttgtgaaagcacaacgaccaactcagcaatctgcaaatgcaagttagtaaatgcactgtatagtgcacaatgagaacagcaataaagcttaggaacataaatgcaaccaattctgatcataatatagaggcacaagggtcacaatctgcaggttaagatcaccaagatccattcaacataccaattgttgccagtaaaactgtgcccaggctttgcaattaacagttagaaccccagggatgaaacaaatgtattggtacaaactaaaagaatgggttgctggttgcaaaatcatgtcgacaaaatttgcggatggctgtacctgtgctaccgcaatttcagctaggtttctttcagtcttctaccgaaacagaaacggaaaaacccgcatttactttgctcctcaccacaagccgagcatcttccaccagaagcctccagcaccaagccagatgatgatgttaacgatggaaatgacaaatccatacccccaccactgagccagtggaacatagccagcaccgtagaagacaggagcagacccaattccatagtgcgtgagtccacccatgatgtttgagaggaatgaaagaaccatggcagcaattagaggaggagtgcccaaggcgctggacactgacaaaaatgcagtgaacattgctccaatgtgcgctgcgccactggcaaagaaatagtgggagtagaagtacagcagcaccaagacaccaaacgatagttgccatgagagaccaaggccaccaacaaactgagcataaaacacaacaatggtcagtataggaaatcagcaaagacattgagagaacacttctattttaatatatttgcagagctcgagttagaagaaacaaaaatagcagaatatcaggtgagaataatattaaacatttaaactgctcatctccagctagtgccatttgtttcaagcttaacaatgataaccacgaggaccattcattttaagatatcttcaaatttaacaattttaaacacctccctaacatagcataattgccagcctatccatactattgacagtgttattgtttcagtatgaacaaacagcagtataagttgcttctcatttctatagaaggataagctagaaagattattcaagaaatttaatatctgatgtaatgaaaaataaattgctttgatttcaaactgctaggaactaacatattgtggaaaattaagtcaccatgctcaatgtttataatatgcttaccagttagttatagtcacaaagcttactgatcataaaatccttacaagcataaagcagatcatgtgatacgatttgacctgataagtcaagagatattgttacaggaggggggagggacataccttcacaacagtctcactgaaccaagagatcaacccgtatttgttgaggtatccagccattgcaataagagcagcaaaccatgtaagggtatcccacgctacagcctcccccaaacactctttccatgtaacaactccagaaatcaggaggacggataggccaagaattgcagcagacactgcatccacattcagcattccaccaaagatccaaagacctacctgttggcaagatgacaatgtatagtgaggaaaaggctcagtttttattcaagttggaggcaatcaagatgatgcaagaatgtagaggtatataaacaggtcgttattgggtttaccacttcttatcttttacaaaataacatgtttcacagtaataaggtgacccaatcacaaaccactgtagggttctcctaaaagatggcttgaagcttcgcaaaagaaaccacaaaacggtacctttgctattcattcactgataatgtaaattagtgaaagtcttttaagtgaaatcacatagtaattctacataggctagtcagagcacaataatgatccaaatctcacggatacctaaataacaattaccggtccctacctctatgtactaatcccagacaagacccctgctaaaatgagggcacaaacaccagattcatggaaatctccatttccgaacagcccactcctttaatatcaatcacttataagaatcctagtaccccacaggcaacatctttgtactgaaaatcataaacacctactacacatatagtacacttcgctagagtactgatattgagggcctatttggtagagctccagctccacctcttctggaactagagcgcagccaaacagtttcagctctacccagaaagagagtggagtaggctggatcactctcacaaaatgaactaaagatgtggagctgggtttaggttgctctacaattcaacttcagatccaactagtggagttaaatttaggagttggagcccaccctaataccccaaaagcagcataacaataatataatactagcaattgttaattcctcaacaaaaatggtagaacgaaaggaaattgctaataatcccatcaaataccgtgaggaacagcgttccagccatgatcttctcctccttgctcataggccccatcttctccaaccgctccttcgccagccgcggcgcgtcggggctggtcttcacctccggcgggtagatcaggtacagaatcaacggcacaaacaccagcgacagcaagcccggcacaatggcggccttcgcccacagcgtccacccgatcccctgcccgatcgtccccgccgtcaggttcgccgccagcgggttcgctgccatggcggtgaggaacatcgccgacgagatcaccgacgtctggaagcacgtgagcatcagccacgacccgagcctcctctccgtgccgtcgccggcgcgcgagccgcacgcctcgcacagcgacttgacgagcggcaggaagatgccccccgcgcgcgccgacaccgacgggatggccggcgccagcagcgcctcggcgaacacgagcgcgtagccgagcccgagcgacgagccgccgaaggcggagacgaaggcgtaggcgacgcggcttccgaggccggtcttgatgaagccgcgggcgaagaagaaggcgagcgcgatgagccacgggatcgggtcgccgaacgcggagaacgcggcggcgaacgtgagcgtccgcgtgagcacggcggcgccgaggccgagcagcgcgacggcgccgagcgggagaggctgggtgatgatcccgacgatggtggcgaggaagatggacagcagctgccacgcgttgcgcgccacgcccgcgggcggcgggaccagccatatcagcaccccggtcccgatggttgccaccagcggcttgattgccgccccctgaagcaccggcttcggcggctgcgacggcggcgccgctggagcagcggaggcggaggcatgaagggcgcggtggcgaggaggaggagaaggggtgagtggggtggggcgggagagggagagggagggggagggggagagggggc

SEQ ID NO: 12402 - DNA, 11944 bp, Oryza sativa
gcctctccccctccccctagccagccgcctctcccaccaccggcgccgcttcccttcccttctccctcccttctcgccggcacggcggagacggcgcccttcccccacgctagctgtggcggcggcggcggcttcccccacggcgagcggcggcggcacccttccccacgctagcggcggtggtggcggtggctctccttcccgtctcgccggcacggtgcagcggcggcggggtgcggtggagacggcggcggcgaccgtccctccccctctccctctccctctccccgttggcctcgatggcgacggcgccctctcaacggcggcgtcgacgacgtcggcttcgtccgagggtggatccgtcggcagtggtggccaccgcgggtggatccggcagcggcgctccctccgccgcctctcttctccctccggcggcggtggaggtggcggtgcccgccgattttttttttttgcaatttttttcgatggctattgctaaccgaatcagattgtgtatggacgaaaaacggacgaaaattagatgtgacgatcggaaaaatataaatatttatattagtcatagatttctactttttggaagggtatattttttgcctgctcaattcggcatttgtttcatcaattttgtggtgctaactaaattgggccgtgtttagttttaaagtttttcttcaaaacttctaaatttttcatcacatcaaaacttcgctacacacaaactttcaacttttccgtcacatcgtttcaattttaaccaaactttcaattttggcgtgaactaatcacagccttggcctgcctgaaaatggtgttggtatagaatccagacagttggccaaaacagacaacgggataaacgcaagcttgcaaggttgattgttgagcaactatatctgatattatgcattagcagcaaatacaattgatgcagtgcagaaattaaacacaatatatctctacaccaattgaattatcaaaacactgttgctgacaaaacaaagcagaggctaattaaaaaaaaagagagacgtcctttcaaactatttttaagaatgaattgtgagcatattagagattgaacaagagacctggttaaaatcacacaaccttgtcactgcatctcaagcagaggctaattcgatcactactagaaactccgtgaggagtaacctttcttttcttatcattgtacatttgttcttcggcaatttttctatacaacggtagctaaactgcaattaatgtttgtaaaactgttaaactgattcagaattcagatggcaaataatgttctgtgggagcatgagaagatacttttgtatgcatgcctactcatttccaatcataaaatatgcaacaaaaatcttctagctagatgtaagaaagatcatatatagtattaagaagcaagaagaagatggaacaaactgcagattacttctgacataatctgatttctatgggtgtgctgaaacaagaattattaattctgatttcttctttttttttactaatcgtattattctgtacagagcctagttattgcttctttctattctcctccttttcatctacggagtactactttctcgaagaattttagttcttttttttactattattttacattgatcaatcatttgacctacaagacctcgcacaaaaaaaaaaagaaaaaaaaagaaagaaagactggatctacaagggaggaattaattcgatcagatcgacaaatcatatccaggccatggagtttgggcctgggctgagaaattagggaagaggaatgatagatttgggctggttgcattaggcccaacgtaaacaactgaacatttgaacccgatttgccattaaaatgaaatatgcaaaaggaaaaatgaatttgaaagatgtgcttcagttttgtccatgcactctggaaacatggggaaaaatgtctagactctttgatccctcaattcatggagtctaatatttcattaaaattattatttatgtagtgtttgcgatacttgtgcacatgaaagcattatttaggtgaagatagaaaatcaaatgcgattagctggtatatatatatatatatatatatataatataccttgtgatattgtaatcatgtttgtggacaggattagctacatgcctgatgacaacatcatgcattgcaatggtctagagatcataaccaatctgcaaattaaaataaatataagtaacatcataacacgcacatatattgcgtgatactgctatatttcagaggataaatcattgtttgaatgataattaagagttaaaattatacccatgtgcttcaccaggctagacaactcgatctgtgtggatcacgtgctttgaaaacctttttaatcacttactatattgtgtcacaatctaatattgggtttcactctcatttctggtcccattgtttttccagataaactgacaagcctccgtttttagtggaaaattgctggataagaataattgtgttctctcacgaggaaacagaaatgcttcggtttgaggcatgcatgcctttaaatcattttcaaccggagttaaatgcatgaaaaataaacttgtgatgatagatcaaacatgatgaacaaaataccaaactaatcacccaaagcatccacgccgatttgttaatgaaaaaaagaacttcctccatcatagaatataaggagttttagagattaacgtggttattaagaaagtaggtaaaattaaatggatgaatattatgattggatgagaaatagaggtagagaaaaatttgaattgtgaagggttatgattggttgggaagagaatgtcggtagagaagttatattttaggacaaattctaaaggttaaaaattattatattttgggacagatggagtataaatttagtactaaaaaatatataagtctagtttcctccatgtagcattgttagagaccggcgtggacctatcgccggtaacacttgactcactttagctggatcaactaaatgaactgatcatattttttttaacaatgtaaatcaactaagtatccataggtccgccaagggttttttttcttcttggcggttataagggttttcctcctttggcctttgcagttatagttaccacttttaccgcagagctatggtaggtgtaattaccagaatggtttggggaaatttgtttgaattgaaatataatttatagaagcaatgaaaatattaaaaaaaaatcttacaagtaatacataatttctagtgatatctagtgaaaaccttgtgtgaaagaaaaaaaacaaagttaaattcatttttttcgagtcaaactgaagttgaaacagagaacagggaaaagaagatcacaaagcccatttaatcccagcaaagggaaaaaaatattttctttctccctcatttaatctctccctacacaaaatattatataaaatgttttacaagtttcctcaacctttttgcaatttttttattttttctaaaaagcataccacggcgcggttacctcgaccgactgagggaggttgaaaatcttgaattcgaaaatttaaagataaattttatgcgataaccttcgtaacttcgtgtggtggtaaaataaacccttgcgcacggtatggcgaaacctgactacacacgcccatctccactatatattatgaccaaattgttggcacgagtccctcaatttgatcatagctgtaaccatacttcttttaagtgacaattgacagtcgttgggccccataattcacgttgtacactgtagtacgtgtacttccatctcacgcatgacaagtggacaacaaaatctttggagaatcacaaccatacatgtatactagctagtactatctacacctacttgtaaagttgcaagctagctctacataatccatatgcatgcatgtatagctttatcatcttttgctttctaatttcaacgattttaactaaattcttttctccatgagagagagtagagtagaggagagagagaggagatagagagaggggccagcatgccagacgtacactccatgcaaaggcttccacgcatgcaagttttgcagcttactgcagcagcttccatccatcgatcgatctgttattgcatgcagcatacaatagggactgttttgatatgtgcccctggctagctctctctgtgtgtgtggatgaatgatgatgatgatgatttttgatggcatttggaagctgtgtgagagggacatgaaaagagagagaagaaaaattaaaggagagagagagatttatagctagatgatgggccaggattatgtgaactccaagcaattatgtgacctatagctaatagctctctctattgtctatgcttcattgcaaaacaaccccacaggggcatgtatgtatatgcacatatctctgtcccctcaactgatctccctgcccctcaggtggccatgataaccttctggctcaagggaagtgagaaatggaaaaggacaacaagagctggagtcaaagacaagaagactagagctctatctctctctcatatctctccttgaaagagcatggaaaatggttggttcacacataccagctacaccgtagtacaatgatgtatatactaaattgtggggttattatacgtacattgaagccgtacaaactgtagcagcgaataatttgtatgtataagtagttgctttcaatatgtagaatttatgcgtagacgcctattctcatgatttatatgaacacaaaccaatggccacatttatttattgatccaagcatgtcactacatacaaccttttagtgcattagtttcaatgcaacagatatactcagttgccttaagcgcttccttaggatggtgtattgctaaattatagtgtaaattttggttcctcgtccacaagaaaatatatacctcttggtatcgactccctatgtcaagtactataaaattcctcttgctaaaaacattaactttctcatatagaaaatccacgaatcacacattcgagaacaaagaaataaaaacgcaatggcttacacataaaggggcatcctataattaagctacatatatagaagccacatgcctagatgacctatgcgtgtgaacctagcattttacaacccttcttttatttcctctcttgtttgctctccatctacttgtccagtttctaagcaaagcacacacacgcacccatcgccatcaccatcatatcatcccctctcctcctctccttcttcctccctctcatctctctccattgctagctcctcatcactccatacaaacaacaagaacacaacacacttgatatatatacctcacacacactcatgtccatttctccctagctacttatatccatcatatctatctacatacttgatcaaaatcacagcaagatcggcaatgaggaagccggattgcggcggcgggggaggggcggcgaagggcggcggcgttctgggtgtggcgggagggaacaatgcggcggtggtgggggggaaggttcggaaggggctgtggtcgcccgaggaggacgagaagctggtggcgtacatgctgcggagcgggcaggggtcgtggagcgacgtggcgaggaacgccgggctgcagcgctgcggcaagagctgccgcctccggtggatcaactacctccgccccgacctcaagcgcggcgccttctcgccgcaggaggaggacctcatcgtcaacctccacgccatcctcggcaacaggtgcagctaatcagttaactataagctcctacgactaagtagtacctaattaattaattaccatgattaattaagctttaatatattaggagattgattcattaattacttcattgtctttgtaatgtgggggttcatattgtgtgttcttctttgttcgttcgtttctcatcggtttttcttaagtagtttgcttgtcttcttcctacattaatttgtttcttgtttttcacaaagtgctagctttttctgtgtgtgtttaatttgttttgttttctcgtttggaatgttgttatattgtgttgatagggctagcaagtaatgtagcataatctttcaatgaatttccctcgcaattaaaagatatatatactgttctttttttaaaaaaaaatctctctctgggtgtgtattaattgttttcctctggtttctcttttttttttgagatggtgttgattttgtttataattctctgtggtgctctgatctacacatgcatttctccaaaaaaaaagtatataagagattacgtgaatttgacacaatacgtcgtacgatatttttttcccatgtacactgtcctagttcacaactgtcttaggtagatctaccgtgagcgtacaatttccgtattctacagctgaagcattacagatcacgtacagcaaaacgttgacgtgcatatactcatgcatgcatatacatttataatatgtgacataagttaaaaaaatttgattattagaatattaatatatatacagacatgtgtctcaagtctcaaagggctatgagaacaacatgagtcctggatatatcaatcaaaatatttcttgattaattcttttttttcttctgcttaattttgcatgaaatgtcgtacaccatgcataattacaaaactgatatatatgtaacgtagaaactaaaagttgcctgaaaagacaccgaaagggatacttcatacttgtatacgttctaattaaccctgaaagacatatgcaaatttgtcggatccaatcatccataattattgattaatccttgtcttaccagaaatgagattatgacatcgactaattacctctacgtactttctcacatgtaaaactaacctatatatatatatatatatatatatatatatatatatatatatatatatatatatatatatatatatatatgcttttcgttttacctaaaaaaaccttttcattttagctttgtataaagtcaaatattcatcataaattttcaaaaattcgtatacagtttaacatgtgaattatatattatgaaaatatttctcatatataatgaatttagaaaataaatcttattatggtaataactgtataaatttctagagaattgatgatgaaggttagaaatgtttgacttactgcaaagttataacgacaagtaatttttttaagtaaaacaacaagtaatttgaaacggagaaaatcatatatattttatctttatttttttttggaagtaaatactagattaatcatgcttatgcgcttatgcatgcatgcatgcatgcataaaaagaagattaattaaggcgcattgacatatatgtgcatgcagctaattaacctttttatttaattaatcttttgtactacaaccatagctatagctaagcttggataataattcttgacagaaacatctcgtttgctcactgatgaaaaatctaccgtactacgacgcatggaattattgcaggtggtctcagatcgctgcccggctaccggggcgcaccgacaacgagatcaagaacttctggaactccaccatcaagaagcgcctcaagatctcctcctcctcggcgtctccggccaccaccaccgactgcgcctccccgccggagcacaagctcggcgccgtcgtcgacctcgccggcggcggcggcgccacggacgacgtcgttgtcgggacagctaatgctgccatgaagagcatgtgggtggattcctcgtcgtcgtcgtcgtcgtcttcctcgtcgatgcagagccggccgtcgataatggcggcggcggcggcggggaggagctacggcggcctcctcccactccccgaccaggtctgcggcgtcgacacctcgccgccaccgccgttcttccacgaccactccatctccatcaagcaagcatactacggatcaaccggcgcccaccaccaccaccacgcgatcgccaccatggacggatcaagcttaataggagatcatcaccatcacagcagcagcatcctctttggcggcgcatcagtgccacctctcctagaccaccaaaccattctcgacgacgacgacgaccaccctaacaaaaccggcagcaacacgaccgcggccacactgagcagcaacatcacagacaacagcaacagcaacaagaacaacagtgataataacaacaacatcagcagcagctgctgcattagcctaatgaacagcagcagcaacatgatctattgggagggtcaccaccaacaacagcagcagcagcatcagatgctgcagcagcagcagcagcacatgagcaggaatgtcatgggagagtgggacttggaggagctgatgaaagatgtgtcatccttgcctttccttgatttccaagttgaatgattgagagggaggggccccatctatagctgccaaaggagtacattgcatatatatacaattatacatatatatacatacatacacattgaaggtagtatttttttccattgacacatatattctctcttccaaatgtacaagatttctcacaccaactccacttttgatcttgcatatatataaatatcttgaaattcatccttgtacacaaaattatagagttatgtagtcatgcaaataactaaaagaacttgagttgtatatatactcagtatcaagatactaggtaagatcgttttttttatttgtagtatcacaggatcgaaatactaccagattttagaaagtacataatttaatataaagtataaagtatgttgtataaattaaagcatataatattgattttgatcaatttaattggttttatgtaaacttgagcgtatttattcaaattattttcaatccaccttattttaaataatattttgtaggattgtatggatcgtagaatcgagatactacctaagatttcatagaatcgtctggaaataaatagtaagatcaagatactataaaaaattaagatactagatgagatcggtatcattttgatttggtaggatcgcagcaccataagatactaggatacggatcagaatatcgacagccttgcatatatagcgatatcataattaaatatatagttagatgccttaattatgtgggtgttcatgtttagaagttagtttagaattagggctaaacactgtagataatgcttcacctttttataaaaattttcttcagggtaaagtttcccctgttttgtttctttgcttcctctttcctttcatgcaccaactgcttcccttgcacatgaagtcacattgatgagcttatgaataaatatattgaagtgtctgaaaggtgcatgcagctagtacttgcctgagtgactagtgatcagtgtggtgttggagagagatgatgagtatcatgtgcatgcatgaatgaagtaggaggaacagtcactgtcactggtcaaaatatatgtaggttggttgcaattacaggtcgttagcagatgcaattagctgctagggtccagaaagataggaaggggaggcaggaaagtgagtactccatgtactatctttgccatcacatctctctctttctctacccctaatatcatgctgtcatctagcacattgagacaatttaataggatattccagctagctttgatagcttctcctgaaatttaataaatataaaaataatttgtaagaaatttaataaagcaggctccattgggtttatcttgaaattagagaaatatatataggttccaattgaaaataaagattatgagagttctggtaattaaaatttaattctttgtttcatgcgaaactgtcacgagataaatactccctccattccaaaatataaggcataaccacccctaacacaaagactaagaaataattattatcatcttgtagtttggatcatcctaataaatacaatgcatgcatccaatagaattaaagaacatgagagtggaggattaaaaaagtaataatttaatggagaaggggtcatagttaattgcctatatgcatgcatgccttatggagtattatggaacatctaagaaaagtggtttatatggaatggagggagtacatgtataactaatgagccctgtctgaatgactatttgacactatgcaaactgcatgtagaaaattgtttatcaaaccactaattaatttgatcggagtttgaatgtataataaaccgtgcaacttgtcctcttgcatttgacacaataacatatataatttgtcgatgtttgatgtcgcgattccgatatttgtatagtgtggggattgttgataccagggtatatacgagattgtagtaaaaaagatggagacggggatttttatacaggttcgggcccctgaattgtcaggtaataaccctactcctgttgaccgaagccggtcgttgctcttattcaccataatcacaccagtacaatatttggggtagcttatctatctgttgtcgacatggtggtctgaagttctgactcgtagtcaacaacagggtagccttcctcctcgaatccacatccggcgaggtcagagacagcgctagattcctctctttggttcccgtaggtaccatatggggttttcctagacttatctctgatgtcgatatctggcagtttgacttggcgtatgttggcttgtattggcttgtggctttgtggcgtctatgttgtccatgtagaactctatttatctttctttatccggaactccttctatacccgaaggttgtttccgtataaaacatggtatgtggtgggtcctgccgagatttagtcaactactattaggtatccataaccctgacataattattctctaagttttaattttaacagcatatgctcatgttgttgacccaaaccctatgatgtgtaagtgtgggtaatgagccagctcgattcattaaggctcgacttattaggctcgataccttaataaacgtgctagcttgcctcggtttgcaaactggttcattaagattgttaggtttgtcaataaattttatctaatttatattaatattactggctctatagttttaaatttaccgattcataatataataataaaatattaactaataaaaaaactaaatacaaatagttttaaaataaataaaggactaagtattggttaagaagcaagtataaaaagaagatatgatgctcgtgagctagctcgctaaactaaagagataaaagcgcagcttgacttgcctcgttaggactatgagcttgattcgagctgagccgcgagtttttagagcttttattcttacccctcccctagtgatgtgacacactaaaattgaattagtgaacggtaaaatttctatttgctgtaattattaaatatattcatactatagcattgatcatctggtgatcagtatatacactacaccgcaacaccaaatagaaggcaatagtttgttgggaaaaatggactattggtacaagtcagtctgccggtaaatatcctggcaaaacaatctatcggtaaaaagataactatgtcaaacaatctgtcagtaaaagaaagtgacggactatctgtaggtactcggtaaagatcttggaccgacgagctgtctgttgctatatcactagggcgtgtcagatattggggtggataggataaggttcctgtgacaagaaaaaacacctgtctccctcaccacactgctaggcaaggcgtagcctctagggttttggcacgaggaggcggcgaagcaagccagccgagcgagtgggtagaggtgcaacggagctgctacaaggtggacatggacgagggtgtagccaccgggaggacgacatggtggagatccccatctaccgaaatacaatatctgtcggaaaaaa

SEQ ID NO: 12403 - DNA, 4950 bp, Oryza sativa
  unsure (1)..(4950): unsure at all n locations
gcatcaaaattgaggaaaaaatcattcaaatctgtatattcgcttaaagcaaaccgttacaacaatcattccgtacttattcgctgtccacacatttcacacgtactccctctatcctataaaaaatcaacctagtactgaatgtgacatatcctaatattacgaatctgtacatacatccgtccaaattcattgtactagaatatgtcacatgtattagattcgttttttagggacggaggaagtagctctatttttcttacaaattacaatcatacagtacgtatacactgtctacgcatttcacccactacatggtatctctcttttccttctgtatctatactccctgctgtcatctgaatgtctagatagagtaagccataagaatttttttaaggaaaggcaggagattttgccttatgtagtaagccgtaagattacgtagtatagaggtaggaacagcacagcgagaagcatcccgataatcaccctgcagattgaattaattaagcagttaggatggtaacgtcgaaacgaggactctctccgtttctaaatgtttgataccgttgtctttttagcatatgtttgaccattcgtcttattaaaaagaattatgcaatatgtaaaactatatgtatacgtgaaagtatatttaaccatgaatcaaatgatatgaaaaaaaattaataattgcttaatttttttaaataagacgaatgatcaaacatatttaaaaaagtcaacggcgtcaaatatttagaaacagagggagtatatactttctcacttaattagtaaatcagttggaagatcctacgcggtgataataatctcaggatgcagcccgtattcttttgcaaatatgaatgatgaaatggcttgtggtacagcagcctgcaaaatgtttgcacagatcaagagatcatcagttttccttgcgtagaacaggattacaatggcgagctaacataggagagtccgaaacgttccaatttgggtaaagctaagattaactctgagtctctgaccattatgtttgaacacagaaaaaactggccattatgttcttttaaaaatctgaccattgtgaacttaactatttgagtaaatctaagctaggaagtgatcaagattaaaagttatcaatctcagggaaaaaaagattaacaattatcaatcgtcttgccatggtaaagaaaagctactttcaaccattatcaaccgcgctcgctttctgaatattcaagcaggtaattaagaagggttggatttccatcatcgaagcaagaaaagaaaaagattaaagagcgtagttggaaggtaatatggaaatgtgtcgtgagaaagttgcgtttggtctctaaacgtctgactacaaatacattgtattagatacctgtatgatggcagcccggagtttgttgccgtgaaggccaaccattttggatgcaatggtcatcgcaatgggtccaagagcaaacttcaaaacctgtcccagaagccacccgcacagatcacaagctatgatactttcctgacttcccatggacaaacctgcagataaaatgagcatgaccccgccccaaaaacaagtgtccaagacatgcatatttgttacaaaggaaaataaaagacaatctgttactgttagtgggaaatttaaaaaggaaaaataatgtatatcccctgtacctggtgtatcatatactcctatgatatatacataggcagaacaatttatatttatgcatgtatgagcacatgtcaatgttttaatgcgagtataaatttgtacttacccgtgctgatcataggcagcgctcctatgcccagtgacaaggacgcgatattcactggtggagaaaccctttgtagtcccggttcgtaacttctctttagtcctggtttctaaactgggactaccaatccgaaactaaagatcgctatctttagtcccgggtgaaataatcgggactaaagatcgatctttagtcccggttgataacatcaaccgggactaaagatcgagctaacctttttttttgtatggccctattactgtatggtttatatatatatatatatatatatatataaaccatgcatatatatgtttcaatacatatatatgcatatataatatatgcatatatatatatatatatatatatatatatatatatatatatattatatttatatatgtttcaatacatatgtacatgcataatatatatgtatttatacatatatatgttttgcaaatgcatatgtatgtatgtgtgtgtgtgtctatatatatatatatatatatatatatatatatatatatatatatatatatatatatatatatatacacactcatatagggcaccatggtgcccggcaccatggtatcaaatgcacaaaatcactcaaatttttcaaaattttcaaattgtgagtatatacctagatataataattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtggttaatgttaatacctaagtgctttgaactgcttttgctttgcgcactacaaataaatgacaaacgacgagagatctaattaatatacacttgtatgtatttgaatcgcagaaatatatatgtagagcatgtgtactcacagaaaatttgaacttttgtctaagtctttctctccagttgccggggaccaaatgacggaaccgataccaagccctacatggagtttaaagctatgattcgtagtagcaattaacataacaagattttcttaattaacagaggaacttatgacagtacctgtctataagttcgaaaaccttgtcaaacgtagactcttttttatccattgagtcatatacattgacggtgcaggccgacaggtcgaaagtaaaagcacccagtggaatctacaatgtgcgtgggatgcattacatatgaaacacttagcaagttcatacgggaatgaaatttggtataggaagacagtaaaattaaactaactctgtgttgtacggcaacagtatgaacgtcttgtaatgctgcgcctttaggagatggacgagattgtcctctgtggcttgcggatattggtcgagcattgcgacgtttactttccgagggtcgatgaatccagtatcgaaaaccccccgccgtcgggccctttgaatctccattctacaatgataaaagggagtatattattttctatagtctacttatatacaaggacctaattaattaaaggagacgtagtaagaaatctaactgaacgatatacttacaaaatccagcaactcataatagagacgtcgagggcatccagctggtatagttcgtagattcccttgaaattgatccagagaatgtcatcctttaattaattaggtctttgttcttggcggcgtcaactttcgccttcttcgttgcccttgtgtgggcaagcggtggagcttggggggcccttgactttgaaggtgccggaagaggagcttgcggaggagtcggtgcaggagcctaaggtggagacggtgctggagcatgaggaggagtcggtgcacgagcctaaggtggagacggtgcaggagcctgaggaggagtcggtgtaggagcctgaggtggagacggtgctgaagcctgaggaggagatggcagagccggaggagatggtgcatgagacgccgcttgtcgcccagggaggatgatgtaccgcctgcgccatagaataatggcatggcttgtgtctcgtagatgcgtctcaccgtctcctccagggtaatccagcgcgaggtcctcgtacgcgccttcgaccaactcaacttcgaccttggagtatcctgctggaatcggctgcagtggtaagtacctgaaaggtccattgggatggccatgcccgacgccaccttcatgtggtgagaggttatttattagtaatcaacatatataagcagcaactagcggaatggccaaatctaaaatatataaactacgagcttacctttattgataagttcttgaaaggaatatgcagctcacatggtgtccactgaatgatgtcatcaacggggcaagtggattcgtcctggtttgtatggcgtccatactctgtgatcctacctgccccattgaggcgcagctgctacggtttcctgacgggctcaccattgcaggaggaatggtcggctggggatcatgggaccgatgtgcggccatgcgttcatcaaccttccttgccacctcctcttgcatgctgcgctcgtagctcgataccctgaactctagatctgcaatcttcaccttggtatctctcttgctcctcatccgactcctgtacgtgtggatgtcctccttgaacctaatcttccaaggaatcacccctttcgctcgtgttcgtcctggatgctctggagtctgcagggcgagtgacagctcgtccctctctctgtccggtcggaacgtgccctaagaagaggcttccactgcgtctgctagtcaacgcgcagcctcttgtatctgatcgccgaagaccagtgggccatcagctgggttgagcgttccaccgtgagcatagtaccagaacttcgatcgttccggctaattagcggtggccggttcgatacccctctcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12404 - DNA, 525 bp, Oryza sativa
cataggggttgagatccatttctttccgtccttgactgcaccatctggcaaagttatcctgaagaaagttgcagggaaaaaaatcacatgagaagaattaattgccattgccattgtgctgcacattgcaggtcacagtgtgccacatttgtattgtaactagcaaaggtacattgagaaaaggaaacctaagcaccatataatcaagggttttctatattagaatatttaggcagaagaaatgcttgccgtctctattttcttattaaagacagatggatgttaaagttgaataacattatggcattattatgcagtttgcgcagcgcccattttgtcgtcgcatcgacattcaaatattcccaacactcaaaatccgactccaaattatgcagcacaaagcatggctatcgacgatattcccttggtgtgctatatgcctatatctacatctcaatgcctgagacatctgccatccatgtagtatctaactccattttcatctataacgcgccgcaagcatta

SEQ ID NO: 12405 - DNA, 237 bp, Oryza sativa
catcggctggatcaagcttcgattgatgagctcgttgaagtagctctctccaatctcctgcaagcttgtccctacaggtcgtgtttcatctgtaataaaaccctcagctaaccaaccccatatcaaaacatcttttctaattagttcatcctcaggatatttgcttagagacaacaagcaagtcttcaaatgaaaaggtagatcgtgtaactgaggcttaatatcttccgcatcttg

SEQ ID NO: 12406 - DNA, 595 bp, Oryza sativa
aatatctttacatagagtagtatcggagtattagccgatacatgctagatccatctgattggctatgctatgaacatatatagtctcgttgttaatatatatttcgatctaagtgatttatactatctcggcatggcgaccgatctatcccaatcacttgatttaagtatatattgacataaggattatatatcgttaatatctatagtcgatctagtagattttgttatttcttacttattaatgattgccgatcgatgcatatatgacatcggctcaaagataaatgatatgtcatcggcacttagccgatcggctatcgtttatggattcaaccgcagtttctttgtctttgttcttgttgattgcaggatcaaatcaactggcacgctagcacacccgaaggtgagttttggacctacactggagttaagcagatctcccaggccttgtgttttcacatcaacacgctttggcacgcccggtgggaccgatcggaagtcagaatcacaacagctgtttttcctcatggcctagaaaccgccagcgtcgccgtctttggctggtgagcctcgctctgttaaagctaagatcc

SEQ ID NO: 12407 - DNA, 247 bp, Oryza sativa
ggttgtgagcacatggttttgatggtcgtgctcatgacaattaaggaccggttcacgatttttggttgtgaaacattaaccgtgccaaccacaagccagcgtgggcaacggctttactttctgtatagtatggttcattgtagagcaccagactgtgaagtggcagagataaccccacgggggtcgctggggagtccatgccttgtttaagggggtgattatgatccaggaacggtgcattgctttg

SEQ ID NO: 12408 - DNA, 527 bp, Oryza sativa
ccatagccgatgacctggttcttctctttttactggcatcggctggttctctgatgagcccttggagaagagttgaagtctggggggcatgatagccgatgacaggaggagatggcccacctccatttggaataaggcctggtgcatactctatgtccctgccactattggtctggtgaggaggggagaactctgtggtctgcaagtcagaaaagaaaattaattaagttatgaatcggctaagcaattatttaaacggagttaattaaatgaagacatacctgagggataacatctggaaagagatctgtcatgtacatagaagccgattgatggaatagatgcaatttccattcaccccaccatctgtcaaagtttttgctcctgaactttgccatctctatattttcaatgatgcccagaggaggtccttggagattgagcagccgatccgtcatcaaggttgatgaaattccccctcagcactggatcttgtcagcaaagaataagccgattgggagttggcc

SEQ ID NO: 12409 - DNA, 175 bp, Oryza sativa
cactgtgtatcctaatgattctttcctccaagagttctctaattccttccgtgagttgcaacaaaggagcttaagcacattgatgctgtttgggccacatgacttggattttgcagacacgtttcggcaagaactcaatgaggtaaggtcaatccgtgtgttgaaactggagatg

SEQ ID NO: 12410 - DNA, 232 bp, Oryza sativa
cttctgtacagggtggtttgtaacaaggaattgacaatggcccatgtacacaaccttcctgcaatgcttcagatacgtactttcagtttcatccatacagtgagtgtaagccccttgtttgactatccggataggttactaagtgcagaccaatcgttaatggtaacgaacagcaacctcgtaggttaaatttctcatgtttgtcctcatcccacacagggacgccctcttt

SEQ ID NO: 12411 - DNA, 602 bp, Oryza sativa
ccaagatgacaatgaagacaggaagactcaatggtgtccttctggtatctttacaaaaaatcagaagagaagggtttaaaggttgaggaactggaagcgctttcaggaggttgagcaagaaatcaatcatcggttgaagaaggcgaagccgagacaggtgtggcgtgttagaaatcaagctcctgtagccgatgaagccgcagccgatgaagcgaagatgttggctaaaggaaaaagtgttgtgaccgcatcggttacatggttttcatattgcctgctgaatttggggtcaagcaagccgatgtcgatgaagttgaagaagaatcggctaagttgattttatcaccagagcaagcagtcttcgagaagccagaaggaacagagaatcggcatcttaaaccattgtatataattggctatgtcaatgggaagccgatgtctaagatgatggttgatggtggggctgcagtgaatttgatgccttatgctacatttaagaagttaggtagaaatgctgaagatctcatcaagacgaatatggtgctcaaagattttggtggtaatccatccgaaaccaaaagagttttaaatgtggagatgat

SEQ ID NO: 12412 - DNA, 552 bp, Oryza sativa
atcatcacaaagttacctggtatgttgggatttaggcaggagtagacatgggaagcagaaatggtaaaaagatacttaaccaacttcatccagattataacagcaacctaacacttgctaagcatctatttatgtgacttctcgaatacatattgaagttccaagaatcctagtcctgtgaatttctagatgctattaatcatacagcaacaacgagatgattaccgttgatagctccaattcatatttaaatccaaatatctcgtaaacataattgatgaagtccaaaacagccttaacttcgtccttgatctgcaacaaagaaagaactcttaagaaaagtaggcccttatacaatcaggggacactatttaaaattatccgaagcacagtgcagctgttaaaaggaggttgtgattaacaccatctgaaacattgtgaaaacaaatgggaatacaaactaccatccatacagtatgcaagtcatgaacatctaaatattatgagcttctggtgcctaaactaatttatgtcacacagtgtaaatacact

SEQ ID NO: 12413 - DNA, 589 bp, Oryza sativa
cttatgaatatcttctttggccataaagatctgattgtaccctgcattaccatccataaaacttaaaaccttgtgtcctgaagcagcatcaactaactgatcggctactggcattggatactcatcttttggggtagctttattcaaatccctgaaatcaatgcacaccctcaccttgccgtttttcttaataacaggaactatactagaaacccactcaccatatcggcaaggacgaataaaaccagcatcatatagacgtttaatcttagccttgacaggttcgagcatatcggctttgcatcttctcggaggctgctgatgtggtctaacccctggtttgataggtagccgatgttcaacaattgatcggctgagtcctggcatctcacaatacacaaaagcgaagcaatctttgaatcttttaaaagctctatcaacttggttctaaattctggagataagtttttactgataaatgtcggccctggtcgatcacctggacctatatcaatttcttccaaatcatcggccgacatgaaaccctgtccttgtttgtcatcgagatcatctactgtgtccttggtgt

SEQ ID NO: 12414 - DNA, 1225 bp, Oryza sativa
ctaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgccttgctgcttcatttatcgccaaaatctgatcttttaaatgttgttttctttttgtttttgtttgtagatggccggcagcgtcacccgtcgtggtttgcacatgactggcttcgtcttggagctgcggggcatgtgcgtggtcttggggtatccacatggagtggattaccaggccaggccgctcccggagcaggagggtgaggatgcagagccccacgctggttgggaggtcactgcagtgatcctctctggctctcccgagcggacttcgctggcagtcaccgcgggtggagattccttccccgccgcttgccagaacgccgccctcctcgccatcggcacccttcaccagcgctacccggacgagttgcagcactcgccctaccgctaccaccctcgtcgcggaggagcccgcgacttcgccaccttccgggatgctagctcggaggatgacgctaccatcgtgcacctggcacgcatggtggaggcgtacgacgcggctcgtatcgacttccatcagatggtgcgccgcggtatggtcgagaacaacatgaagatcctggagctgcggcaggagaacctgcagctcaagaaggacctcgacgcggtggaggcgcagctgcatcagctcaagatcgcccagggagaggtctgccgccccaagcgtcgccgcgtctgccgcagccagaagatcaccgcccg

SEQ ID NO: 12415 - DNA, 1746 bp, Oryza sativa
tgacccaatttaataccagtgataaatttaagaataatggtagtcgggggggaaaagtttaaattgtaagcccctcctctgtttgcgggttctgtgtggggttttcagatggtgacgaccaggagaaatgctgttaccggtgatggcaatcaacctgaaggcagcaaccacaaccaccagggcaacccacctccacctcttccttcggcctccgccaccaccaccagacaccaacgccattctcacccaaatcctcgcccagcaagccaacatgatgactactttcctccaccacctccaaaatccgccacaacagaatgctccacctccacctccccaacactctaaactcgccgagttcctccgcatccgcccacctaccttctctagctccaacaaccccgtggatgcgttggattggttgcatgccgtggggaaaaagctggacactgtgcagtgcagtgatgaagagaaagtcatcttcgccgcccaccagctgcagggacccgcatctctatggtgggaccacttccaagctacgcagccagagggacagcctattacatgggctcgcttcaccgccgctttccggagaacccatgtgcccgccggagtcgtggccctcaagaaaagggaattccgagagttgaagcaaggcaaccgctccgtgatggagtatttgcatgagttcaacaacctggcccgttacgctccggaggatgtgcgggaagatgaggagaagcaagagaagttcctggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcttacgccagccgtgcagcctggtcaaggccacagggacgctcaaggtcagcagcgtctgtgcttcaactgctttgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaagttggatgtgatccttgggatgaattggttggctcaattccaaggagtagtggtttgcgcgagacgcactgtcctctgtaccgagggccggaacaaccggttgttttctttgcacccccagcctctgtcagaagttcagaacttcatcagataggactgtcagaaatccccatagtcagggagttcggagacgtgtttccggaa

SEQ ID NO: 12416 - DNA, 490 bp, Oryza sativa
atatgaattttagagtcgttttgggacgcgacaacggtcccaggatatcgagcccccagacagcaaatggccatgaaagtggtatgatctgcagggcctgggccggtgatggatttgcttggcgtggaattgacacgctctgcatcgccggaccaggtcgaccgcatcattgagagctgtcggccaataaaaaccttgacgaaaggctttgccaaccaaggtgcgcgaggcggagtgggctccgcattcgccttcatggatatcggcaaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcc

SEQ ID NO: 12417 - DNA, 7813 bp, Oryza sativa
  unsure (1)..(7813): unsure at all n locations
cccccccccccccccccccccgattttgcttgccagactcggttaattaatgaggcacttgaatggtttttgagttttcaaagtacttaatctagtgatgcttttgttgacctccattttgaatctctatacatgctgggtatgaactacttctctgttcccgattcgggatcaacaaacaaaactgtcctgatagtcctagatagcagcaatagcttcaaaggttcagagcgaacgaaaataattttcaatagtgctggcacatgttttttcagaaacatcgagtggtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatggacgccggcggcgaggaggcgaagcaggagcgccacctggtgctggctcacgagctcttcctcctctcccgccccgacctcgacgacctcgccaatgtcgccctccgctccgatgccctcgacgccgtcaagtccgatggcatggcgccgctgttcgagtcgctggccaccgcgggcgtgctgctcaagccggacgacgcagctgctcgccgagatgcgcgcgcggatcgacgaggaggtccgcaagctcgacgagaagtgagtggattcttcctctcttcgattttatttctagccccacaaaaaagaggtcgcccgttgctgtgttgcgtatgcctgcagtagtactatgtggggataggttttgtgataaataactctggtgttgatatgatccgtttgcctaaactaacctagcttgctctcggtgcggaacatggatgctaaagctggtagacagtggcgaagctagagcaaaatggaggggggttcgagattttgccacaagtatatcaatatatataacttcaagctacattttcgatagaaccgttgattaataattttttacatcaacagtagagacacacatgcatcaataaaataaaaaaagtgacaaacattgtttttcaaaattaagaaatccactaataacattgataattgagaattggttactaacccatgagcaaaagatgatctgcatatgcaaacataagcaaacaccattctatttcattatctcaacatcctcgacgatgatttgataacctaaaacaagttaacatcaaaatcagttctcatttttcaaataaaaagtagaatccagcgcacttagatacaatcattaccttcaatcatcatcaaatatgcgtccttgcattttcatgaagcgacgaacaacggcctcattggtgactttcttcatttcttctttctccacataacaaataaggctatcacttaagtactcatcaccaattttattgcacaaatatgttttcacattcttcatagctgaaaagcacctctcaactgtggcagtagcgacgggcaatacaagtacaagttttaaaagttgataaaccaatggataacaaagatgttttcttgtctccaccattatttgagaaagctcggcaatagtttgtatgttggagaatctaccatcatccctcacatcagcgatgtagagaccaagttggtggctaaggtccctcaaatttccagaattaaaatcactaggatacaattttgctaaactcatcaaattctctagattgaaatcatgaaatgagtctcttggactaaaagccgatgagcaaataagcaattgagagcttgtctcactgaagcgattgtcaagctcttgaagtatccaatcaataacatcattaaaacaatccacttgatagtaatgcttgtttgtaattctagatttgtgcctacgcttcttgggatcaatatatgtatcttccatttccaatttgacaatatcatacttgtcacaaaagtcagagacttcatctagaactttctcccacttttctcttctaagctcatccaaattgagcctagttgactttacacatttcatagcattcactatgtcttgatccttccgttgcaatgctagtgacaagctgtttgtgattgttaatatagtcaacatgaggtgcaaatagaagacaaaatcaaaagattggaagtactccaaaagattcgatgcttgatctctaattttccaatcatttttgtctttttccacaatttctagcactttgactattgtagcaaacatgccaaccaaacttttgagagttttatagtgggaactccatcgagtatccccaggtctctgaagacattgctcttgattcaacccggttctagtttgaagttgcccacaacccaatgccttactcatttctttaacattaatatctctaatcaaatcccttctcttagatgatccacccaccacattcagtaagatggaaatcttagtaaaaaaatcactaacgcctttatgttttctcacaatagccacaagaacctattggagttggtgagcaaaacagtgaacataataagctgaactattttccctcatgatcaatgattgcaaaccattgaactcacctcacatattgctagcaccgtcatatccttgccctctaacttgctttagacttagcttcagttctgcaaatagagcatcaatagaagacttgagataggcagaagttgtttcagtcacatggacaagaccaacaaatctctctctcacaattccatatttatcaacatatctcaagaccactgccatttgttctttgcaagaaacatctcttgattcatcaactagcaagcaaaaaacatcatgcccaatttcttctagaatagcatgtagcacttcctttgcaaaacatttcacaatatccctctgtatttcaggagcaaccaaaagactgttatctgatttttttgtacctattgcctttcttaaggatgggttttgctccgctgtgtaatcacgaaattccctgaagttgcctctgttgtagggctcctttgactcatcgtgacctcggaaaggcaatcctagctttactagcatcctagcaacatcaatggacccattcaatcgagtaagatagtccctcttaccagtttctctcacactatgaaaagcaacatcaatgtgctgtctttttttgtaataaatcatcacacttcttcattgcttgatagtgtgaaccaccgacatcacctacatgcaatttcaacctttcttttctatgaaaaccattccaaccatttttaacaaatgcttcatatccaccatccttcttttctctaaacaagaaatagaaaaaacaatatgctcgatttttggactcactgtattcaagccaactttcaaactcatcaaaccattccgggacaaaccttcttgaacctgtcataggaaaagcaaatgtgcgaggttgacaagggccattctccaagtatttccttctcaccctctctctgagattaggatggtactcatcaatttgttttcttaatcctggatcatatttaatctcatcttcccagtttatatcatccaaacatgaattacatgcattgttagcactattcggctctggcactttccttttgtaaaatcgttccatcaattaacctatcattagatgatttaggaggatgtaaatatatactgattttatcattcattcaagtacagaagtagaatgaaaattgatatgacttacatccaaatagcaccttcaactcaaattctcaaatttccccccaatctgcaattttattccaattctgaaggattccaaattgacccctactggcctcctaattctacaatgtaaaaaaaaacaaccaataaaaattttaggcctttgtatctaataaatcaaattgattaaaaaagaaatagatgaagcatgctttcttaccttgtctctactaacgcacaatgtggctgtgtgctgatcagttgatggagatggatgatgtcattgttggcttcatggcttgtgaaagtgtggtctgacgcttgctcctggttagctggttgcctggcgaccggcttcctgccttcctggctcctgcggctggagcgagcaacgtaggcactaagcaagcaggggcgacggcgacagcgacagtgagctgccgagggcgacggccgacggcggcgcgtcacgatgccgagatgggcaagtgttgtctgggagactgggattggctgattgcagagcagtggcgtggaagccaaacagatgcgaggcggagtcgtcaagattggcagcgacgggacgcggcatacgagaagtcgagaagagaaaagattgatctggattcgactctcctcatgggcttacaacgttaactggactgttgtttggactgtgggtgcactatattgggccaaggggggtgcatatagggccgagatatgggggtaataactaaaaattttgtttgaggggggttcatctgcacccacgggcctctattgggcttcgcccccgctggtagatccgtagatagcttgcatttgatttggtagttgtaaatttacgaattatgcttagggtcaattcacctctatataaatctgtactacataatactaataaactttctccacagttttgttttagattcatgtacatattgatgattttgtacattatctctgcaatgtgtaatttagcatgtagaaaagtaattgagattgctaaggatcacaatgcacaacatcccaactgatacgaataatttgtgtgtcccttttatccagaaaaaataccagtgtaaactaatgtgaaggaagaatggcatgttgaacttcgttagtaatatggtatcgatttccttggtcgctactttgttgtcctaggtaaattgttatacatgctcggtgtctgtatgaagtgcatggcaatgcatccggaagcatcagctgtcgccccatgtcttcttgatatgatcagatctaggtatgccaagcctaaacaaacatttccctgttaaggaattttattggtaagttaccattttgacatcaaattttgttctatacagctgtttcacaacatcctgaagcatcagaaggtctgtgttgtttgcagctttttgcatattgatagtgctgcacccattgtatgtctcatcagctcttatagaaggaaatcgggacatttcaactggtttggaattgatacacatatgggctcttcatgttgcagaagctgatcctgatacagaatgaatatcagtatgtactttggtcactatggggggatatatctgttatgaatcaccgatttgcattttgttcgtcaaagtagagcaattatagtacaataggctcagcacataatactaatagggtcatttttgaaccaacaaagaagtacagttgttcagggtaaacgttatatcaaattcatttgcatcgtctttgattttaacctgaaagaagagtattttcactgtgagataattcactatctgaaaataaagagctaataactcccaccttatgctttagtttcctgtaacgtacttctttctatcattccatttggtcttctattatactcaaccagtgatccagctcttttcagtaatgtgtagagtaaaaccagactagttttttgttcaactcataattagaaaaccatttcagtacactggaaactcagtaacttctcacattgtcatctaactcttccattgtcatgtttgtctccttgcaggcatcatgacctgtttgcaactctgttccgagatcttcagacatcatgagcactgaatcagtggatcgcagcatggccaggaactgcaggtctctgccttttaagcttgataccatcaaaatgatcaatgtactggactagatatataaatcgattgatgtatttggtttcggagtgctagatttttcgtcattcatacatagaacatgaattgatttacgtgaaacaatttatgtaagtcttctgttccagattactactatgtttgaaaactttgaactgattagttgagcaaaagaaaatttacctgtggatgggtcatgcagggcgagaggaggaggaggagggcgtgtgctccatggggaccaccagccacagaacggggcactcctggagcgttggatcagctgcgagggacaatccgacggccgagatgcgtccagtgcaggtatttaagcgcaatgctgcttctccttgcgcggtttgctgcacaaccactttctgcttctccctccctcacaggctcacgcattctcatctcaagagcactagtggcgaaagataaagggcaaatgttatatccaattccgtctgcatcgcctttgattttagcctgaaagaactaataatttcactgtgatatgattcacaatctgaaaatgaaagagctaatatcactcatcatatgctttaattttcagtaacctactccctcctctcattcctttaatctaatgttatactcattcagtgatccagctctttcagcaatctgtaaagaaaagagatcttcaaacgagtagattaacaaaagcgtaaagtgtctagagtttttggaggcgtcaccctaaggtggccgtttttcttttcttttggggggcgttagctgcggctagcaccctgctcgactgtctaaggtcgattctgtaaccttcgtgacaccctctttcttcttaatacaatttgggcgacctctttcggctgtcccggcaaatctgtaaagaaaaacaggacctctttttaccttataaagagaaaccaatccactaagctggaaacgcaataacttttaacactgccatctaactccattggcatgtttgtcttgtagatggctatgagctgcatgcggctccattctgagatggcccttcagacatcacgagcactggaatcggcggatcacagcaagaccagcagcagcagcagcagcagcaggtctctctaccttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12418 - DNA, 645 bp, Oryza sativa
cagttccttgtgcttggcttccaagcggatgctcttgtccaccagacgttggaaatccggatagtccccagagactagacggacggacagctcggggtccattcctgccaggaacttctcttgcttctcctcatcttcccgcacatcctccggagcgtaacgggccaggttgttgaactcatgcaaatactccatcacggagcggttgccttgcttcaactctcggaattcccttttcttgagggccacgactccggcgagcacatgggttctccggaaagcggcggtgaagcgagcccatgtaataggctgtccctctggctgcgtagcttggaagtggtcccaccatagagatgcgggtccctgcagctggtgggcggcgaagatgactttctcttcatcactgcactgcacagtgtccagcttcttccccacggcatgcaaccaatccaacgcatccacggggttgttggagctagagaaggtaggtgggcggatgcggaggaactcggcgagtttagagtgttggggaggtggaggtggaacattctgttgtggcggatttgtgaggtggtggaggaaagtagtcatcatgttggcttgctgggcgaggatttgggtgagaatggcgttggtgtctggtgg

SEQ ID NO: 12419 - DNA, 967 bp, Oryza sativa
ggcacttttcttcatgacgatcatgactaatctgggcataaaaaggagcattcccaacaggaatgacaaaggacatcgtacgcaactactggacaaaaccttcaactcaaaacaggtactcaggcttgtaacacggcatctaaagacaagtgaaaggagagagttaagacatctatccaattaatagcacaagtttttggattaatttgaataaagtttgaaaatcaaagtaaaaaggtaagtaattaaagtaaaccaagctttgcgaaataaattaaaacagttggaaacgagatcataaattttgtaattttgaataactggtttcaaaagaaatgaaagaaaattataaaatcaacatggtaaatttattttattgcagcaagattaaataaaacaatattgtaaaacttttgctgataaatgagccattagtacagtaatagatgtacagtactaataacactggaataaatttttaatgagaaccaaaaaaaaattatgaagtgcatgtgccattagtttggttaattaaaagagaaagggaggagaacagttctacttttccaatatttttagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgtagacggctccactccacaggcagcttgaccaaggctacacctaattctccacaccatcagcctcattgtagaactctttctctgatgaatgattgcacggtgagtatatgacatactcagc

SEQ ID NO: 12420 - DNA, 740 bp, Oryza sativa
tatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgag

SEQ ID NO: 12421 - DNA, 625 bp, Oryza sativa
ccacaataaaccacaattcaaagtgcccaggtgatatgatattcccaaagtctaaagttgtaaaaccacctaatgttacctaattaaattgcgaagcatctacctaaaatcatactagtgataccacgagtagagtgtccactagttggggttttgtttaatctagggtgaacaaggtaataataacaatagcaataataatagggtcataacaaaggtaaataggcatggctaaataaaacagtgataacgcgggaatttaaataaagcgataatgcaataatttaaatcaacataagtttataaactgggattcaatatgatcaagatgatgtgtcttgccttgctcgctttcccaaacaccgtcttcaacttccacgaagagcggatcttccgaagctacagcgtctacacgaccaacggaaaagaaaaggctcaaactgtcacgtcctgataaattcatcccaaaataaaaatcattttcaaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaa

SEQ ID NO: 12422 - DNA, 10915 bp, Oryza sativa
acggacgttccgaaaggctcgctacaaaggctctacagcggacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccccccacgctgatcttcccgggtcagaggtgctgacgagggagtggcagccgaacggcgagcaacagccgccgctcgccgcgccctccgctttgacgacacggagccggtggtagcagcgccagaggtcttggtggcggaggaccgcccaccaacacctaggtgctgccgtgccgtcatgaccaagttggctacgtcatccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagagcttgtgcgcttttgcttgtttagccattgggctgaacaggaaaagcttggcgcacacgaaagagtatgagagcttagaaaaacacacgcagaaccccctacatggcgcgtcagatgacggagcgtggggctcctcaccgggagaccgcgcaggtccccctttgccggttcggccgggggccctgggtgaggttctaagctcctagtctgtggaatgttcgcgaaagtggaaacacacaagacacgggcaatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccaacgacatgaccagtgtcagaccggtcacaaatcggtcattcttgtccaccacgcgtcagtttatcaatcttgcatgttcacccttcttcatacaatgtcttgcttgtaacggttgggatgaagcctggcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagtggtccgatccctcggggagacaaagagaggggcggcctcatcaccttcgggcccgacccccccgagggggtcaggccacgtgggtgattgctcctgcccaaacctctagtcatgatactcccggtcccatgtcaccgacatcatgcttcccgaagaaaccatgatgaatttatcatggttacaacagaaacatccacatctacataatggtagtactagtattgttctattctgcacgtattacattctgtgtgcggaactcaacacgtactgctcgagtacaatttctgagcagaggacagggaaatgaaaagaatgcctaccaggtatagttaagttaagggtgtgtttagttcacgtcaaaattggaagtttggttgaaattgaaacgatatgacggaaaagttgtaagtttgtgtgtgtaggaacgttttgatgtgatgaaaaagttgaaagtttgaagaaaaagtttagaactaaacaagggttaagaagaaataaaataaaactatgaatatatctgctagtattgtacagttatgctacgagatgttgaattcaaatctcacatactattatttttttttacttagtatgcatctttactacatgttgtttcaattggtactaattaaacatcaaaaagtttagtctcgattactagtctcgaacaggtattaaagatcgtttctcgtgcatgagcaataaaaactgatataacaagaggaagctccacgagaaaagcaaagaagacggaaagagaatctcatatcacctgtgccatggattgatgtcacaaaatcgccgttgttcgctctgaatcgcccgttgacaacctgatttatcgatcagggctgtcgagagggatttatatgcgagctcaacattgtttcgattttccgattaccgcggacggaaatttgtccaccgcgtgtggatccggtaacgggcttcatcggggcttgcttcgatggacggtcaataggagcgggagtatgtactccctaggagtacccattttcatatatatactgtactcgaaaaattggctttgagttgaacctgactcttattttgttcttctggattttaatattttgtaaactattttctcaaagataatttaccaagttgagctatcattcatagcaagatctctcgctgcaacacccagggtccttttagagaaaattgcaatattgggacaacaaacattagggcttcgctgtcttgacactccgagtggatgacaaatgggtccatatgtgtctatgaaatatgtgtccagtatcattatagcaaaggtcaatgtttgcagtgtcattattgcaaatctcccgtcatttttaccccgtttcatagaaaaatattatatcttatgaaattaaatcttataaaattaatagacgagatatagctacattggtgtacatctttaatgcatgccatccaattttagattaccatattactttcgaacgaatggagtaagaaatgctcatctggttggcatcaatattttaggcgactggtgatatggaagatgttctccggggttgattacagccgtagttcctcgttccatgtcgtagacacacagcgctttcccattgaaccccgagtagtagatacagttccctctcaagcctgttgtccgtgcatcaagtgacgctccaaaacagcctatctgaacgaagaacactctgccacctagcgaatccaccttcacccacgctgatctttgctcctgcgtcgtcgccatgctcagcctgtaaacgccaacaccagcgacaatccgatcacatccaatcgggtgagagaagagaatggagtgcagctccccgttcgattccacaaagatgctggtacgtttcatgtacaccgccggcctcctgtcgtcgtcgtctacggcggtcacggtgaacgccggctccagtgagaactcgaggacggcgacatggtcgatgagatcggtgtagaactcgccgtccatcgccgtgagctggcgtaacgccaggatgacgatgccgcggtgctcgtggtgaggcggcccaggctggaggtactggtgctgatgcctcttcacccagtggttgtcgccggggcggcaataccagagcaccgtgtcggcgtggtcgatgacgagcacgacgcagctggccgggtccatgggaccgcagcacgagaggaggcacctccggcgatggctgctgccttcggcggcgaggacggtgccgtcgtggtcggggggcagcccgacacggcggccggtgaaagggtcccacaggaaagtgcacggcgagccgcggcgcgccatgagcagccagccctgcgccgtggtccaccaccggtggcctctcatcatgtcgtcgacgccgccgtcgcccaccctccttggcagcagtgctctcgccggcacgctgtacagggacgtggcgtcgccgtggccgaacagaagcagaggagcaagcttgggatccagtactgctgcagatgcatcgcctgcctcctccatgattttgatggccgactgtcccacaggtaggatacggccggtcaattgaaaacgaacgaatttggcggtgctttataaacgaggagaggctttgagcagtgcaattactggcatataggaaagagaagcgaagaaatctgcacgcctacgacctacgattactagtaccaattaggacatgaattcctacacgacatcaaaattcaaacaaattatagtactagtactttgggccggtaaatcagtaaaaggaaacagtaatctgggccggggataaagagggatcaccacatatgcatctatggagattggatagcaaccaacaaaaaccaaccgtgccgggtatacaaactacaagcagaagcggaagccgacctatatatgagtccggaggaaacacgtcaagaaagcagagctccgtagcagcacaaaacgcagcgcgccaagcaggccattgcggtgcacgaaccctcgagattcgccaagcagatagatggaggccactgcgacggcggcgcagggactacgggactggtcgtctctcccgttggacatgctcgtgctcgtcctggatcggctcgggtggtcgacccacccgagcttcgcattgacgtgccggcactggcgctccgccgtgtcgcccttctacccggcgtggatcacgcctctcctcctgagcgccgccgacatcggcgtcacgaacgtcaggtactacagcccctactaccacaggtgtttcgagatcgccgacacgctcctcaaggtgcccaaaattgcggctaggatctgctgctccagtggacaacacctcacgctgtgtctacctagattgatcctccaagccgatctcgtagccggcaccatgtatgagctgccagagatgcctttctattcattcgagtttattgtctacgatgagcacgcgcggaggatgtattgcgtcaacacgacgtacgcgctacagctcgcccgtgcgacccaacaagacgacggcgagtgggggccctgggaattaacggactttgacgtggaaggaccgcaacttctggcggcgccgatcagcaacccggtgctccatggtggtttgttgtatgttcttggtgaagacgggaagatggcggtgtatgatccatgcaaccacgacaataattttacagttcccgataaacctaagggctttggaatcaaacaccaagttgatagccacctgtttgagtccgaccaaggcgcgctcatggctgtcctcgtcggctacagtggtgcgcctatccatgtcgtcaagctcaacgaagagacgatggagtgggagaagatgcggtcattggaaggacatgcgttgttcaccgggacatacacgacaatgttgaggaagactaagcttagattgatgcaaaacaaggtgttcctcccgaggctgtatgactggcctgagactatccatgtcgacattgttacacgtgatggcgaaacagcatttgtaccaaagtcatccagttcgtctaacaccaaggagatcacctcggacataaatatttggttctacgagtttgggcagcaagacgcaagagagttttggggatcggagagagtagattatagtatttgggttgattttagtactaattgacacaaattgacgttgttagctcttatattttcatatagtgaatcatctcacaatgaagttactcttctttcaggccaaaatcaaaatcgacgcaaatgaaatttgatataatatttctttgttggttgaaacatggcgctattaatattatgcactcagccaatgcaatttttgcatgaattgatattgatatttgtgcacagtaatttatgaggatttaagggaataataaaattataggcttggatgattttctcggaaaatttgaatttttttgggagggaaggatttagggtttgggtgattcacaaggatttaggcaagttttgaatttcaaaattcgaaccttgggatttgtaatggaactttgggatgaagtttttgggatatcaaggagagacccaccgagatcttttggcacacttaagtccttgaggatacagaaagatctaaaatttttgcaattaggatttcgttttatacaaaataagttagaaaaataattcattcgactgtgagttgctgaagatatggtggtgttatcggaagacttgaccgaatagccatcactgctaaatggtggcatggatctacttaatccacaaatagactttcccattaaaccaaccatatgactgattactcccttcatttcaccaacatccattatccaatgcatgaatcgatttaaaaccaaaacgtatcacatagagctagaagaatgaggaaaacttcaccaaaagcaaagtagttaacgtacaggtgcaagtagttaacgtacagtatcaatgatactggttggtgacgttggctttcatcatatacttggttatcttcttcttcgccttcttgtcttccgactcacacgtcttagcgtgagccagaagtgggtttctcgccctggccgaagaaggttcaagaagaatcttcttgtagccttttccgcagatccaacacttctttgggtcgaattcctcctgctgacgcacggccacctgatggcccgttgcagtggcatcgagggcgacctcgtcggactcgatgactgcgccgagagaaggtttgggagcgccgtcgtcagcgtcggcattggcgctggagttgggatcgaccttgtcgtcggctgcgacagtgccagtgggatcgacctcatccgtgacggtgttgttggcgctgggagtggggacgagctcgccgctctcagccctggcactgccgctggtgtcagccgtggcgctggagtcggccatgacgccctcgtcgcttgtgtcgctggcaccagccggcgcagcactggtgctggcaatgttagagacggcagtgccaaatccagcgggatccaccagctggtactggaaggcgccgggcttgaactgaaccaggatgacggtagtgttctcgcccgatgccaagccgaactcaacaacctcctcacagatgacacgcagctctgcaccctcctgcatagcaatattaattggtcacagcattattggtaacagcagttttaacagcgaaagaatcgaagtcaaagcagatggcagtttgtcagccaggcatgcatattcagtgctaaactaacaaatggttttgtgaggtttagggcttacacagtttttttttaaaagaaaagagaaaatcaggatatttacattgcttgattgaagtcatttcctagaacagatagcatgattaacaccactaagatatcttgtcctgccaagaagacaaactgagggaaagaaaagactcacccccgataaacggtcatgtatgtaagaaaccacgtccgcactgtccacgcaagacctgcagggggaaaatatacagtagtcaatgcaattagtatggaactatgagtgaaactatatatgaaccaaataggaggaaaaaaaaaaaagagaatgccaatgagtactggtgacataaaaatgatccaatagttattgacaggtattttttgctgaagagttaccacttaccagagaccttgacttgcaataacaagaaactccatgtcatcagttatgtcatcctgacattgaaagggcaattttccatcagatcccaacccggcaaaactgaacttcatattctaccaaacggacctatttacacttagttacacttacagcgaggatgtccggatcacataccagcatttgtttttcacgatctaaatctttgttcttcttgaaagcaaagtcacctgaaatgtaagtaggtaaaacgccaatcacagtgtaatgtgcttctttttgtgctattacatgcaatcaatgaaaaacagatccagacaagactataccaattgatcttgagattgttacacctcccccaaaatcaccgaggacccattgttccttgactacataattccccattacttgttcacacctaagtccaagagatctccctcctgcattttgaactctctctctttcagactcagttcttgtgcatggtttgtgatcgaaggataaatcaatagcctattgacaaaatggaaacaagcacaaatgttaggcgccacaatgaacgagcttgcaaattaggtattaaccagaaattcaatagggaaacaatcactataccaggccaccctgtcttgagagtacgcaacgagaatcaccaacatgtccaacaatcatttggttacctctgatgacaaccacacatgctgtgctcccttcatacgctggcccagtatatgtcgcctgggaaaacaacaaccaaactgaagtatataacacagaatcacaacattgttagaaggaaaagactaccaaaaaatagctcaagaaagccaacaggtatagaaaaacatttctgaaaaccaaaccaatgtatgaaagaaataaccatcgaagggatatcgcaaacaatacctcaatttggatagcatagtatgataagaaccaaggtgcaatgagaacttaagaacctgttggcctccaactcagtaaaccagccaattgatatgtaactaattgaaccttttttaataggagcaattagtcgagattagggttaaacatatctcctccaactccaaagtacatcacaagaaagaacaacagtctcgatatcaaacacattcttccatttcctttttcatagatacaatatgcacactgtccaacaaatacaattttgagtaacttcttcacgatatgaatatttgaggatgctaggggttaaaagattactacctgtgggaaaggcttagcacagacaccagccttgagaaaatacatacatccattatcatgaggaataactaactctctccaagcatcggactgttgcaggttctcatccatgctgcagcaatcacacgaacaatgatatcccacatttccaagtgcagctataaacaaaattatgtaaagtaggccaaaataaccttaaaaacacattgtccagtgcattaatcagatcgttgtgatagtcttcatgattgcatagctcaatgtgaaattgttttgcgcaatacaatgctacttcagctcctgagatagaaaaaaacaattcagtatggcgtctcgctcaatacgatggatcaagattacttctattgcatagaagcttataaatcaaaacactgttgtgaacattagtagcagaacaacacttgaataggcatcattaaaaaaaaactaacctgttaatctgtaattatcctctaaattatcatcaccatttatattactagtaactcatattcatgcagtgttttatctctcatgaattaaaatttctttttatgtagttcatgttatccttgcaagcatgccacacgaatgtgattactgattagctaacttgttcattatccataactgtagcatcatatttatttgaaaattgacaggtaaatgtttcaacatataccacaaagttttcaaaacatgcgcagagataaacaaagtgatacacacagacaaacatagcatgacataacagttacgccaacaatttggagggtttgaaattaaaaaaaaaatgagaatgaaagcaaacctccatggccatcataaacaccaaagaaagacgtggacgtggcatcatcaagatttagaatagctgcatgctagagaatatagagggcatatgtcagtcacagtattttgcagaactgtccctttttttttcatacaaaaggctgcaagtttactcacagcatcttccattttctcaccccatccttgcatagacgacacaacatacttaattctgtcattctcttcttcaaaagtgaacttcgattctacaggaaggctgttacccatagcggaacttgctttgctgaaaatttaacatgaatacaaatataaaataacattattaacaaaaacggggaaagacacttaaacaataatacagatcaattaaatgccagaaagctaggttacatatgaaataaagtgaagtagaatcatcaaacttgatatggcactacttatctagctcaaagcacagggtgtaattggtgctttcattcagggcccttaaatgcttaaatgcatttttgagatatataacatggaagtatcaatcttcagttgcagtgctgcattattttacacctaaatcttattttattactgcgaacaaaatacacacaaggttttctacaaacgcgatataagctttactgacacatatcataacaccaaatttcaaagtgagataagaagaggaaacgagcgcataaagtgtactgtacaagaatgatcgatttcctttagatatggcactgcttcggcgaatcaaaacttaaacaattgccaacaaagaatgaagaacagaagaaaaaaagcaagaccaccctaacagtacagtggggcacggaacaccatcacagagaagtgaaaaacgggttacagacaaaaaatgcacaatatctgggtaagggagaaggaagccaaatcaagattcag

SEQ ID NO: 12423 - DNA, 32814 bp, Oryza sativa
agcatcgagtaaacaaagccccaataggacagagagttctttcgaggcagaaaacagagagacgtgtagagaagaagcatcctgcatattgcatcaggagcagcgaaatgaacagaagaaggcatctagctaatacaaattcagaaactggcacttccgcagcataccaaaacagaacaaactgaaaagagaaacgaattgatgtggtttaatttctcgagcttgcactggtagaaatagagaaacggaaggcaagatcaagaccaaatagagaaacggaaggcaagatcaagactaacatgttccgaggagaggcgaacgagatcaccatgaagcttccgtgctcttcaacctcctccaagaaactcacacacccaacttcaaaagcatcaagcaacaacaacacgggaaagggaagccaagaacaggaggaaaaaaatgatcacggccaggtaaaatcttagcaaatttcggattccgaaacgccttaaaattcgagaagagaacgaggcgccgttctacttgatcaatacgtaaggaagacgggcagattgcatcaggaacagcaaaaagaataagaagagggcatttggtttatacaaattcagaaactgacacctccgcaacacaccaactgcaaaacaggagccaaaaaaaaaaacaaagcagagaagagaaacgaattcatggcgtctaacttctcgcgcacgcattggtcgcgccaggaaccgtcaagatcaacgtgctccgatgggagagaggcgaacggagaccaaccatgaagcttcggtgctcgtcgacctcctcatccaactccgagaaaaccacgcctcaaatgcatcaagcaacaacatcacgggtacgggaagcgaagaacacgaaaaaagaggaccagaccgcggtaaacaggaaccaaccaagacgcagggtgctgctcgattcagcgaagacaagaacgagagaaaccgcgacaccaaacactccaagcaaacaaacaccaccaccaatggagcaagatcgaagaagagtagggagaagaatctcacggcgctttcggagaagaagtagggtttagggatggaggcggcggatgaaaccacagaggagaggaggatgaagtgagagagagatctcacctctcacctttgccgctgctcttgagacgcgagagagagagagatgcggaaaagtggttgtgctgcgaagcgcaaaaagttgtgcttaaatacctggaccggacgaatctcctccgtcggatcgtccctcgcggctgatccaacgctcgaggagtggccccatcctgtggctggtggtccccacggatacctcgcccctgcatgactcgtccaattctcttttactcatcatcatcaactattagtcagttcatcaatctgggtacaattttcatcaattctctttaatctggatcaggacaacttccatacaatctccacacgaatcgacaaaaattctagcattttcaaatcccagattaaaaaaccctgtaatatgacaatatcaagcctaatcagaattagctgacctggaatttctaatattacatggcaagataatatatgcttatttacaacttaatctagtacatcgatcacatcatgttggcaaatggtatgatgatgttatcaagcttagaaggtagcgacctgctgctgctgctgctggccttgctgtgatccgccgattccagtgctcgtgatgtctgaagggccatctcagaatgaagccgcaggcaggtcatagccatcttgaagacaaacatgccaatgggaggagttagatgacagtgtgaaaagttactgagtttccagcttatactgaattgggctcttttaagtaaaactggttccagcttaaagtaaaagtaaaaaaattggtccctgtttttcgttacaaattgctgaaaagagctgggtcactgaatttgtatactgaaggaatgagagaaatgagtaggttacagaaaactaaagcatataagggtaggttactgaaatgattaggcgatgcagacaaactttgatacaaaaccagcataactgtactcctttgttcgtcaaaaaatgacctattattattgtgtgtggttttaagaaacaaatgtcatcctattataccataattgctctctacgtcgacgaacaaaacacgaacaagtgatcgataacagatatagaccagagtacttactgatgagcattctgtatcaggatctgtttctgcaacatgaagagcccatgtgcgtatccattccaaaccagtagaaacatcctgatttccttctataagagatgatgcaacatacgacggatgcagcgctatcagtatgcaagaagctgcaaacaacacagacctcctgacgtatgcttcgggatgttgcgaaacagccctgcagaaacaaaatccaatgtcaaaatcgtaccacttggttataactaagaaagtctttaacacggaaatgcttgttttaggcttggcatacctagatctgatcatatcaagaagagctggggcaacagctgatgcttctggatgcattgccatgcacttcatacagacaccaagcatgtatatcaatttacctaggacaacaaagtcccgattgagcaagtcaacaccatgtgatcttttatcatatccttgcataacagggagcataaaagcagcagcatataaaggaaatctgttttttgaccactctgtctgcaaatctttagcttttccaagaccccatttacgagattttcctgatttaacttgaccagatctagatggaacttctctttcataccggtgtgaccaattcagaagtgttcctgattctgagacttccctccaaggacctgcaccagcaggtccctgatcactaggaactagccaagagggagaggtgtcggatatcaagtttccatgccgcagctctctccttacaattttagtttccgcaagctcctgtgcagcctcagtcataacatcaataatcaaaatgcgctgacttacatccacgcttgatgagtacagcaacttggtgagaacatctaatgattcaaatgtgcaggttaccagcaaggcaactaatgccttctgtctcttttcttcagcagaatcttcctctccttccattgccacgtcagaacatcgaacatgcacaagtgctctaacaagatcacctgagttgtggcgtagttcatcaggtgatgctctcacaagcttttcggcagaactcagagcgttttcaaccttgggtaaaaaagaagggaggatgatcaggattttacaataatttgctctggaaagtacaggtagcactagatagaaacttacaccgtctggatcatcaggttttcgtagtgcagcagcaagatcttttaattgggtgaatttcttctgcaaatctgagtcatcgtctgacagatcatatggctccagggatgaatcactggaggcatcaatgttcattatttcctcatcacattcttcctcttcgaaatgcccattcacagcagaaccagacgtttcacaagaatctagtgatttgatctcaatgatttttgccctgttctctgaagtatcatgtttaatagcctttgcccttctctcaccagcatgtttcttgttctcaggcaaagatggtttcagtttgcttataagttctacatcctttgaaggggctgtgatttccttcggagataaaaccccaaagtcccactcaacattctcacaacagttatcatcaaggtatagaggattgtttggatcaacaactttagaaaatgtcaatgcaatagcactggccatcttccggattaaatcaattggactctctaacctacctacagcaaaagagcattcagtattaccataataataatatgataagctaatgcagggggggtggggggggatactcacagcttacaccttcaagaatattgttcaatacatctttagttgtttctaattctctttttgacatcttctccaaacacaacccaattgctgcagtgatgtctgagtgttgtttaaggggaacaagtcaaatgataatttgcaaataaaaagtgtgtaatgtaatacagttttgagtgcctcaaaggatacaagcttgttgctccactgagtatgcctggacaaactctttcttggaccaaacactgactaaagtttgcagtgtaccaaggaagctcgatgtcctttgcttctgtgtttctatgcctgaatttggtggcaattcaaagacagcatagtgaagaatccatctcagacaacatagagggaatgttttccaacgcaaaaatttgtcaacaaacattgccctgaagaaagcacagagaattaaaggatgaaagaaaagaaaagaaaagacacgttgaagattatttgatcaatcgctgcatgccaattatacgctgaatagacacccataatataagcccatgctgaaagttaagtaaacatacatggcaccctgtttgtcgttcataggaatgaagtaacaaagacatacagggtatctgaagactatcattcaccttacctaaaacatccactaactgaaaaaaataaacctcagaagtactttttccttcacagataaatgtagcatgccagacacagatgaaccaatgtggataaactaaaaaacaagcacgtcaagtgttgcatagtattaaaatgcgcacatgtactatctcattctcacctcaaaaacagttttgtgcatgaagctctgattaaacaaagtccacagaatccagtatgcctcctcatcgcttgtatgttgtgatgcaagttggcgcaacatctcttccgccaacctttcaacagaatgctggtctctaatagcctcaaccacattaaaccaaaattgggaaacatgcttgatcttgtcaggacttatggttttatgatcagattccatacatctctttaagtgactacggatcctaggaatcagctcagcaactaaaatgcctgaaaagagcaagatatattatcagaaatacaacaaatagtagggaaaaggatggctacatagattacaaacaagaagttgttaatgactagaacagtgtgctaggatgatcagccatgacatgaggcactgctatcctgggtgacatctcaagcattgcagaccccaagtctactgtgattgccaaaagtgaacactggataaaaacccaaaaacaggctaccttaaatgtttaaaatttcagctgaagggactattagtggaccatcagagaaaaccaaatgtgtaccactgtgttgtattagtttgcataaggattaaagattatatgaggacaaaaaaggatctgctccatcaccctagtagcagaccatcgcaaacataaatgttgagttgaatacactataatcctaccagacacaaatgcattgctaaaccattactgcaccaactagaactgcccccattagtaaatagaaatgtctaaacagataaactaacagcacactgcacacgtcaagctacatcctgaaggatgaatactcaccagtagatccacgacggctaacacgagatatcacttcacccacgaagaggaacacagaattggaggcatctagtccattagcatcttcgccagcagccaactccatagccgcttgttcagttgcaacaagaagctgatcgacaacacacttgaagaatgaccttggtttccatcaaggacttacagtttggaggaacaaacatagtgcaaataaatacatattagctgagaaaaagctaacagaataaaaggaaaggaaaaaaataacaaagatgtttgtgtttgtgtgtgtcgtgtttggggcggtgggggtgaggatacgatgatgtcagtgcaggtgaagctcccattcttgttttatctggaacagatgcaagtagttgagcaacccttgaaatgaaagctgctctgcctgggttcaagttgtcatcatcgtgcttgctgcttacagtaaactctgcaataatctggctgacccccttattctcgaccaaacatagaattaacagcctgaaatggggggaaataatgacacaccaagctcaaaacatagttatcgggtgagaaaaaaggaagataccagataggaacagacccatgaattttcagatgaagtgtgcatgctagattgtttgatttcctaatgactcgagcataaaatagacttaagaatacaaagcagacgattggacaaatacatgatattagtacagacccatgtagtcgaagtgttgaaacttgaaattttgtcctacaaggtttgggtgtaatatttgaagttttgaactcacagggaattgtcaaaaagaaggatgtgctatagacttatagtaaaagcaaacaaagttggaccaataaaagattcaggtgtaaacttaatagaattgatagattgttcatgaataacctttcaatatttgaacacataatgttatgatcttccttagagcctcctttgtgagacaaagcaggaacaagagcttgaatgacttcagttggaggtcctttgacaaaaaacgaatcatatatttccttccttgcagaggcacggatctgacgtaaccacttcaaggcaacatctggacaaccaaagtgtgagaatgggattataactgaaggaactttgcaactgacctaactgtgatgaacaatcaagaagttttgagtgtatagtaatcaaattgtagagatcgataaacaatacaaatgaagtatgacttgtatgactggcagataacattataagcaaacaggagagttgtacatgtaaagaatatcaatggtacaaagtatatatgcagtgatagattcaagagtaaacttacggccaagcaaaatcttagatatagtaggaaatgctggaccatggtaaaaagcatgcctccaagatccccgttcatcattgctgaggcttacgccattaattatctgaaagtacagaaaataattctccctgttacatcatggcctaaaaggatggaactccaattggctatttggctgaatcatattgaaggaagcatgtgtctttgaatatccatactaatttatctctcaagcatgaaacatgatcttctgtattctgaatgcattatcaaatgacacaggttttacaaaatgtgtgctgctacagctcacctagcaaggtcctgcaattcgattacccattgtgtgaccaaagttataggtttatcaactggaaaattctgtggatgcttatcaatccagtttcggagtaattccttccagagatcaatttcctcaaatatatgcaccacaattatgacattacagcggctgaaacattgtccacataaccaatagttcactatgatatcttaatgctccatttctattttttgtggcagaattactgctccatttcggcatacagtcctttgtgattgcaggtcaaaacaaaaactcaagacttccccattttttttatcacagaccccttccatgattattagaaatcacacatcattgtttatgccagaaccaaaaatagcaaatgataaaactactagtaatttttctcagatggacgaaataaaaggcctaaaattagcacagagcttcacctggctcctgaagggttcgtccacggtacctacaagagaggccatcagacaccccaagtgacggcgaatgagataaatgggaatagggagcatgtcggattaggattcggagcctcaccggctacggcagcggagtcgacggggaagacgagggcggcgacggcgtggatcgcgcggacgacctcgccggcgctcgacgcggcggcgaccgcgtcggccgcctccgccaccttgtccagtgctaggtcttcgaggcgcgcgccaccatggccgccgccctgggagcccgcagccctcgccgcggagctgcttgggttgctcgccatgggagggtgaagggaaacacacgacgaacctaagagagagcgcttgagaaggggaggttttggagcaagagtaattagggggttttgtttggaggagaaataacagttttacccggcttgactgccgttggctaagataaaattttggggtatgtttgagaatatcaaaatttgcaaatgaacttttgttagagaagatgtgtttgagataccaaaaaaataattgaaggaattaagaatgtcgaatgtcaattgtacttttattcatgataccagtagtatattactcctattatttctaagtttttttataaggatagaattggagctgctaagagcaagtttaatagtatagccaactactagctctaaatcatctatagtcaatctactccttccttcccaaattgattttatacaccaaaaccaaggataatttaaatcacatcaatcaatacaacatacacacattctcccaccatgcatcgattaaaacctcatgccacttacaccatagcatgcacacattcttccatgctgtattaactgtattctgctgaaatccgtgtccatgcagttatatgatgatcaatttaagaatttttagattcttttacatgatgatcaatttgggaaggattgagtaatagtaattcatacaatagttaactagaaacatataccacactattaatatctggtcccacatgtcatactcacattgcctcttggagtccgtactacagctgactataaatctgtagcccactgcacttctctatcctcttttatctttttaaaatatgtctatagctggcttagagcaggtacaatagcataccattagttagctataaacatatttttatgagataaaaaatgaaaaagaatagcagcgggctacagatctgtagccagctgcagcacggactccaaaacacagtgtgtgtatgactggggccatatattaatagtatagtaagcaactattgtatgaatgagctattagattggctatggatgaattggagctagtagtggactatactattaaacttactcttatagtatgctattgtacctgctataaaactaacttgcttcttttcctcgatacagcaattaactaacttttctcagtagtcgaattatgcatcaaaagcggaaggagcgagtataaccaactgccaaatacgaagcatgagtgcatgattctctataagattcgaaaacaagctcgaactttcgaacgctttcattacaaccaagaaacatttcgatttcatattattgacatcatgtgacggagcgtggggctcctcaccgggagaccgcgcaggtccccctttgccggttcggccgggggccctgggtgaggttctaagctcctagtctgtggaatgttcgcgaaagtggaaacacacaagacacgggtgatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctagcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgcgccctaactccttgtttcctgtgccctaccctcgccacacgcgctcgctctcaaacatctcttcttccggcgtcatggcacggggctctgctccactcgatggtagcgtgctgccgctttcccgcatcgtgagcgagaggcaggccgggctgccgcgccgcttcctgccggaatctgccaccggccaggagatagttacgctgggcgagggacgcccggcgccacgctacccggggcggaccgttttcttcctccctttcgcaatggcagggctggttccgctattttcttctttcttcatggatgttctggagttttacgatctccagatggcgcacctcacccccaacgcggtaatgacattggccatcttcgcgcacttgtgcgagatgttcatcggggtgcgcccatcccttcggttgttccggtggttcttcaccgtacagccggtgtcgccgccgtcggtggttggtggctgctacttccagccgcgggggccggtgctgaaccgctagattccctgcgtcctccgcaagaagtgggatgactggaagagcgactggttctacacccccctcgccgacgaagcgcgcctccgacttccgaaccagcccccggcgcaggcctccagctggcgggcgccggtagatctgggagatggctacgacgccgtcctcgaccgcctggcgggcctgcgatcccaggggctcacaggggccatggtgtacggcgactaccttcgtcgccggatcgcaccactccagcggcgcgcccggggtgcctgggagtacaccgggtccgaggactgtatgaggacccaccggggggtcaaatgggactgggtccctgaagacttcaaggtaatgatccaacgggtgctgaatctcagctccgcggaggcatcgctcatcccccaaggagtcctccccctctgcagcgatccagatcgcgccaccatcctgaccatcatgaaggcggtcggggcctcagaggagcaggctcctcgaggccatgatggcgcgggcgggagctgcaggggagaacaatctaccccaggagggggtcgtgcttccgggctccgtgacgggggctcggggggctgccgccctgccgacgcccgagggaagaggaagcaagagggttcctcctccccatctcctccccgagggggcggggcggcgcgtgtcagcagcaggcgcccggagggggccgcgccgacgccgcagcccgagggggagcggaagaagaaacggcttcgcaagatggggggacagaaccatcccggggaaaccttatttcccctccaaggtagtcgtttaaccgaccccctcgcaggttcgtcccacgcccattgtggctgtattcattctcccaacgcgagttttcactcacccatcttgtttgtcttctggtctttcttctgtttcagcgagatctcgtcgcgtccctcccgccattccaagtccggccagtctgaggccgaggatacggcgaccgcggaggcccggaggcgagaatctgaccggcgagaagccgcggatcgcctacgggaagccgaggaggccgcccgggaggccgtccgggctcgccaggctgaagaagccgcttgggaggaagccagacttcgccaagccgaggcggcgacaacttccgaggcagctcgcgacgaggccgcgggcacatcgcttgggcccactccctcgggcaacactcaggacaagccaggtccgggggacgtccccgagcccggcacgtccatcggcgggccgggccgcgcggcatcctcaccgaggcggctctcccccacgccttccgttgccccattgagcgcagagccccttttgcaggccttggccgtcgcaaacaccacggtgttggacgggttaagtgcccagatggaggccctgcaagcagagcgggcggagctcgacgccgcatgggcgcgcgtcgaagaggggcgacactcggtggaggccatggtggaggtgagccgcaaggcacaccgccggcatgcctcagagctcgaagcccgtcggaaggtgctggaggagatcgccagggaggtggaggaggagcggggggctgccctcatcgccactaccgtgatgaacgaggcgcaggacgacctccgccttcaatacgggagctgggaggcggagctagggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgtcgtggagagggacctggcggaccgcgaggccgccgttgccattcgggaggtcacactggcggcgcacgaagccgcctgtgccgaagaagaatccgcactccgcctccgcgaggatgcgctcaccgagcgggagcgagccctcgaggaggccgaggccgcagcgcaaaggctggcggagagcgcgtccctccgcgaagctgcgcaagaggaacaagcgcgtcgcaatctggaaggtgcccgcgccgagagggccgcactgaaccaacgggccgctgaactcgaggcgcaggcaagggagctggatgcaagggcgcgtagcggtggggcggccacgggcgacagcgacttagccgcccgcctcgcagctgccgaacacaccatcgcggatctgcagggcgcgctgaattcgtccaccggggaggtcgaggcccttcgtctggcaggcgagatagggcccagcatgcttcgcgacgccgtgtcccgtttagaccgcgccgggcggcaggcgggtctctggggcgggcggactgcgaagtacgccgccaaccaggggggcctcgcccagcgcctctcggagatggccgggactctccaacggctccccgaggagctcgagaggacgattaagtcatcctcgagggaccttgcccgaggagcggtggagctcgtactggcgagttaccaggccagggaccccgacttctccccatggatggcgctggacgagttccctcccgggactgaggacggcgcgcgcgcgcgggtccaggacgccgccaaccatatcgttcacagcttcgagggttcggcccctcggctcgcgttcgccctcagctccgacgaggagggcgatgacggcggtgtgggcgacagtggcgacgaggctggcgacccgggtgcatcggagtgagcctccaggtccccgccaatctttaaatagttttttcttcttttctttcttccgaagccttcgggcctcctttttgtatagattaacttactctgcaatcaaaataaagaaatttctgtgtcaatttcattttactgtgtgtatgagaacgaggatgatctgtgccatggtccttttgtgtcttagctcgaacaagggctcgtgcccaggtcccagtcctcaaatggctcgggtcggggctagtgcctggggagatccacgtgtcgagactggccaggccgggagcgtggtgaccgagggttatgggtgacccggttgtgggtttttgccgattcccccccggagttcaccacgccccggggcacggctcggttctgggccccttttggcgattttagccgactcgagcccccgagggcaggatcgagcacgagtgacctatttcaagtcaagattcttcaaaaggaaacaacagcacagacacagcctttaggaaatcgaaaatgcttttattgaaatacagatagaagagaaataagaatatgcatgtgtggtagcccccggccaaccctgcacgcccgaggggggtacggggttggcccgagcccgaaacctgacacccgaaccctattaggggtagaagcgacgaaggtgttcgatgttccacgggttaggcagctctgtgccgtcgcccgcggccagccgaacggagcccggccgggggacgctgatcactcgatacggaccctcccacattggtgagagcttgctcaatccagcacgcgtttggacgcggcgtaggacgaggtcgttgacgcagagtgatcgggcccggatgcggcgctgatggtagcgccgtaggctctgctggtagcgcgcggctcggagggccgcgcgccgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgatccacgaatcgccgtgcttcttgaggatgttgaaggtcttggttttaaggcctctgaggatttccgcattggcgcgctccacttggccattgcttctggggtgggcgggggaggcgaagcagagcttgatgcccatgtcttcgcagtgatcgccgaaaagttcactagtgaattgggtgccattatccgtaataatacggttaggcaccccaaaccgggctgtaatgcccttaatgaacttaagtgcggagtgcttatcgatcttgacgaccggataagcctcgggccacttagtgaacttgtcgatcgcgacatacagatactcaaacccgcccggggcctgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcactcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgcgggtcagagcaccggtactccatacagacctggttaacaccaggaggcggcggatccccagtccagctgccaccctaagtcccgcaaggagtccctcgtactctgccatattattggtcgcccgaaaatcgaggcgaaccaggtatctgaggatttctccgctcggcgaggtcaacgtgacccccgcaccggcgccctgaagagacagggagccgtcgaactgcatcacccagcgggcggtgtgaggcagctgcgaggggcccgagctggcctcggggagtgagacgggttcgggagccggggtccactctgccacaaaatcggcgagagcttggctcttgatagcgtgacgtggttcaaagtgcaaatcgaactcagaaagttcaattgcccatttcaccacccgtcctataccctctcgattatgcaagatttggccgagggggtaagacgtaaccaccgtgacccgatgcgcctggaaataatggcgcagtttcctcgaagccatcagaatagcataaagcatcttctgggcctgagggtatcgggtcttggcgtcccggagggcctcactaacaaagtagacgggccgctgcacctttcggtggggccgatcctcttcgccaggggccgcatccctggggcgctcttcgtccaagcggcctcgcggggcgcactcgtcttctgtgccgacgacctcggggtcggaggacgacaggcgcggccttcccacagtggcctcggggccgtcctgggggtcgggggctcctggcatcgtcggacaagcgggcaaagggccaactctggtcgtcgggggccttaggccaccgttcggctcgggggcctcttctccctgctctctcccgggtcgagtcggcacagggttaacctcgaggtcagagggcgataggtgcggccttcccgcagtggcccccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgccgcactaactacttgcggggtcgccgctaagtagagtagcaagggttcatctggctccggggcgatcaaaactgggggagagctgagatacgccttcaactgagtgagggcacgttcagcttcctccgtccaagtgaacggcccggagcgtttgaggagcttaaataagggtagcgccttctctcccagcctcgatatgaaccgacttagggcggccatgcaaccggtgacgcattgcacatccctaagcttgctgggggcgcatccgctctatagctcgtatcttctcggggttggcctcgatgcctcgggcagagaccaagaacccgagaagcttgcccgcaggtacaccgtacacgcacttatcggggttcagctttatgcgggcggagcggagactctcgaaagtttccgccagatctgaaagtaaagtttcttggtcgcgcgtcttcacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgtagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagtttgccattcgccttgggaacgaccaccgggttcgccagccactccggatggatgacctcgcggatgaatccggcctccagaagtcgcgccacctcctcgcggatgaaggcttgacgttccggggcctgccgccgcactttctgccggatcggccttgcgcccggccgtacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtagtcttggacgggccgtcacccagggcaacctccttgaccgggacctcgtcgcatgtgatcatccgctgcctcggggcggcgggaacggaggtgccaagcctctcgtcgccaccctcgggcttggacgcagcggcgaggtgatccgcgcgctgctccatacaagcaagcgcgactttgaggtcgccatggacagagatggggccaccggggcccggcatcttcatctgaaggtaagcgtaatggaccgccgccatgaacttcaccaacgcgggcctccctaggaccgcgttgtagggcagacttaggtccgccacatcgaagtttacccgctccgtgcggaagttgacggatccaccgaaggtgaccggtaggtcgatatgacctaacggccatgtgtgccccggcgtcacaccgataatcggctgggacggccagagcaccatccccggggccttgatggcgtcaaaggccacgggggaaaggatgttgagggctgcccccccccccccccccgtctatgaggacacgccccaacttcacgttgcaaacggtgggggaaaccaccatcgcgatctgtcctccccgggcaacacacggtgggtggtcggtctggtcgaaggtgagggcaacctccgaccaccgcgcccgacgcgtcgcctcatgagtgggggccgcggccagaagctctcgcttcatggccttaaggctccggcgagaaacgtgagcacacgctcccccatcgacagtggcaatggtggccccaggctcctgaaagcctaggtcatcatcgccgccatcgatgtcctcgacgggggccttctgcttggcctcacttcgccgattgccggagggtaccgccggggacttaccctctcggcgctcctgcctcctctcctcctcccactttctcgtccgctcagccaaacttttgactgcgcggcagtccgcgaggtcgtggagggaggtgttgtggacgatgcaccacttgccggttgggcgctccctgctgggagcgccggcctccttctttttgtcgctcgcaggcctcccctttcgggtggcccgcgaagcgccctcgacagtgaggacatgaccctcgtcgtcggaatgggctgacctcttcttcctcctcctgtcacgtcgccctgtctgagcagcggacccgggggcggccgaagttgccacaccggaaccggaggggttccaggtccaggcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtcccttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagttgaggttttgtttactctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatatgacttgccttgctcgctttcccaaccgacggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggctcgggcggctgacggccgggtcccacctggcagccgcgagggcgcgcccgaaggcggcctcgccggcacggccgaaggtagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggacgacggtgctccggcggtcggcgagcgaaacggaggcgcggacgaggtcgacgggaacgcggcgaagccgatggaggtgacgccgagtggggaggaagtccggagcgacggcggcggcgaaccggagcacggcggcgacggcggagagaaagtgcgacggtgcgggctcgattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcccgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcgaggatgtattttagagtcgttttgggacgtgacaaacctaccccccttaaacggaatctcgaccccgagattcggaagaactggcgaagagatcgggatgggctgccttcagctcgtcttcacgctcccaagtagctttttcttcggcgtgattgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaagacatttcttgagttgtgacacatggaacacatcatgcacgttgcccaaggaggcgggcagctccaactggtaagcgacttctccgcgccgagcaatgatacggaaaggacccacataccgaggtgcgagcttcccttttgtctggaacctatgtactcctcgcaatggcgtgacccgaaggtacacaaaatcatccactgcgaattccaggtcacggcgacggttatctgcataacttttctgccgggactgggccacctttagattatcccgaatggttctaactttagcttcagcttctctcaggatatcagtcccgaacacttggctttctccaacttggtcccacaatagcggtgtccggcatttgcgcccgtacaacgcttcataaggtgccatttgtatgctggcttgataactgttattgtaggagaactcggcataggggagactcttatcccaggtcttcccgaaatctaggacacatgcgcgaagcatatcttctaggatctgatttagacgctcggtctatccatctgtctgcgggtggtacgcggtgctgaaatttaatcgggtaccaaactcttcttggagcttcttccaaaagtgagaggtgaattggcttcccctatcagatacgattttcttgggaacgccatggagactcacgatcctagcgaagtagagctccgctagtttgttccctccataggtggtcttcacaggaataaatcgagctaccttggttaatcgatccacaactacccatatagaatcatatccaccttgggtctttggaagtccagtgatgaaatccatcccaatttcatcccatttccattcgggtacttggagtggttggagaagtccggccggtcgttggtgctctgccttgacacgctggcacacatcacacagggccacgaactctgcaatttcccgcttcatgctaacccaccagtatttctccttcaagtctaagtacatcttggtactgccagggtggattgaataaggactttcgtgagcttcctgaagtatcagctgtttaagttctctgctatctggaacgcatacccgatttccattccatagggttccgtgttcatcctctgtgaaaccagcggctttaccctgtttcatattcttgaggagtccatgcatgtccggatcattcttctgagcctcgcggatttgatcgagcaaggtgggcttggcttccaacgcagccaaaaatccacgaccaactatgtttaggttcagggcttccatctgttggttaagttcgggtggaatgccacggacgttaagagtgttgcaatggctctttcgacttagagcgtcggcaaccacgttggccttaccaggatgatagtgaattcccacatcataatccttgatgagttctaaccatctcctttgccgaagattcagatccgactgagtgaagatgtatttcagactcttatggtcggtatagatttcacagcgattcccaatgagatagtgccgccagatttttagagcatgaactactgcggctaattccaagtcatgtgtagggtagttgccttcatgaggtcgtagctgacgtgaggcataggctaccacatgaccatcctgcatgagcacgcaccccaatccttggcgcgaagcatcacaatacaccatgaagtccttgcgggtatccggcaagattaacactggcgaggaaaccagcttttccttgagagtttgaaacgccttctcgcattgcgggctccacacaaatttctcttctttcttcaacaactgtgtcatgggtcgagcgattttggagaagttctcgatgaatctccgatagtatcctgccaaacctaagaaactgcggacttgggtaactgtcttgggttgcttccaatcggtgacggcggtcactgtttcgggatccacagcaactccttttgcagatatcacgtgccctaagaatttgacttcggacaaccagaactcacacttgctaagcttggcatacaattgatgttcccgcaactttcccaacaccagacggagatggtgctgatggtcttcttctggttgtgagtatatcagaatgtcatcaatgaaaaccacaacaaacttatccaagtattccatgaacactttattcattaagttcatgaagaaggcaggagcattggtcaaaccgaacgacatcaccgtgaattcatacagcccgtatcgcgtggtgaatgcagtcttcggaatatcttcttcacgaatacgtaattggtgatatccggaacggagatcaatcttggagaatacagtggcacctttgagctgatcgaacagatcatcgatccggggaagagggtacttgtttttgatggtgacttcattgagagctctgtagtcaacgcacatcctcttcgtcttgtctttcttctctacaaaaatcacaggagcaccccatggggaagtactcggacgtatgtaccccttttctttcaactcttccagctgtttctttacttcggctagttcatttgctgccatacggtagggtcgcttgtgcagaggagtggttcctggagcaagatctattcggaactcaatctctcgcttaggcggcataccgggtagttcttccggaaacacgtctccgaactctctgacgatgggaatttctgacagttctatctgatgaagttctgaacttctgacagaggctgggggtgcaaagaaaacaaccggttgttctggccctcggtacagagtaacagtgcgtctcgcgcaatccactactccttggaattgtgccaaccaattcatcccaagaatcacatccaagttcttggtgtctagcagaatcagatccgagggaaaaggaatcccctgaatttctatagggacggcagggctataatactttgctgtcataacccctccaggggtggtgatgagcagagggtttctaagcctttctacccccaactgatttctccccacgaatcgcacagatataaacgagtgggaagctccagagtcaaacaaaattgtagcagggatggaatgaacgaggaacgtaccaacgatgacgtctggagttgtcagcacgtcctcggccgtcacatgattcacacggccccgaatgacattgtcacaccctgaaaattcaaaatatataaattgttgtttaaatggaatttttagaaataattttaaaagtcttgaaaagaaaatctatgtttaattaataaattccaatataaaattgggccagataaaatttcattaaatactttgcttaattctataattcctagatttttctgggatttatttgagctaagaaagtatttttaataaatggaattgcatttaagaaataattttaattgaaaaaggttttaaaaagtcttcttttggctttgggccgaaagtcggcccaaaacctctcttctctctctcctcggcccagccggcccagtccgcagccgcgcgcgcgcgttcggccgctgacaggtggggcccacccgtcagtcgtcgtcttcctcgggccgaaaccctagtttcgcgccgccgagctgccgtcgccgccgctttccaaatccggccgcctctttccttctccggccgaatcaatagaggggaaatgatctccgggatctcctctaccttttctcctttggaatctttggttaaatcgctttggaaagctttggaatcgagttcgattcggatcggttttccctctttccaagccgcgagtttccttcgccgttgccgtcgccgtgggccttcgccgccgcctccgagcccctttaaaaggacccccggtgtctcctctacccgtcgcagccctcgccttcgcctctcgtcgccggagtagctctagcgccgtgtgccctagcttcgccgtcgccgccgccgcttcagccgtgctccgccgtcgctccagctgtcgccgccgctcgggaagaccgccgtcgtcatcgccaagtcgccgccgtcctcgtccgccccttcgcagccgtcggaacccgctggagcttcgtcgccgtcgacaacccgaaggtagccgccgcttccttctcgtcgccgtcgccgtccgttgcttctccgccgtcgttttggtcgtcggtgtgttcgccgtgccgtccgctacccgttggtgtcctccgttcgtgccgtagcgccgccgttcgccggtgagcgtgcgccgcccgagccgtctgccgagccgagccgccgccgccgtcggtgacgtcattgctggcgtcatcaaggccgtccgccgtgaaccgccgtggactcgatcaatctcagccgtccgatttggatcggatcaatctcggccgtccgttcgcgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattattgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggcttaatattgtttaattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctacgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacagacatccttcccgccgttgttggagcggggaggcgcttggccttgctgacgccttggctttgggcatttatccgcaaagtgcccgggctcgaagcagttgaagcacagacgctgctgaccttgagcgtccctgcggccttgaacgggctgcacagctggcgtaggaggacggggcgcacgagtcccttgctgattctgctgctgctgcggctgtgggacgcgcaccacgaattgaggtcggggcgctgggcgaggttgctgctgctgctgctgctgctgctgcgaggaggatccccctgggtagggattggtgtagcgaaccctctggttagcaccctgttgattgcggaaattcgccaagcggcgcttgtgcgattccaactccttgtgcttggcttccaagcggatgctcttgtccaccagtcgttgaaaatcaggatagtccccagagactagacggacggacagctcagggtccattcctgccaagaacttctcttgcttctcctcatcttcccgcacatcctctggggcgtaacgggccaggttgttgaactcatgcaaatactccatcacggagcggttgccttgcttcaactctcggaattcccttttcttaagagccacgactccagcgggcacatgggttctccggaaagcggcggtgaagcgagcccaagtaatcggctgtccctctggctgcgtagcctggaagtggtcccaccagagagatgcgggtccctgcagctgatgggcggcgaagacgactttctcctcatcgctgcactgcaccgtgtctaactttttccccacggcatgcaaccaatccaaagcatccacggggttgttggagctggagaaggtaggtgggcggatgcggaggaactcggcgagtttagagtgttggggaggtggtggtggagcattctgttgtggcgggttttggaggtggtggaggaaagcggtcatcatgttggcttgctgggcgaggatttgggtgagaatggcgttggtgtctggtggtggtggcggaggcggaggaggaggtggaggtgggttgccctggtggttgtggttgctgccttcaggttggttgccatcaccggtagcagcatttctcctggtcgtcaccatctgaaaaccccacacagaaccagcaaacagagagagagaagctaacaattaaaactatccacccacgactaccataattcttaaatttattactgctattaaattggttcattaaagttcaagttgcttaggcaaataaaataagacaggctccgacatagttacaccacacaccggcataaccatgccccacacgactccaaaaaagacaaacgagaaagaacacacgcgcaagcctactaactgctcgtctactgctgcgacgggccagggcggaaggtgagcaacagcgcaccctccgtgctaccaacgccggaggcttccccctcctggggaaccacgggcgcaggctcggcacgaggggtctcgacgaagcaggtccacgccagggactgacggacaagctcaggcctggaggtgctcttgcgggcggtgatcttctggctgcggcagacacggcgacgcttggggcggcagatctctccctgggcgatcttgagctgatgcagctgcgcctccactgcgtcgaggtccttcttgagctgcaggttctcctggcgcagctccaggatcttcatgttgttctcgaccatcccgcggcgtaccatctgatggaagtcgatacgagccgcgtcgtacgcctccaccatgcgtgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagggtgccgatggcgaggagagcggcgctctggcaagcggcggggaaggagtctccacccgcggtgactgccaacgaagcccgctcagaagagccggcgaggatcactgcggtgacctcccacccagcgtggggctccgcgtcgtctccctcctgatccggaagcggcctggcctggtagtccactccgtgtggataccccaagaccacgcacatgcctcgcaactccaagacgaagccagtcatgtccaaaccatgacgggtgacgctgccggccatctacaaacaaaaacaaaaagagaaacaacattttaaaggtcagattttgatgataagtgaagcagcaagacagagagagactagacagttttcacaaataacaaaggatttttatttttgaaaatattgctaaggcttgggatctacggctcgtcctagggtcaagggaggctctgataccaacttgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcgaagactagggcgacgaccacaggcgcttgacggcaggcacgagctacacaccaaagccttcatcttcaaggagctcctcttctgggcttgggaaaaattgagcaagactgagtacaaccaccgtactcaacaaga

SEQ ID NO: 12424 - DNA, 4010 bp, Oryza sativa
gtgtgtttttttaagctctcatactctttggtgtgcgcaaaccttttcctgttcagcccaatggctaacaagcaaaagcgcaccaagctctctccgagtgttagcggtgacgacgggaagccgaacccacgccgtcgagctggtactccaccgccccctccacgccaaagtcctaggcggaagaaggcgctcgaaagggtcgaaggatccgcgacttcgacatccacgggtgatgaagaagggcgccgagatggggagcgtcgcctcttcgtctacggcgacggtagcacgccccagggcgcgctccaagctgcgggcgcgctcttacgtcacccgcccgtcgtccctgacccggagtctccagcccaacgttgctggacgacgtagccaacttggtcatgacggcacggcagcacctaggtgttggtgggcggtcctccgccactgtcacgtcccaaatcgactctaaaatacatcctcgaaattgtgcaaagaataattaaaattcatgtgaaagcctccaacaattaaaatgtgcaaagataaaagtcaaatgaggcttggaggatttttgtatatttcctaaaagcctaaaatgcgtaaataaattttagtggaattttcagagcacaaataataattgaaaagaaataaacaaagttgaaaaggtttataaaaagaaaaatccctaaaagtcttctttccccccccttttcccttcttgggccggctcggcccaactcccccccctctctctctctcctccccgcggcccatcggctcctccccgcgcgcgcgccgctgacgggtgggcccgcccgccaccctcgctgacgggtgggtcccgcctgtcatcttcctcctcgcgccgcgccgccgcccgcccgtgccctagcgccgccgccgccgcggattccgccgcatcccgccgtccccgcgcgcattaaagagggggaaatcactccccgtgattccctctcccgtttccccctcttttccctctctctctccctcggattcgtccgatttgaatcccgcaatcgtcgccggtgtcttcaatggagccgagatctccgcggccgtttcctccctctccggccgcgctctccccctctcggcgctatatatttgctccccgtgcctctctcctccgtttccgccgctcgccgctcgctctcgccgtcggattcgtgctagcgccgtcctcctctctctccgccgtcgccgccaaccttcggttcgccgccgtcgtcgctccggacttcctcccgactcggcgccacctccatcggcttcgccgcgttgtcgtcgaccccgtccgccccttcgtttcgcccgccgaccgccggagctccgtcgccctcgtcatcccgaaccgcgccgccgcgttcctccgctccgttcgtcgtctccgccgtcctcgtcgtcccggggtgagccgaggaccgtccttcgctttccctcttctctccgctctctcgggcgccgctccgccgcgccggtggtcgccggcggtgaccatcggggagcgggtgcgccgcctcccgtcggccgtgccggcgaggccgccttcggccgcctcccgcggctgccaggtggggcccggccgtcagccgcccgcgcccgcgggtgcggctgacttgtgggacccacggcgccgaccgccgccagccgcgtgctcccggtccaccgtggaccgagaggctgacgcgtgggccccactcccgtggacccggtccgcgcgccctctctctcggctgacgcaaataattcgatttttaaattaaaatttaaatgaagaaattcgcaaatatccatttaaagagcatataaacttcaaatggccataacttggccatttgaactcggaattggaccgttcaagtctctaatttttccttaagaagtgaagaacccatttttgtgctttgtttctgctgttatgtggaatttattagtgtttgtgtcgcgaccgggaaaattgccttttcccgaacgctagtgtattaatccccgtcccaggaaaagccggggtacaccacacaaacatggtataaaagacacatctttattatatcgataatatttacattattacaaaggcacttaaggcctgacaatcaaaaataaacagcagcggactagcgggcctacggctcaatcttcacaggcgctcaactggggtataagccaggactccacctaagacatcttctccaaagcttctcttactgaagaggggaaagattgagcaagaataagtacaaccacagtactcagcaagccacaccggagatgcataattaatgcaagggagtacaaggggataataatataggggttaagttttgcagtaaacagcatttaaaagtcacttagttgccccaaagccattttataagacaatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttgggggcttttgaatagagggggcggtgtgaatccaattccacaataaaccaacaattccaaagtgcccaggtgatatgaatatttcccaaagtctaaagttgtaaaaccacctaatgttacctaattaaattgcgaagcatctacctaaaatcatactagtgataccacgagtagagtgtccactagttggggttttgtttaatctagggtgaacaaggtaataataacaatagcaataataataaggtcataacaaaggtaaataggcatggctaaataaaacagtgataacgcgggaatttaaataaagcgataatgcaataatttaaatcaacataagtttataaactgggattcaatatgatcaagatgatgtgtcttgccttgctcgctttcccaaacaccgtcttcaacttccacgaagagcggatcttccgaagctgcagcgtctacacgaccaacggaaaagaaaaggctcaaacactaataaattccacataacagcagaaacaaagcacaaaaatgggttcttcacttcttaaggaaaaattagagacttgaacggtccaattccgagttcaaatggccaagttatggccatttgaagtttatatgctctttaaatggatatttgcgaatttcttcatttaaattttaatttaaaaatcgaattattgcgtcagccgagagagagggcgcgcggaccgggtccacgggagtggggcccacgcgtcagcctctcggtccacggtggaccgggagcacgcggctggcggcggtcggcgccgtgggtcccacgcgtcagccgcacccgcgggcgcgggcggttgaccgcccggccccaactggcaaccgcgggaggcggcccaaggcggcctcgccgg

SEQ ID NO: 12425 - DNA, 862 bp, Oryza sativa
aggatgggttggaaactatgtcacgtcttccgtctgtataccgtggtggtatgtggcacgtggttacacgtgagaaagacgtgtcttgtgggtaaagatgtacacctctgatcagagtttaatctattcgaatagccgcgccctcggttatgggcaagccgagcaatgtacccaagttagtgttttaattcttaaaacccgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtttagtgctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaaccgtttaggcaggcccccgggcgggtttgagtatctgtatgtcgcgatcgacaagttcactaagtgg

SEQ ID NO: 12426 - DNA, 554 bp, Oryza sativa
aaggaattgagaatgatgttaccacaagacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggctaggattcgtcttaccgcaaggaagagagctttgtttgtccctcgctatcaattggcgccaaaggtccgcgtggtggagaaagaagttgccccagcaaatcctccggtcatcatcataagtagtgatgaagaagaagaacccaagcgcaacaattccaagtttgagtgggtagctatcaaagatgaggaagatgagccgaacgagccttcaatcgacctcctatgctcggaagaactagaatgacttgttaagtcgttgtcttagatcgttgtgttagcttgtgtcgcgtcccaaatcgactctaaaatctatcctcgaaattgtgcaaagaataatttaaaattcatgtgaaag

SEQ ID NO: 12427 - DNA, 5030 bp, Oryza sativa
  unsure (1)..(5030): unsure at all n locations
caagcgcctgtggtcgtcgccctagtcttccgctgtttttcgttgtctttgagtgtgctgggccttcgttgcccatgtaataattttatatacgcttccgcttgttaaactctgtattgtatcaacttttggtgtaccttgcctcctgggacaaggaataatacacgcacgtcgggaacgcctgttgggtgatttccggtcgggacagcttgcttggtttaagtttgtttgtgtgtgtgggtctcgcatgtgatttacatcaatggggggatgtaagtgcatgcgtttgtttgcttttgagtgttaagaagtgggtgagtttagtggtgtgagagtcttcagtttgtaataatgaaactcagttaagatcaataaaagttaaagtaattctctgtcctaagtagtttcccccgttttctcttcttatcctgtccataccagatggtgaacactcgtagcaatgggaatggtcccaacaaccccaataatatcatcaatggagagattcccactttggtccaagttcttgctcaacagtcacagcttatgaacatgatgatgcggcaatttcagaatcagcaaaaccaagggaataatcatgcacctccccagaacaagttagcagactttcttcgtgtgaggccgcgtgttttctctagtgccactaatcctgttgaagctagtgattggctacatcccatagagaagaagttgtatttatttcagtgtactgatcaggaaaaggtctcatttgcatcacatcagttgcatggccatgcctctgaatggtgggatcacttccgccttaacaggactactgctgaacctatcacttggcttgaattcaccgctgctttccaaaagtcgcatataccatcgggagtagcgtctctcaaaaagaagaaattcaggtcgcttacccagggatctcgctctgttactgagtatctgcacgagttcaatcgtcttgctcgttatgctccggaagatgtgcgcaatgatgaagagcgccaggagaagtttttgggaggacttaatgatgagctttcttacccacttatggttggagattaccctgatttccagaaattagtggataaggctattcgtcaggaggacaagtacaatcgcatggagcagaagaaacgtcggattgctcaattcaagacacaacagggaaataatcaaaagccgcgtcttaccttaggaccccagtccatgccacagggaggttcttcgtctgttgttcgtccgcaacgtcagttcttcaacaacaatgctggcaacaacatccgtaatcaagctccacgtcctgttgcagctccagcacagcaacaaccctgccaagagggagcaagccagcaagcccgtggtgtgtttcaactgtggagatccaggacattatgctgacaagtgtccgaaaccccgacgcgtgaaggttgtccctgtccagaataactctgctgtaccagcatcaaaggcccgtgtcaatcatgttgctgctgcagaagctcaagatgctccagatgtggttttgggtacgttccttgttaatcagttactgcaacagtacttttcgattctggtgctaacacattcattcttatctatgagttttgcgggaaatcatgggatggaagtagaagatcttagacgtcctttgatggttagtaccccaagtaatcaagcactctctttgcaacgtagcccctcggtcagaatagaaattaagggagtaccatttctggccaatcttatcttgttagaatccaaagaccttgatgtcatcctagggatggactggttagccagacataaaggtgtgatagactgtgccaacaaaaaagtaactctcaccagctatgatggtcgagttgtaaccgttcatgcattgtcatctgagtctttaaggtcaagactgaaccagataactttggaagagattcctatagtccgggagtatcctgatgtgttcccagatgatttaccgggtatgccgcctaaaagggatatagagttcagaatagatttggtacctggaacaactccgatccataagagaccttatcgaatggcagccaatgagttggcagaagttaagaaggcaagtaggaatgatttttgggggcccttttttaaacccagaaggatacatagaccgagtcataccatgggagctncgttattttttgggaaaagaaagccatactcagagaatgtggtggactatcgtgcactaaacgatgtgactatcaagaataagtatccactacccacgattgatgatttgtttgatcagcttaaaggtgccactgttttctccaagatagatcttcgatcagggtattatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaggaacatcttcgtcttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatattgagttagctgcagtcgttcatgcattaaagatttggcgtcattatcttttcggtactcatacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgtgacagatggacgacagttgccattggaattatgcaaggaatttgaaagattaaatttgggaattgtcaatagaggtttcgttgcagccttagaagcgaagcccactctaattgatcaagctagagaagcccaaattaatgatcctgatattcaagagatcaagaagaatatgagaagaggaaaagctattggtttcttggaagatgagcacggaactgtatggttgggtgaaagaatctgtgtccccgacaacaaagacttaaaggatgcaattctgaaagaagctcatgatactttatactccattcaccctggtagtaccaagatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaataggtatggattttatcactggtttgcccagaacgtcatcgggccatgactctatttgggtgatagtcgacagacttaccaaagtggctcatttcattccggtaaagacaacctattctggaagtcgcttggcggaattgtatatggcaaggattgtgtgtttgcatggcgtccctaagaagattgtgtctgattgaggcagtcagtttacttcaaatttttggaagaaacttcaggaagagatgggttctaagttgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccttacgaagcactgtatggtcggaagtgccgcactccgcttttgtgggatcaaacgggagaacgtcaggttttcgggacggatatcctaagggaagcagaagaaaaggtaaagatcattcaagaaagattgcgagtggctcaatctcgtcataagagttatgccgacaatcgccgcagagatttgagttttgaagaaggagattatgtgtatcttcgtgtcacgcctcttcgaggagttcatcgttttcagaccaaaggaaaattggcaccgcgttttgtgggaccttataagattgtcagcagaagaggagaggttgcttatcagttggagttacctcaatccttggcaggagtccataatgtgttccatgtgtcgcaattgaaaaagtgtttaagggtacctaccgaagaagctaatattgaccagatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattaaagtcagctcatccgcttctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctatgtttaattaataaattccaatataaaattgggccagataaaatttcattaaaa

SEQ ID NO: 12428 - DNA, 1278 bp, Oryza sativa
gtgagagcttgctcaatccagcacgcgtttggacgcggcgtaggacgaggtcgttgacgcagagtgatcgggcccggatgcggcgctgatggtagcgccgtaggctctgctggtagcgcgcggctcggagggccgcgcgccgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgatccacgaatcgccgtgcttcttgaggatgttgaaggtcttggttttaaggcctctgaggatttccgcattggcgcgctccacttggccattgcttctggggtgggcgggggaggcgaagcagagcttgatgcccatgtcttcgcagtgatcgccgaaaagttcactagtgaattgggtgccattatccgtaataatacggttaggcaccccaaaccgggctgtaatgcccttaatgaacttaagtgcggagtgcttatcgatcttgacgaccggataagcctcgggccacttagtgaacttgtcgatcgcgacatacagatactcaaacccgcccggggcctgcctaaacggttgtcacgaccggaaataacccaacgggcgttcctgacgtgcgtgcattaatccttgtcccaggaggcaaggtacaccaaaagctgatacaattcagagtttaacaagcggaagcgtaaatagaattattacacgggcagcgaaggcccagcacacaaagacaaacgaaaaacagcggaagactagggcgacgaccacaggcgcttgacagcaggcacgagctagacaccaaagccttcatcttcaaggaactcctcttctggacttgggaaaaattgagcaagactgagtacatccaccgtactcaacaagacacacccacaaatgcagaataaatgcaagggagtacaagggaattataatataaagggttagggttgcagtaaacagcatttaaagacatttagttgctcaaggctattttgtaaacgcgatcctagcactaaacaatattattaatcaaggccgtgaacccacacgaacctgccttaacccaaggcctacgatgattcagaccgaactggcaacccgaccctgggtcccagctcgtcccaagccaacccaggccaaccattccacat

SEQ ID NO: 12429 - DNA, 884 bp, Oryza sativa
aaaaatatcatataaaaaataaaataaatgatgacttggctttgtaatattccccttggtgatggcagaagtgaccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgcaggcgtaaacaccagtcggcggcggacgagacggccggtcggtgaagacgtagacgcccaacaacggtggtgtgaccaaccaaccatataggcgaagacaccagtcggcggcgacggaggcaggccggcggtgaagtcgtagacgcccaacagcggcggcataataggccagccgtgcaggcggaaacaccagtcggcggcggacgagacggccggtcggtgaagatgtagacgcccaacaacggtggtgtgaccaaccaaccatataggcgaagacaccactcggcggcgacggaggcaggccggcggtgaagtcgtagacgcccaacagcgg

SEQ ID NO: 12430 - DNA, 13905 bp, Oryza sativa
  unsure (1)..(13905): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattgtgaataaagaaatttccaaagtattgggcatacgccatgcgcacactgctttaacagatgtgcttaagtccctagaagacacatggtttcaccacacctggaaatatatggcatatgtggtgtaaaatccgaataaataaactcataaaggatttaccaaccgcctagaaaatgaccacaatatataatcagcctaagccataatattggtcaataaaaatgcacacttacgtggcaaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtgacatgctcccgagtaacaaatcttctgggtaatatagaccaagtgtagctcatatgaatagcttctgatctgaatgactatcccttatgggatactccaaaataaatataataattgaatcccgactggcgcaagtattcagttgatagcctttacggggaataataattggtccagtctttgagcatagaagatagactcatgactatgaatccatgtggaatgtatccggaacaagtcccaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaaacagtgacaccaatcaaaggtaatgaagttgcataaccatggaggcgaagaaacagtcggtgatgacaaaagcaaaccgacgatgaagacgtagacgcgcatcaacagtgatggcgaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgtcagtgacaataatccatcaaattggtgttatagctgttgcagatgcttcacttggaggaaagtagatgatgttgtccaactcgtcgaaactgagctgattggttgataactctgctctaaagcaaagacgaagataatgactcctggaattgactcgttggctgattaattgattgcttcatcttgtcgaattttgagagtcttgtatttgtgtagcccccgactctttggttagttgggaaacaactgaacatagagtcgagaattatagcttcttgtcgtcgagtaatcattgcttgattgaagatatgtgttgaagatgtccaagtagaaatccggtagtgaagacgcgcagttgtgaagataaaagcaccagtcggcggcggcataatcagtcggcgacggaagatgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaagcggccggtcggtgaagacgtagacgcccaacaacggcagcataataggccagccgtgcaggcggaaacaccagtcggcggcggtcgaagcagccggtcggtgaagacgtagacgcccaacaacggcggcataataagtcagccgtgcaggcggaagcaccagtcggcggcggacgaggcggccggtcggcgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatatcggatgagtagtatctgatataaatataatactcgagaaaaaatcaagtattttaaaatatttataaatatgtatttctcctcttatcaattgtgatttccccgagcagatgactctgtacatttaaacactctgtccgactagtcatagcccacaagcatcgggagtcggcctaggcatttcccaaacatgcatatgagtgatatgagttcgtcattaatggaacaaagtttcacggatcagaatttactactcgggtacttttgcaattattaagagcagaaaataaatttatctcgtctctatgcttttgatttattccgaataatacttagcaccttgcgttactcggtccatcgaacgagcccccgggtgctaggaatcggcccaaaggcaaccatccaatggcaaaccaaacggaaagcataggaagatagaactccataactcgataggtacttttgtactcagattatgtcgcaagcaatcaagataaatattataaaaaatatgatataacatctatagccctcgactcactactcaatggaagaccaattggtgtagtgaggcagaggaaaaggaaaaatatcatataaaaaataaaataaatgatgacttagctttgtaatattccccttggtgatggcagaagtgaccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcaggcggaaacaccagtcggcggcggacgagacggccggtcggtgaagatgtagacgcccaacaacggtggtgtgaccaaccaaccatataggcgaagacaccagtcggcggcgacggaggcaggccggcggtgaagtcgtagacgcccaacaacggtggtgtgaccaaccaaccatataggcaaagacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgtaggcggaggcaccaatcggcggcgacggaggcaggccggcggcgtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccaatcggcggcgacggaggcaagccagtggtgaagacgatgtcgctatcggcaacggcggcggcacacaccaaccgtggcagcgaggccgcaagcagtgaatgattgtttgatctcgactgccatccaatgcatgcgaacaaccatcgctccagcatacatgtagattaaatcgacgtatacacgtgcttgctcctggtggccgagtatattcctgtgtcctgtgccaatctagcagcacgtccatctgcatggaagggaagagaggagcactcggacacggcaagaggcacccgagtggccgagtaggcgacgatggcggccgtgtcgtgatctcaaccagcatgtgaaaaacaacaaaaattgccaggaaatcaaaacggccggcgattagggattaattaataatcaatctaataaaaattaaattggaacagccaacccaagttgtacggcgtggcttggatacgtcgtgcgcgtcgatcagcttgggtcgcaatgcctcgatcagcagtagccggcggaagccatcaacggccctgcgacctcggagagtcggcagcatgtagatgaccgaccggggcagctgtaaagcctaatgataacagctcggaggcgaccgactacggagacggtggagccggtcggcgctgacggatatagccggcagtagatacggccggcggtgtacatgcaagacagatagcaacaaaataattgctggttagaatcaactagtaaacagattaactctgtagatgtaatgtgcatgttggttggatcgtgcatgtatgttgatcagttgaatcaactcatgcagtgttttctcctggtaaactgtgcccagcgatggccaccacatgtccgccggcaaagcacgaagaaagtctcgatgcgtgagggcgtcgtcgacagcttcggcttgatctccgccgaccgacacaagatcgacacaggaaaatataccagaagattgatctatgatagaaaaaaaattaatctaataaaaaatagattggaacgacaaacccggtccaaagttcgagccatcgaattcggtgagattgatctcgccgtttcttctgaagtggattccatctcacttttcgacgggtaattcgacgcatcccctacctggcgcgccaactgtcgaaacatgaattcggcaataataaaagggggtagcggacgagacctaaagtggatggatgcagagacaaaggatttagacaggttcaggccctctcaatgagaggtaataccctactcctgtttggggatttgaatccgccgagtgtgtattgatctgacgatcaggttgtctcatgccccctagagggcctcctgcccaccttatataggatggggggcaggattacaagatagaaaccttaaccaatacggtatcggtttcctaaatctattttacaatattatcgaatcaggactttaggccgctccataatataaaaggaaacgtaatacccaagtcatgatcggttacatattccatagatatatgttatcccctattactagtcggataaccatgccgtgtgggtatggggtacccataatctccacagatatatttactagtaactttctgacaacaaagtccatggaaatgaacgtctatatatacttccatagattcaccgttcaattgagctcagtttggaagcacaaccttttgggactaatattgggcctttttcactaacaacagagaagcaaatcaggcccatatctgggcttgcaccgatcgtgggtgtgacggatcagagcgacccagtgatgggcctttttagtacccagggcccagtgttcgtctcaagaagagagctgaggcccatatttgagtttgagcttttagtaccacctcggagacgcagagctgaggcgcgcaaggcgctctgtatataagcaggcagggttgcacggagcaactcatacctttctcggccttttggctaagatcaagtgtagtatctgttcttatcagtttaatatctgatatatgggctatgtgcccacttcgatattaaatttattttttgtgggggagggtccactacagtggcttgccgctggggccctcacgcgtcgcccaggtgttgcactgctgcccgggcctggcgcaccccaaccaaaccaacgattaatttttaagtatgcagttgcgctgatagctagacggagtatcgatgcctgatgtgttcgtttgtgtgagatagggtgagaaaatacctcgttttccgcgcgcacgttttccaaactactatgcgtttttttaaaaattttctataggaaagttgctttaaaaaatcatattaatccatttttaaaatttaaaatagtttatactcaattaatcatgcgctaatggctcatctcgttttacatatcttctcaatcctctatatctcaaactcacccttagtgttcttgtatatagatgatatccaatttgatgttgatgtgtttaaagtttgatttcttcttggctaggctctgaattatgatcctctgcgccttttacattcacatcttcctgcaggaagagttgtcactgatgttcggtgtcgctaatttgctactacctccgtctcaaaataagtgcagccgtggatatccgtactcaacgtttgaccgttcgtcttatttgaaaaatttatgaaaaaaattaaaaatatataatcacacataaagcattatttatgttttatcatctaatagtaataaaaatactaatcataaaaaattttcaaataagacgaacggtcaaatgttgaacatgaatagtgcaaaactgcactaattttgggacggagggagtatgaaattggtgatccatgaatgttcggtgtcgctaatttgctatgaaattggtggtccatgaacacaaactctgcaagagttcggatagctctcgtcgtaaattcgctattatgaaattggtcacggacctgttgatctgtgaacaaaaactctgcaagagtgtcagaattcggatactatccaactctcatgattgatcagaatgtcagcgctcgctctacggttcagataccatcgatgacatcgtcagagttcagatacctgtccaaactatgaaaagtgtcgtcagactttagtgctctggagttcagataactctccaatttctgccgaaacactgtaaactcgacgtgatctgcacacacatttaacacttcaactccatgcgatctgcagggagagacatttaggttcggtactgcactgtatactaggaaattgcctcgcaaaataggaataaatacagtgccattcaaatttacatcctgaaacccagaatataaatggaatccatatttgcatttacaattccctccatgggaccttattgttcattacagaagggttttacatgtgtaacaacaaaatacaaatgcctactacacttactcaaataaacaatttcatactgaattctcagagcccttgtattttcttgttttttttttctccctgttgctctctgtttcccatcacaacagacaaatccgagtatttgtatctcgattataggtaagcacgttttggaacgggataaatcagaggcaggtgactcttctgctgcatgcataagaccgcctcatgcaaactcttcctcagtggagtgaattccaaccccaaatccttgagcctctggttcgagaacttgtacggcttcgccatcggcttcccgtcatcttcacacctgaaaaatccaagaaacacacgcatgaaaaatttgagatcgatcgattacatctcagaagactatttcagcaacgcacacaagcaaatcaatgtctaatagttgcgtactttgcagtggcagggtactgggggaagaggtccctgagcatccggaggagctcggcgcggtggagcacggtgccgatgcagaggtagcggccgcgtgcgtcggggcgctcgtagacgaggacgtgcgcgcgggcgacgtcgcggacgtcgacgtaggcggcgacggcgttggggtacgacttcttggtgcccatgaggtagcgggcgacgtggttgctgctgaagttgagcgtctgctgcagcatgggacccatcgtcatcgacggcaccaccaccgccagctccagccccctcttcgccgcctcctccgtcgccgtcatctctgccatcatcttggcgcagcagtacaggttctgcacgtacgacgagaaaattttgccgagatgatcaatttactgttcatgcaagcaacgcggttggagttggtagaaacgcagcagagtaatgtgcttacgtcggtttggcggcagaattcgtagtcgctccagcaggtctcgtcgaggacggcgtcggggctcctgctggggttcatgtgcacggcgccgtaggacgacgtgaacaccacgcgccgcacgcccatgtccgccgccgcgttgatcacgttcctcgtcccctccactgcaaccggaaccaggtcctgcagcacggagcagcgttagtaaaagttggaggaggttaaaggcgccattgtcgtctcttttgggctcaagaaccaggctagtgaacttacagggtcgttggacaccggggaggcgacatggaagacgccgtggcacccgctgaaggcggcgcggaggctggcggcgtcgaggacgtcggcacggcagagggagagcctctggtcggctccctccagctcaagcaggtgagcattcttgctgtcagctacagatacgcgcgtgcaagaaccgatcaataaatcaagcacaaaatgcagcaaattaatggtaacaccgtgaactactagttagtaacttaccaggatctctggctgttcccctgacgtggtagccacggatgaggagctccttcaccacccacgacccaatgaagccacctgctccggtcacacagaccagctgcttctcgccattgttgttgttggcctcaaaattggacgacatggtgagagacactgaccagttactgtcactagccaaatgctactctgaacttgtgagagaactttcactcgaactctgaatgttggttgtgtgagtctgccgtgtatggacatggccgctatttatacgcgagctgcgagcacctgcgccgccatgccacggagcacgaggaggacgacgacaagaggaagattgctagcgtagggtggtcatcgggtgaggggtgggggaggcgcaactgcgaccacgcgaaacggaatgccgtcgccttgtcgtccatttttgaggattcagcggcgcgcgcgcaaaaactgggcagcacaaggccgaattgccgatgggttgggcgtgcgcgtgggctcatctcacgggcgcgtacgagcagtagagtatattccattgcctttctggacgagaggatcacgaagccaactctggcacgtaaaccgtgcgaggttttcgctgaacctggcgaatcttctactgtactaggatgcaacttgtactaaacaattgcatctgctgctggaacgaccgacgattcgagtcagactggtacgatcgactaatgtctttttgaaaccttgacggaaatagtactatagtagtacgttcgagtgaatttgacgattttttacgctaagtcttatttagttcctaatttttttctttaaactttcaactttttcatcacatcaaaacttacctacacacaaactttcaacttttccatcacatcgtttcaattttaactaaacttttaattttagcgtgagctacacatgctaattatgattgtcttagagatacgagagaaaaccaatgaacaatggcaaattcggtatattgtggttacaagttccgcgattacaatttccaaaggtaagtaaaataccgacgtagtgcaaaatacgatactactaactgaaataggagaaaactggcacaaatcaacaacagtttatgacataattaatggaacgtgaaaatagcatataagaccgtaaaacaaacatatttatattaagatgctttgtttacttagaacacttagggcctgtttggcacagctccagctccaactccacccctcctggagctggagctcagccaaacagttttagctccaccaaaactaggagtggagttgggtggagctctctcacaaaatgtaatagagttgtggagctgggtttaggcagctccacaactccactccagagttggagctgtgacaaacaggcccttaagctgaatccgccgtgctcaagtatcaaaactggagtacttaagtggactaaaccaaccgaagaattcagtcggccgttgaaactaagatccggcgcgtgttggctgcacgactcgcggcttttgaaaccgaacggcacggcacggtcggagttaacagaacccacctggtatctgtttacgggaagccccatgtttgagactccaagggaggaggtgagcttggcaacgccaacctttttgacggctcgtgtcggctgctgcctgcttgcgtcacccggtgggcgagcgccagccgatcgggagcaactctaagagcaagtttaacagtatagcccactacaagctccaatttatctatagtcaatttaatagccaattcatataatagttgcttactatactattaatatatggtcccatctgtcatacacacaccgtctcttggagtctatgctgcagctacctacagatttgtagcccgctgcttttctctttcatcttttatatcattaaaatatgtttatagctagctaatagtctgctattgtacctgctctaatcccaacttcacccccaataccggctgaaccgacgggggcttatattcattctcttttcttttttttttaacttttaactcagatttacaaatttttaagttaagatttgaaaatttttaagttaaaaaatttaaaactttcaactcatatttaaaaactttcaagtgaaatcattaatatttaactcaaagacttaaaatttttaactaagatttaaaagctttcaactcagatttgaaaaaaaatccaagtgaaaatttgaaaacagtcaactcaggtttacaaactttcatctcaaaattcaaaacatttaactcaaatttaaaactttcaaccgaaattaaagatgaaagattcatttctttttttaaaaaaaaggtgaaagaaaaagtcccacgagggcgcagacccacgggtcacacaggtgtgtgcgccagcaagcgagttggcgtgtctccgccagttagtttttgtgttgtaccggtgcttgtattcacgctactcggttaagttatgcacttacgcgtacataagaaggaagtcgctgacacgtggttctcatttgttaacgagacaaccatggttaactggccacgtcaacaaaaaaatcattttcaaaaacaccgaagtagtttatttgtatcagtttttaaagatggaggagacgtgctatatcccgttctgtagccaagggagatattcattcaggatcaagaggacgagggagatcaaatagacttattcaaagagtgtggagtacataatacgtggggatttcattccagcccaattcgttgcaaacgtcctttgtacctatccggcccaactcaccaccgtcggctacggagacgacccggttctcctccgatgctactgctgccggagccggactcccaaaaccctcgccccatctccgcttggctttgagaccgctcatcgcggctgcagcagcgtcggcaggatccaccgccttgccgtcttcgatctacccggacgctcggcctccggcgacgactttaggcatgtccagcgccgtcacgggcctcgtccattaccatggtacgtcgtcgattcctcgtccactttgaccttctcactccctcccctttgccgctcgtccggctcaactaggccgcggtggcttccaatgttaggtagttgggaggaactgtgttgcagcctggcttgatgcagactaactgcttgctgtcttccgcatttcttgttgtttggagcataagtctcaaattattttcggtgatgatgtgatgaacaatccacaaacgtacatgccacctcttttggagcataagtaagcaagttatgggcttctaaactaatcatagtggtgttgaacttttgatggtcttccagccaattgatggatgttgagcaatcgtcgacaatggaattttgtgcttctataggtgtttgttttttttttttaaagaaacgcttccataggtgttgaggatgaagttttcacataaaaaaacaaactcaccgtagttaggcctgaccaactctaaaatttctcgggtctgctactattccagcccatgccattcaattgaaggcctaacactgaattttatccctgtttagcaccatcgtttaaatttgagaaccaattgattgctaattaaatggatcagagtttcataaactactctactcgaatatgtacacaataaatgtcatgcctacttcacctgcagtacaattgtactgcattttttcggagttactacctccgtttcacaatgtaagtcattctagcatttcccatatttatatgtaagtcattctagcatttcccatatttatattgatgttaatgaatatatatatatatatatatatatatatatgaatatgggaaatactagaatgacttacattgtaaaacggaggaagtagtcatcttgtcttattattgtaatctgtgatgccaatgccctcaatgcaaatttttagaagatgatatcgcatttataaaatctgaggcctctcagcttaatgttttattctaaaccaaagctggcgtgtgcaaaatggaacttgccgctaacttaagccttttatatccctagattcatgcagaggtgctagtgggaggagatagatattttacctgcttaatttacctgaagaactcaaggccaagatcaagacactgaaggatgctgacaaaaggtgttggttgaaagatttattggtttatcactatggccttgttaacagtgaaatttggtaagtccggagtagtcatcggtttagagtcagcatcggcttcgaagtcctgagattagccgatgagagttgtcaagtcatcagttgtcggattcttgctatattcggttaaggaaattgatctactaaataaaacttatccagaagagaccgagtttaaagagaatgcggcatgacaagttatctattaattaggaatagtttgttagtttccttttatctttaggaaattgtgtttagtgtctgacggagcgtggggctccttaccgggagaccgcgctggcccccctttgccggttcggccggggaccctgggtgagattctaagctctcaatctgtatgtggaaggttcgcgagacaggaagcacag

SEQ ID NO: 12431 - DNA, 37944 bp, Oryza sativa
cattcttgtccaccacgtgtcaacttagcaattaaaatgttcccccttttttaaacaacaatttgcttgtaatggttaggatgaagcctggcatatatctggtcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcaatgcactacgttacatgcgtcgtgacacgctcagccaaaccgcaataaatgtggttaggtgagccccactgtgctcacctaccccatacacgcggagcgaaaacccacgaggggtcggggcgcctcggccctcggggccgaggggggtgcagcccgaccccctcggggggactaagaggagggcgaacacatcaccctcgggcccaacgtcccccgagggtgccaggccacgttggcgattatgtctgcctcaaacctctagtcatgatactcccgatcccatgtcaccgacagtagccctcggcgttatgccagggcgttcgccctccttaagggaagcggtcgggcgtgacgccactcctaaggcccggtgacaggtgggaccggtctccacaattgggcagaaacccaacggtcaaaaatcacgcacatcggcaatggtaactcggctgtcaataatgagcggtctcttcaagactgccacattactcgagtagcacacgaatctggacatggcgattcgtttcatctggagatatggtaacgtcgcttcggttggcgagcgtaattaacgcgcgcacgatatgatctacctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagggtataaaggcactgaggaagggatttgtttccttcctttcgccattattccccttgtcttcgccgcttgcgccctaactccttctttcctgcgccctaccctcgccacacgcgctcgctcttaatcttctcttcctccggcgtcatggcacggggctccgctctgctcgatggtagcgtgctgccgccttcccgcatcgtgagcgagaggcaggctgggctgccgcgccgcttcatgccggaatctgccaccggccgggagatagttacgctgggcgagggacgcccggcgccagactacccggggcggtccgtcttctttctcccctttgcaatggcagggctagttccgccattttcttctttcttcatggatgttctggagttctacgatctccagatggcgcacctcacccccaacgcggtgatgacattggccatcttcgcgcatctgtgcgagatgtttattggggtgcgcccatctcttcggctgttccggtggttcttcactgtgcagtcggtgtcgccgccatcggtagttggtggctgctacttccagccacgggggccggtgctgaaccgctacatcccctgcgccctccgcaagaagtgggacgactggaagagcgactggttctacactcccctcgccgacgaagcgcgcctcctacttccgagccagcccccggtgcaggcctccagctggcgggcgccggtagatctgggggatggctatgacgccgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagacttcatgaggacccaccagggagtgtgatgggactgggctcctgaggacttcaagatattggtccaacgggtgctgaatctcaactccgtggaggcggccctcattccccaaggaatcctccccctctgcagcgatccagaccgcgcctccatcctgaccattatgatggcggtcggggcctcagaggagcgagctccaaagggccacgacggcgcaggcgggagccgccggggggaacaatctaccccgagagggggtcgtgcttctgggtcccgcgacaggggtccggggagcagccgccctgccaacacccgggggaagaggaagcagggaggaacacctcccccatctcctccccgagggggcggggcggcgcgtgccagcagcaggcgcccggagggggccgcgccaacatcgcagcccgagggggagcgcatgaagaagcggccccgcaagatgggggagacggaaccatctcggggaaacctcatttcccctccaaagtggtcgtttaaccgaccccctcgcaggttcgtctctcacccatcgtggctgtattcattctctcaacgcgagtttttactcacccatcttgttcgtcttctggtcttttcttttgttttagcgagatcccgtcgcgtccctcccgccattccaagtccggccagtctgaggccgaggatccggcggccgcagaggcccggaggcgggaatctgaccggcgagaggccgcagatcgcctacgggaagccgaggaggccgcccaggaggccgcccgggctcgccaggccgaggaaactgcttgggagggagccgcccgggcccgccaggccgaggaagctgctcgggaggaggccgcccgagcccaccaggccgaggaagccgctcgggaggaggctgtccgagcccacaaggccaaggaagccgctcgggaggaagccggatttcgccaggacgaggcgatggcgacttccgaggcagctcgcgacgaggccgcgggcgcgtcgctcgggcccactccctcgggcgacgctcaggcgacaacttccggggcagctggcgacgaggctgcgggcgtgtcgcttgggcccactccctcgggcgacgctcaggcgacaacttccggggcagctggcgacgaggctgcgggcgcgtcgcttgggcccactccctcgggcgacgctcaggaccaaacgggtccgggagacatccccgagtccggcacttccatcggcggcccgagccgcgtggcatcctttccaaggcggctcttccccacgccttctatcgccccactgaacacagagccccttctgcaggctttgaccgccgcaaacaccacgatgttggatgggttaagtgcctaggtggaggccctgcaggcagagcgggcggagctcgacgccgcgtgggcgcgtgtcgaagaggggcgacgctcggtggaggccatggtggaggtgggccgtaaggctcaccgccggcatgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaagtggagctagggaagaagctcgacgccgcccagggggtgcttgacgctgccgctgcccgagaacagcgggcggcagagaccgaagcggcgtcatggcggcgcgaagaggcccttgaggcgcgcgccatggcgctggaagagcacgcctgcgtcgtggagagggatctggcggaccgcgaggccgctgtcaccatccgggaagcaacgctggcggcgcacgaggctgcctgcgccgaagaagagatcgcgctccgcctccgcgaggacgcgctcaccgagcgggagcgagctctcgagggggccgaggccgcggcgcaacagctggcggacagcctgtccctccgcgaggcagcgcaggaggagcaggcgcgccgcaatctggaaggtgcccgcgccgagagggccgcactgaaccaacgggccgctgagctcgaggcgcgggcgaaggagctggacgcgagggcgcgcagcggcggggcggccgcgggcgaaagcgacttagccgcccgcctcgcagatgccgaacacaccatcgccgatctgcagggcgcgctggactcgtccgccggggaggtcgaagccctccgcttggcaggcgaggtcgggcccggcatgctttgggacgccgtctcccgcctagatcgcgccggtcggcaagtgggcctctggagagggcggaccgtaaagtacgccgacaaccagggaggcctcgcccagcacctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaagtccgggatgccgccgactatatcgtcgacagcttcgagggctcggcccctcggcttgcgtttgcccccaactccgacgaggagggcaatgccggaggtgcagacgacaatgacgtcgaggccggctatccgggcgcatcggattgagcccccagacccccgccatccttctgttttttcttcttttctttcttctaaggccttcgggctttgtatagatcaacttaatctgtaatcaaaaatgaagaaatttttgtgttaatttcatcttgctgtaagtatgagatgaggatgatctgtgccgtggtccttttgtgtcttagcttgaataagggctcgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcgcgagtgacctatttcaagtcaagattcttcaaaaggaaaaaacagcacagatacaacctttaggaaattgaaactgcttttattgaaattctgaaataagagaaataagaaagtgcatgtgtggcagcccccggccaaccctgctcgcccgagggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgagagcttgctcaatccagcacgcgtttggacgcggcgtaggacgaggtcgtcgacgcagagtgatcgggcccggacgtgacactgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggagacttcagggtgagctcagatgggagaaccacttccgcgccgtagacgaggaagaaaggtgtttccccggttgctcggcttggtgtagttcggtttgcccagagcaccgctggcaactcctcgatccatgaatcgccgtgcttcttgagtatgttaaaggtcttggttttaagacctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttatcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggcggaccaggtcgaccgcatcattgagagctgtcggccaatagaaaccttggcgaaaagctttaccaaccaaggtgcgcgaggcggagtgggccccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccctcgcggtcctcgggtagagtcttatttctgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggatgcgagccgtgagagttcgtcggccatgacgttatcccgtctgggcacgtgccgaagctcaatcccgtcaaaatggcgctccatacgccgtacttggcgcacgtaggcgtccatttgcgggtcagagcaccggtactccttaccgacttggttaacgaccagctgggagtcgcctaacaccaggaggcggcggatccccagtccagctgccactctgagtccggcaaggagtccctcgtactctgccatattattggtcgctcgaaagtcgaggcgaaccaagtatctgaggacgtctccactcggagaggtcaacgtgacccctgcaccggcgcccagaatgaccgacgtgactggtctgactccggtcatgtcgtcagcaggcggccacaattccacgacgcgtctgctcctggcgaaagtggaggtagttgtgggccgtcccatcagaaggtgactcggacggcaaccatgcaaatctccgtccatttatgaaaaggtagggtaagtccccagtgagaaggggggatggtgcatgtggtatccccttaagatataaaaggaggaccttgcccactgagagagggggagagctttttcttggactggacctttccagattaggaacccagaacaagggagaggctggctgatactttgtagctctttcatacacagatctcccaaaacacaggagtagggtattacgcttctcagcggcattccgttcggctcgggggcctcttctccctgctctctcctgggtcgaatcggcacagggttagcctcggggtcagagggcgataggtgcggccttcccgcagtggcctcggggctgtcctgggagtcgggggcacctgacaccgtctgacaagcggggagagggcctgctccggtcgtcgggggccttaggccaccgtccggctcgggggcctcttctccctgctctctcccgggccaagtctgcacaaggtgggggtgcgcggaatgaggattgtcctcatcgcgctccacgaccaacgccgcactaaccacttgcggggtcgccgctaagtagagtagcaagggttcatttggctccggggcgaccagaactggggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatacaaccggtgacgcattgcacatccctaagcttgctgggggggcgcatccgctctatagctcgtatcttctcggggttggcctcgatgcctcgggcagagaccaagaacccgagaagcttgcccgcaggtacaccgaacacgcacttatctgggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgaattctttaacccgaagggcatcgtcgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttgcgcccggccgtacggcgagacggtgctcaatcacctccctggggaccccgggcatatccgccggtctccatgtgaagacgtcagcgtttgcccgcaggaaagagacgagcgcgccttcctatttgccgtccagaagaccaccaatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctctccaggaccgcgttgtagggcagactgaggtccgccacatcgaagttcacccgctccgtgcggaaattggcgggtccaccgaaggtgaccgggaggtcgatatgacctagcggccaagtgtgccccggcgtcactccaatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtcggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcagcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcgggtggcccgcggagcgccctcgacggcgaggacatgaccctcgtcgtctgaatggactgacctcttcttcctcctcctgtcacgccgccctgtctgagcggcggatccgggggcggccgaagctgccacaccggaaccggaagggttccaagtccaggcctcctccttgcgagccactcggtccgcgagctgaaaaaactccgcggtagtctggggctccttggaggcgatcttttcgagcatgcggttgtgccgcacgccccccctgaacgcgtagattaccgcgtgtgcagggatgcatggtatggtgttgcggacttgacagaaccgctgaatgtacgagcgaagtgactcatcatcccttcgctgtactgcgtgtaagtccgcttcttcacctgggcgcggatatgagccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctggtccccgcgtccgtgttgaggtgacactctagacgaggaagcgccctccgttgcgtgggcagcacgtcggtcattacgccggcgctcgatgctggcgcgggcgtccggccccccacgcagatcttcccgggtcgaaggagtcgacgaaggagtggcggccgaatggcgaacagcggctgccgctcgtcgtgccctccgtcttgacgacgcggagccggtggtagcagcaccagaggccttggtggcggaggaccgcccaccagtatctaggcgctgccgtgcagtcatgaccaatttggccacatcgtccagccaacgttgggctggagactccgggtcatgggcgacaggcgggtgacacaggagcgcacccgcagcttggagcgcgccctggggcgtgctgccgtcgccgtagacgaggaggcgacggtccccatctcgccgcccctttccacctcctgtggatgtcgaagtcgcggatccttcggccctctcgagcgcctccccctgcttaggactttggcgtggagggggcggtggagtacgagctcgacggcgtgggttcggctccccgtcgtcgccactcacactcggagagaggtcgtgcgcctttgcttgctcagccataaggctaaacaggaaaagcttggtgcacacgaaagagtgcaagagctcagaagatcactcgcagagtcccctacctggcgcgccagatgacggagcgtggggctcctcaccgggagaccgcgctggccctcctttgccggttcggccggggaccctgggtgagattctaagctctcaatctgtatgtggaaggttcgcgagacaggaagcacagaagacaccggcgatgtatacaggttcgggccgctgagaagcgtaataccctactcctgtgttttgggagatctgtgtatgaaagagctacaaagtatcagccagcctctcccttgttctgggttcctaatctggaaaggtccagtccaagaaaaagctctcttcctctctcagtgggcaaggtcctccttttatatcttaaggggataccacatgcaccatccccccttctcattggggacttaccctaccttttcataaatggacggagatttgcatggttgccgtccgagtcaccttctgatgggacggcccacaactacctccactttcgccgggagcagacgcgtcgtggaattgtggccgcctgctgacgacatgaccggagtcagaccagtcacgtcggtcattcttgtccaccacgtgtcagcttagcaatcaaaatgttcgcccttcttcagacaacattttgcttgtaatggttaggatgaagcctggcatatatctggtcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcaatgcactacgttacatgcgtcgtgacacgctcagccaaaccgcaataaatgtggttaggtgagccccgctgtgctcacctaccccatacacgcggagcgaaaacccacgaggggtcggggcgcctcggccctcggggccgaggggggtgcagcccgaccccctcggggggactaagaggagggcgaacacatcaccctcgggcccgacgtcccccgagggtgccaggccacgtgggcgattgtatctgcctcaaacctctagtcatgatactcccgatcccatgtcaccgacagtgtcctataaggactttatcttttccttttatctttaggaaagtttctttcttgtccgacaaggacttgtatcaacccataggtataaatatgtacacccagggtctatgtaatctatcttcacgatcaatacaattcggcgcatcgccaccttttaccttttctactttattttatcgtccgacgggacttggcacctgacgtagggctgcatcggtgttcgatctccggcgaaggggtaagtccaatgttccgtcggcccaggcaattgtatcgtttacgtcggtgtcgttcaaggctgcatcagtgcattcgacctcttggattgctctggtttggatgatatatttgcctacctatttatcatatgtttatgttaatctagtcttagcatatcaatttagctctatcggctgcttctcgttttagggtttctgccggtatcggctaaatcgtgttgctaggttagattagcttagatatctaccaccctgaaaactcagtcaacggcttgattgtctagatattatgtttcttttcatacttagtgctgcatcagttgagtttgatctactaagtcgtgcttagaaccataatccctagcctgcttcttgattgccaataagggtttcatcggggtttcagccggtgagttatctggacgttgcatcggcttataaggatagcgtatacatataagttggatttagccgatgacaacaaaggtttcactgttcaatctaatcttgtggatttcatgacatcggacctccagctgatgtgtgctttaaccttcggatcgatgcttatttatcatataattatttgccgattggtttatattggattatattgttattttattacaccatcatcagccgattgcctttatatcattggacatatagccgattgctaaaaccctatcgctatcggctggtatcggcatcggctgagattgctccatcagcttgtcagccaatcggctattttgatatactatttgcatatcttatcagttgcaggatcaaactgactggcacgcccgcatctcaacaacctttggacctgcactggagctaagcagatctcccaggccggtgtgttcgattttttcgtcaacaggcccatgatgggaggcttgaattaggcatctgtcaaggaagttcattgcacacctctccaatttaaaggtacgtaaagaaatatttgtggaatatacgtgtgtgttttatgtttaatgcgccatgaatgcacaacttaccttcttatttagtcatatttaacttgactatctcattaaatatgtttattctagtggctgataaatctgaaatacatagagatggttttcaaatcccttatgttcttatttaaatgtatctattctagccttctacaaatggtcaggatttgtctttataccatgtctctttcaccttttttcttcaagaaagaatgtacatgtgccatttaacgttacacagttacatatcgtttgttggaatcacacaaggatcgttggaacacacacgaacgcgagagcaagtggcagagcttgaaatgcttgacaatggcaacaaatgccgccttttttgtatttaactcggtggccaacaatacgatgaacatgtgcttttataggcccagcgcgacgcacaacggagcacgaactccatccccgacctttgctcgcactacccgcacgacccggctccatgcgacgaacgcgttaacaacaaacacacacacacgacgcacgcgcggactgacctgacacacaaggtcaggtttatttcctaacatcgttggtctatatcattttgtgatttcctgcaatcttattacatcccacatgaatttctacatggttctttcattgcaatttattatgcatgggagctatattaattgtccaagaaagatttacatgttaagatttcatttgcaaactctttgtcctttctgcaatggccataaatttgctttttcatgttcatagaaaaagaagtcatatctgtgttgattgatttataaaacataattcaaaacagcgtgatctacatgctaaatgtatagttacggccttcttccaaatacaagacattttgttgctcgagttggtaatttgcattctgttgttccctgccgagcaagctctcaatctcctctgcattgtcttcagcttcagcccatgggtgctgctggtatctccttaacatctccagcctctcagcaacctctttcatcgttggccgttcttctccattcatgcttatgcatcgcatcaggaggtatgtgatctcttctagcatttcagcgctcatctcattccttacttggctatctagtagctcttgatggcgaccaactttcattgctgtggtgaagcatgacaccaggctcctgttttcctctggcccgtccaagtacaatgctttcttccttgtcagaagctctagcatgacgacaccaaaactgtaaacatcgctcttatcagtcaactggcatgtcataaggtattcggggtccaagtacccgcaagttccctgcaccaacgttgcaatctcggcctcatcagttggtgctagctttgatgccccaaaatcagaaactttggcgttaaacttgtcatcaagcaagatgtttgccgtcttgacatctccatggaggattgggggtgaagccgatgagtgcatgtaggagagtgcctcggctgactctgccgctatccgaagacgagtatcaagtggtatgtcagctttgggttccttgccatggatgtagtggtagagggtgccatttgagacgaattcatagaccaacatgggcacttcaacttcgaggcagcaaccaagcagcttgacgacattccgatggttgatttgggagaggatgaacatttctctcgcaaactccttggtctcggcctcctccatcatcttcgacttcttgatggccactactgtcttgtcttcgaggacgcccttatagacaacaccgtgaccaccacgacccagaacacggtcagaggcgaagttgtgggtcgccctcttgagttcttctgtcgagaatatcctgaacccatgggtgcctccgccggagtgcatctgctgccggaggatcactccaccgttatgctcgaagaacttctgcttcgttctgatgagcttcctcttctggagccccaagtagagccagaagcacatgaacactgacaagaagacaccgacgctaacccctgaacacgacgccattgtatacccaatattactccgttagatttccatttttgagactgaatgtaatttttcatgatggacgacagttataattttttttacctgtaactactttaagagctaaagggaagttgtcctttgggcggcaaccgttcctgtcggtccaatttccactagtcccaggagggcacacgcaagtgtgacttcctaacatgtttgtgcagtctccgtagcatccgtacttttccggacgtaagcactcgttgatatcttccattcacaaagcaattaatttcgtcatatttgatcatcagccaaattaatctatggaaattaattgacagagttaattaagatgactgctacctgtgcatccaccgtcgaggtaggggttgccctcgtagccctggcagcagttgcaccggtagccctggccgtcgatggtgtcgaagcactcactgttcgtgctccggcacgcgtagtccgtcgcgttgcgcttggcggcgctgcagttgtagacgttccggattgcccagtcgagcacgacgggcacggcctcgaagtcgctccggttgaaatccttcgtgtcgttgtacacggtgttgatccaggtgtgctccaccaggaacacgtacctgcacggcgtcgtgccgccgcggagctcgttgtccaccgccgccgtcccgttctcgaagttgaacatccgcggcacgtagaagttgagggtaggtggtatgatgctctggcagcaccgctcgccggtgcaccgccccggcaaccgcggcactgtatcattgcccagcgacgggcggcggcacgcggacatgcagccgctgacgtagttgccggagccgtcgacgatgtagccgaggttggggcagccgagcgcgacgaggcggttcttctccggcgagtagcggtaggtggtgctgccgttgatggacgtgtacgaggaggtggggacgtcggaggacctctcttctggaggagggtagcacttgctttccggtttgaggaggacccgggcctcgccatcggccagggacaggctgacgagctgcgggtgttgctcgaactgaagcgtgagtaggcgcggtggcgacgcgctgtcgtcgcagttgagctggaagccttcatcgcgggcgcagcgggcgccgatgccgaaggggtagggaacgttgatgtttccgcacttgtcgcggcagcctgtcagctgctgagccgacgctgctggtgtcaccggcgaaaggcgacagatgagcaagactgctgctaatgcaatcgcctgcaggtgcagggtattggtagccatttctgaaatggcttgcttaatgtccggatgctacaattttataagagttaattacattagcggtcattaaacttgcaacgaagtttcacttagatccacgaacttgcaaaacacgtatcgagattcttaaacttggtttaatgtatcatcccggtccaaagcctagtttaaccgtggtcttctctatgtgacatgccacgtggacgatgacatagctaaattttttcccttttttttcttcccatcttttttctccttcctcacctcgtgtggagaaaaatactgcggaagggagaggaaggaggcaaagtggagaaaaaaaagataagaagggggaaaaaagagggaagaaggaagaaaaaataaaaaaaattcatgtcatcgttcacgcagcatgtgtcacaccccaatccggcaccgccgtacaacggcacctgataggagcgtgtcgtaggaataacggcgcgaaccgcttcctacgaaaccgcgatctcgttaccagtcccaggacatagtgctggtacccacggtgacaaatatgaatcattgcaaatccttaaaataaatagaggacttatttaccttaacttaggttgcagcttagaacagcccgagaatgcaaccgacgtcacggacgaggaaacaccaacaacagcagcagcagcggaaccaagagcagcccgagaatgcaaccgacgtcacggatgaggaaacaccaacagcagcagcagtggaaccaacggactaacacccaacgccacaggcgacggctgggaaccaggacgaaaccctaatcttcacttcacttcatcttcacttcacgacggaggaactatatatacatatatagagcaagggtgagtactttcgtactcaacaagccacgggaatttaggtgtttaatgcaagcttggaagagaggcaaggttgttttgcaaatcttttatttgaaatccattttgaaaccactaagtgatttatttcttttcaggtttgggtcgaaaagagacttgcgtctcgattcaactttaagagatgtttttcaacaactcaattgataatgaccgacctcccgggtcagatcattacttctcggctcccagagccatttcacttgattaagcggctcccagagccttattcattttctcggactcccagagtccagctgcccagcagcacaacattccgcttccactcgggaagcctagtctatgatgcccgtagacatcccgaatcacacagattcgtttctgaccactcaggccatccatctgccacataggctgattctggttacgattcctatcccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggatacctcatgccacatagaaggatcaaatcctcacataaatataggccattttagttttcacaaatcaaactccaaccacctcgatcggtaattcagcaagcttctctttcttgcttaccaggaacccggtttggctccaatcgaccccgccccggcgttcccaactattggcatgcgaggtttccctgaaccgactagttacttagccagggtgtcccattccaccttgtggttgcactttgttatgcttgatgagtttcccacaggaattggtccttatatgcaaatacgagacagtgccacataggcacggcacccgcatcgcgaattttcacaattcattttattttcaaacacaccgacaccacatgtcgggttttcaaggcttctcaaacccatttcccaaattttcgacaatcgacggtgtatgtggaatatttggtatacgcactcagagagcacgaataccgaagtaccacaaggatggagcgacaaggaatcagggtagtacaacctacaggaattagtgcgactactgggtaggtccgtcggtttgtcacgcaaaccgaggccaagcatgttatatgtgtgtgactctaaaaatgcaagttgcaaacaaaataataatgattttccaattataggagaaattgatcaaagggtgactttccttgctcaaggtcttcacgaagcttcacgaatctacgagaaatccctgatcgacgaaaatccggtaaccgcggctatacgcaaacaatcaaaacctaaacgaaagaccaaaagaaagaccctatttagactaattaatagtgccattaaatatatctcaattttacggcagtaccggaagttgaacggagtcaatcggagctacggattgagagatatgaattttggaagctcgaatgggattttccagactaggaaatgatttatcagaattttctggaatgtaaggaatggtttatggaatttatagaaataatattctcaagaatattattgacattcactgatgtgtgggaccaaaggaattgatttatggaatttcggaataataaggaattgatttatggaaaaggaaatggacgagggatgtatattagactttttcgggcggcaagggcgcagcccgagtgttgaaggaggctcggccgagccatttgggccggcgtgggcgcggggaaggcggcccattagggcgcgcggaagagagagggagcggtccggtggaccgagtgcacctcgcgggtcccaggtggggcccgcttgtcggtgacacggcccacggtgggatgggcgcacgtgagggcggcgctagggttcggtggggatggcgcacgggcggtgcgccggatggaccgagacgcgtcgggcccacgcgcagcctcacggctcgcggtggaccgcgcgcgcgagcgggagacggagggagcggcttaccggggtcagcttgacccggtccggccgagctggcgccgacgtggcgccttcgtggcagccacgcgggccggcgggaggaggaaaaggggaggccgagatggacggcggacggcggcgcggcgagatacttgttgttttgtgtaccctggctggtcctggacagggatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaattgtctcctctcgcccttcggcaattctttgtcaaacagtttttcaaaattctcctcccagtctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtgatgttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacgacagatcagtaggcaagtggtttagtaccttatctttagcaacccctctcttcctcctctcttccgccctggcagaagatagtcagtgttagagagaagagcaacgacggtgtattaaagtcaccaatcaatggttcagttgaaagctacaaggtatcccagtgccagaagaaccctgctcgtgatcaacatttggtgtccaagattagatgatggatgtattgatgcgggagatgcaaagtccgatgcaacagatgcaacaacagtgtctccaacaacaagtacaagctcagatgcaagccggaatcaggatcagagcgatagtcagtttgttttcaaagaggaagcacccgcaacctcagatagtacgccaccaagtcctcagcaaatcagcacagctaagccaccaccaatcccaggagtaatatatgctacctattgtggttatggttttcaagcgcagtttttgcaaagtgtccatggaagatgtatgacagggcacatcttagagggttgttccccggtaagacgtcagcgtcatcacatccctaactcctcaagttgtgtcagttccaatgcagagtcgatcagttcagttttgaggaatcaactatgcaactcgacaccgaagtcaagctagaagcaggacagtcatgccagtagttagaacttatgggaaagttagtcaagagtcaatgtgtccctgagctaaatgagagtcacttttatgtggaatctcccatcagcaactgaggattaagttccaaatcttgctgggatgaaagtgcgccgtcattactctattttgatgaatcggtgaagtttcagttttcaaagtgagggcctttgtaagcaagagaagtgttggttatttttcaaggacaatagtccaattgttcctagtcaggagaaagtaagactactccctgtaagggggtaggtctcggagatgagttttggctcacttcgtcgctgttttagttgaaggttcaacccagtgcaacaatccgggtagtacttgaagaagccagttgcaaggtgtcagcagagtcaccccaatctcaggtcgacaggttcgattctaaggtacacctgtgaagcatgtcaacagtttagcttagaaaagcaacagcgaggacagttgtagtacagacgaaaggcaggtcaagcaggttttcctggaattacttgtcatttgaattgggaccagtcgaagcggacatagggtaaatgatttacaaatgccagattcaattttcatcctcttatagccagcgtggtgaattctaccaaaattgccaacctcaacagttcagtccaagataagtaagtttcaggagcatccgcagtcctagtctgggtcagttcaagcagaaccagtcggtccagttttggcaaagcaaaggaacagaaaggtcgaatccagccagttcaatcgtgcaggtttgatcaaccagtcaatcaatcagttcgaagcaggatgtggcagttcaatgtgcagatcagtcagaccgccgaccagcaccagctttctttctagccatcccagaatctcgggacgagattcctgtaaggggggtagatttgtaacgccccgattttcgttcgggattaaaaatcattaaataatgcattttctagaaattaaataaaagttaaatcaatttatccaagtgaaataatgggagaattaaaattttcccttaaaaatcattggccgggaatattttgcaatattctttgtgccctaaaatactctccggaattttccgtgaattttcggagctcgagaaatagttttaaagtcacaaagatcatttaaccaattaaataaaaagaaaacaaatttaattctcctttcttccccttcctccctttcgggctcggcccaaattcctccccctccttccttctctcctcgggccgccggcccagcgcgcctcccctccccaagtctgctttgcgtccctgcgcgcctcctccctcccctcaggccgacaagtggggccgtgggacccgcttgtcagacccttcctctacctccagcctccctcatccaaaccgctgtgccgccattgccgcccacgtcgcccacgattccggcctcttccgctcgcgccctcgcgcccaaaccgcatgaaatcggttcccatccacctcctctacactctccccatgtttcccccaaaaattgtgccgggatcgagctccacttcgcccacgatgtcacccacgtcgcgggtcattgccgccccaaatccgccacgcccggcaacggttttccctccccgagcttataaaatccatccccgggctcccttctctcgtttcccctcctcgccggcgcttccctcgccttctcccgctctccccacgccgctcccgcgcgccgccgctctccggcgagctccggtcgcctctagccgccgccctctgtggtcggtcgggccagccctggctgtgcccgtgccctgccaccactcccctcagctgcccgatcggcttggcccgatctgggccgtccatcccgtggaccggcggtggaccgtccttgtggtcccggtccacggtgcaccgagctccttgacccgctgacgtgtggggcccgcgtgtcggcgccggctgccccttgctgacgtcagcgaggtcctttttcctttgtaaaaataattaataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctatcctttgtcaaccttgggtaataaattgactagcttgtgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacccctaataaatcgacccaatgcactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttggatccccttgcacgtctgcatcgttggtgtggcttgctgagtacggtggttgtactcaatcttgctattattccccctttttcagaagcgtagtgcttctgggctgaagacgaagttagaggaccaaggctcagaccccagttgagttttgcctgtggagtggagctgaagccccgctgctgctgcttttgtttcggtgtgaggactaagcgcctcttctgtaagtattttacgctttatttacgtttggaactgtatattacttgtcgttttgtgtaccctggctggtcctggacagggatttaatacacaaaatagtctggaaatttgggctaaatttctgggcgtgacacatattaaaccaagtttagagatctcgatgcacgttttgcaagttcgtggacctaagtgaaacttcgttacaagtttaagtaccgctagtgtaatttactcattttataaatagactatagctggcaggtgaaatatctaggattttttttctcaaaatgaaaatgacgtatctagatttgtacacgctcataattaattaattgattggagatttttctttgggaggggggaggggggttaaaaattgcatgctaggtgctttcgttgaagaggttgtttgtttgagttttgacgcacgcgcttcgtcgacaaataagatgcttagcagggtgtatactattggttgactactaaattttgagttccattgataacacagttttcgacaaatttcgaccggtttttgataaattttgactgaatttcgaccaaatttactgtttacccttcgaaattccaatcgaaaattaattccgagccatgtcaaaacgtcgaaatttcgtagaattcgaccggttttcgttggaattgtgaaccctgatgcttagttttccaataaaagttgcgtgctgggcactgtttgtatcagtcatcaacagatcgatcttatagcacaaaacaatcttatagcacacagcatacagcaacacgaacatcagaataacaaacaagcacacatacaagacttcctataaagcatacgtacttcacaacccggtgtccacagtcaacggaagaaatcaacctttgagcctttcaaaaccaaactagtctgctctacatcagcctctacagatggacatcaacgaacaatttatatggaaaaactcggcactccccaaggtccaattttttgcttggctactgacaaaggataggctacccacatgcaagaaccttcacaagaaaacaatcatccaattgccgttgtgcgctatttgtcagtctgctgatgaaacttcaagccacctttgcttcctatgcccgtttgtggtcagcttctggaattcaatccacagatatcctggaggcgtgcacactcatgacctgcacttgattgctctaccaaacaatctgccgcaggcacatttcaaaaccttctatctgctttgcctatggagtactctctccgtccttaaaaaaaaaaaagacaaaccctggtttccgtgcccaacgtttgactgtccgtcttatttgaaaaaaatatgaaaaaaattaaaaagacaagtcacgcataaaatattaatcatgttttatcatctaacaacaataaaaatacgaattataaaaaatttcatataagacggacagtcaaagttggatacggaaacccatggtttgtcttttttttttgagacggagggagtatttggaatcaccgacaagaagttgtcttctctgaccagcaatcatccttacatcggcttcttctccgctgtaaggatgagactactctgtggacagaacgacttcttctgcgcgacgatcgcctagttgctataacctggaaatgtattttcaacatcgcaattaattctctacacatgtaatgcgtgccgctggttacgtctgaactctatacttgtaaacctcttcaaatggtaatggaaattcaggtgggaacctctccctcctgtgattattccaaaaaaattgcgtcaaatttttttttacgtaaacaaaaaaacccaaactagtactgtacaaaatcgtacacgcttcgtactagtttctctggtggaaggtcatcagggcctcggttcctttcaaaaggcttattcgtttcaaacgaattgtaaaggaaaagtgcaggactatgcaatcctttgaaatgaacactgtattgacatttgtttcaaagaaatgcaccaaagaaaaaagggaacatatcctaagcacataaaaaaattttcgtgcacaccaactagcaaatgtcacaaaaaattctagaaaaaaaaactaaagatgtactcttaatagtattacacatatctacaaactctcatatttaaatttattatattttagccgtgacaaaaaagacaaaattctgacaaattttatctcttaggccttctttatttaggtttaagttttattggcttagacttttaagtcaacttattggcttatataatttataagccggtggatttaatgtcctaaatttagtggtggagtcatacatctatctcatataagtcaaaaattaaagcttctccaatatagcttttggcttaatagtgttagagtggtttatggcttcaaaaagccaaacgaaaaagctgcttgtttgtttaggcttagattttttggcttataagcctaaactaagagggccttaaaactgtcagattttcacttatttgttacggctaaaatataatgaatttgaatatgagactttgtagatagtgtaatactattaggagtacatctctaattttttctagaattttttttatgatatttgctagttgatgtgcacggagtgtgcatataaagcttgtatgcataggatatgttcctaagaaaaaaatttttatccctccacttttagagggaaaacaaaggaaagaataatccactccaattcaatgttttcaatcctttggattgtttgctacacaaccatagggaagtttcctatgttttcaatccttaggttacacatgtattcccatactattcctccattttccctatttctacgttttgaaaatcctacaaaccaaagaagtctttgcaacaggctttcacttttcctcgctcctcgagttgaattaagcttcatccaacaacatatgtactccctccgtctctaaatatttgacaccgttgacttttttaaacatgttttaccgtttattttattttaaaaaattaagtaatcattaattcttttcctatcatttgattcattgataaatatacttttatgtatacatatagttttacatatttcataaaatttttgaataagatttatggtcaaacatatgcttaaaaaataatgttgtcaaaatatttaggggagagggagtaccatgtaaagcaacgttgctctctggatggattgacggtttcgtggttgaaagatgaaagccagaagattatacaagcgcggtcttcggttagtgcagtaatgcttgtgtccttgtaagctattgtttcgttccaatgtttcagcagcgatgaaaattcgtgttcaccccaaaaatgaaatttttttattgtcctaccgaaaacctaccttgcgtaaattgacatggcaagttgtgttgtgtattgaggactatcggacgaagacaaaatgtagagcaaaggatccgctagattaggttagagaagaccaaacacaaagctgcgttgacgatgacgaccgcacgaactcgcgctataccggccggcccgcaaatgcgggagctcggcccaactactcgcgtacgtacatacgtatacggcccaactagacgcgcacgcaatcccgtcccggcccaactcgagaactgctcggctgccagcccacgtccccgcggcgcacggcgaaattgctcccctcccatgccggaatcccaaaaccctcgccaaaatcgccgcctccgcctattcgcgcggcggcggggacgcagctgcggaagtgcgggggggtcaccgcctcggccgccggcgcgacgacctccacatcctcgtccattgccatggtacggcgtcgccagctccaccttctcccccctctccttcgctgctgtttgcggttaggaacatacaaatgcggaggggccgcggcggtgtccaattttagttaggttttcgaaatttcaatccctggtaggcgcctgtttagtagcactagtcaatagttctgtagattgtgaaattttgaagggaccctgtgttccttacttagtaagggctataattgggctttcgtagaggaagaactgtgttgcagcagcttggtctcttcttttgtgctaccatagggccataggtggttgatgacagagatttcgccgaaaaaatcactgtagttaagcttggtctacctcacaaaactattggatctgccactattccagcttgtgcctttcaactgagcagtttaatgacaatgttgcattgtagtccttaacaacagagaattgtatccccatgcgtttaacatcgtggtttgtattcaacagcaaatttgttaaatggatcagtttcgcaaactatcacatccgagtatgtatgcaattcatggcacgctaatctcatctgccataccattttactgcctctgtttttggtgagctagtccatttctcttatccttttgatgccatgtactgtttaatttccctcaatccacattttttggatctgttagaaccctgccagctttatgttttgcaatttatgtgataccaaagctggctttgcatagtggaactgtcagccattttcagtcctgattttctcatgtgaaatttaattgttgttcacccatttcttcttcttgtcagtaaatgtgttgtcttgaattgggatcatttactcgctgaatcatgaatacatgcagaactatatacgttatactgtacatatattgcagatgaacagatgggcaacattgattgtcttgtaatctttaagcccatcacatgcgtctattcaggatccaccactaccttgtcgggtggagttcatttcgtagtatgtttctttctcacttgcgacttgtctgaattgaaggtaattgagggcatgtgtggtaatttgacttgtacgagataactctatactagactttctttttccttctactatcaaatggcccagttattacattgaattatcacaagttgcttttgtgcgtgcatcaatttggtctttttttgcatgcaaaccttgacctgaacttttgaccagtttgatccaaagttttctttgtaagcatgcaattttctgttcaatttaccagtattatgtgtattttccattacccaacaagcttcatagaaagtaataactaatgtacagtgatttttctgtccaggtgtttctggctgagcaatacacaccaacatcatagatattgcaggttccctccagaagcttgtttcctgagtaaatcaccaatgctgggttcaatgaatgcatctttggtatgttgtgccaacccaagcaataataggccaaggaattcagatatatcgaggcaacaaaaagatggcctgctttttgggaaaaaaaaagctttaccaagaaatatatatgactgtgagaacatttatgattttgattgttatatagtgttctccaaaggtggtccagccatctctgtcctctggggcaagcaattcacgcccgctggcaacatcaactccagggataaggtagaagattgtagagctatttgaaatgatccaggcacaactgtgagcgaggtcaacatccggagcacaaaaggcctgaacctacagaagatcagtgggagaggggcagtgttgatccaatccttaatttgctaaggaaacactcatggaactcaaaaggaagatcaacgatgggaaagaactgagttctgatgaaacgtggagaggcaatgattctgggaattaacagaactcaaggatctttggtgtgaaaaatgacatttaggaagagcgaacgtcctactgcatacaaggccaactccaaattgcaggcgaaggtctcttgttcgtggagtgaggttccagcctgttgttaccaatggcgatatgcagttgcagatgccaagtctatcacagatagcatggttgataatgacaagtctgtcgcagatagcatgattgattattgcaatggttgattgacaatggcaatgattgaaaatcacagatagcatggttgatgctgatctaaaaggtaagatatcaccaggcatgtttttccatacgaaatatgaccagaaaacatgtctttggatgactttggcattattccagatgatgattaatctgattcttcggatactaaaccttacgatggaactttctgatgttactggtagcaatgtatctcatgataagatcatggaattttcttgtgcagaagctctgatataaataagctctttcaaggttctggagctaagagaacttgcgaaatcttgaggaatcaagggctattaaaaaacgagtaaaaataaattggttgaactgttgagcaacatggtctgcttctgatccattaacgacagagtctgaccttgtatttgagccattctgctcaactatgtcctggacatgtgtgccacgtttgttttgtcaataccaatccatttagatagattaacaatgtaaattagtaagtttaacaactttacgctgttctgtgttgatcatgtgcagacctacttttttctaccaatttaagcttcttaatgaaacagctgcatttcttgtcttccctctactgtagtgctgttgacccttgattgcattgttttacttggcgaacttgtaaagctagctctattaacctgggaggtcctgcttacattgttctgatctgttggtgctctatctgtcaggtttgcgccattttctttaccaatacaaaaagatatatgaatggtatcgcctaatattctttttctataatgcaggcaaataaaggtgtatctatacagttctgttattgactgcggctgcagctttgctcgtgaagcgaagaatgaaagcggcccagtggattgcagacggcagaattcctggctgcattattgttcggcctctgtcttctcgtccagtccaagagctttgcttgtgtgttgcatcctgctgctaatcaatctctcgtgatccacgcacgcggcgtctcttggccgtggccggggccctcccctcttgatttctgggagccgtcagatctgagcgattggacggttagttcccccgtctcacgtgcctctgcccctgctgtcctcctcccctggccctctttgcctgcctgtatattgtctgttggaaccctgattaaagctgcatcccctcgttcgttttgatacgattgcagatcagtactagcaacaaatttccagtcgcgactctttcagaaaaagaaaaaggattcagtcatcaatcactagagagaagtaaaaagaaaaaataaaggtaatcctctactcctctcctctcgaacttgtgtagaactactttctttgtctggtcgcctcacttttgcagccactcgatcagcatgcatacctatataacttttatgcatagcttgctttctttcttttgctttccgtcatcactagtaattaattaaacttctagtaattcttttttttgcgcaaattcatggccttccaaaggaaggcctaattaaatagattgttaattagggctgttttggtttgatgccaaaattttccctaccaaatagttggcactttaaatagtaccttgtagatatttggtttgatgccaaaatttaccaacggtaatataattcctataaaccaactttaccaaaatattggtagtgccaaatattatccatgatttagcactactaatgatttggtagggcatcaaaccaaatgagcccttaataaacatgaatactgatcatatgcacatgccgtaggcacgagtcacacgattagaagtctagaacagaagcaagatacaaatgtaggtgcatggctgttggcatgtactccgtagggatagtagaagcgcagctggtccatgtatatgcatggagatgaagaagtgaactgttcgaactcggcttggaagttggaattaaagcacgacgaggccaggctagcaagctagcttctagctgggttactggaacccggccaatactgttcgtataggtcagtgccagtgcacgagtcagccatgctgccatggcgtcgtcgtcgcatgccaatggcttgcatgcatacagacagttcaaaactgaggatgaccagtccacatcatacagcgcccgtgcatatatatgtacgtggaccttagaccatacacatggagtttgtgaatttttggtgagcttatttcctgcttacatcacactttgcacatgtgacggagagagataacatgaaaatataagagctggctatcatgcaagagctatcttagcatgtgctcttagaaaaacaaattaaatagatatgtgagattaagacaaaatggtaaagtgtgtatacaccttgtagctccaaaaagttaagtagatatcataggtatattttaatattataaagacaaaatggtaaagtgagtggattatagctatatatgtgattacatatagctactagttgatatatcgatttactatatctatttcatattataagtcactttgattttttctaagttaaatttatttagttttgactaaatttatagaaaaatatgacaatattttcaacataaaacataacaactatcaaaatatattcatttttagatttaataaaattaatttggtgctacaaatgttgctgtatttttctataaatttggttaaatttttaagaagtttgactttagaaaagtcaaagagatttataatacagaaggtagggagtattaaacttgttccaaaatgttgtgccatgctcataatcttctcccatcctaacgagcatgctctcttcttctgttagttgctagattataattttagaatcagggcttagaactcgatcatgtagtagattgcgactcataaaataggatgcaatcataatgtttgtggaagtaagtattgatatatcataacaaacgacatgcatgttttcattccgggagcacacacacatgcacgtcctacgatatgtagtcacgtgtagtttttacatgcaatccaagctagaaagttccaaacattgtactgtgagatggtaaaactgaacaagattgacggccggtgtggatcgaacaggaaaagaagctagaagatggggagggcgtctatctgggagctgaggtcgccgtcaagattccactatcagtggatgtagaaatacacaggtacgtacgctgtacctatcgatctctttctcaagctaggacaaaagcttagctagctagctagttgcattactactggaatgcatatagatgagatgtgcaggtgcagctggctagtcccacgttgcgtgcatcgtatgcagggagcaaccagtccatgtacagggccgctccctcgttgctgaccggcggccggcatgccggattcccggccgctgccttaatcctgggccccgccggccggcgtatcgccggtggggcacccggccgcgcgcccgcgtgccttcccccacatacaccgaccgaccatcaccggtgtgtgtgcatgcatggccccggcctcggccccgatgtacatatgtaagcatatactccattctctaaatgttttacgccgttaacttttctaaacatatttgtccgtttgtcttattcaaaaacttttataaaatatgtaaaactatatatatacataaaagtatatttaaccatgaatcaaataattaataattatttaaatttttaaataagacaaacggtcaaatatgtttaaaaaagtcaatagcgtcaaatatttagggacggatggagggagtatgtgctagctagtacagtgtttgcacgcattgcatgcttagttaatgtgcatatttgatcatggtctcgaccaaaaccacggccttttgaccgccctagctatatatgagcatgtagcatataaaccatcatatcatgcccgcctgtctcgatcgatcgatcgagcgatctagtagtagtggcagtatagtatgtgtgtcgttcgatctagtgatgagatagaccgtgcaattgctgtcaagtcatgagaatcagaatctgaatcagagatggtgctgttgcatgccatgaaccaggcagcagcagctgcacatatgcagtgctgctagctaagcttagctagctgatcgctgtacgtacatgtgtccacacagtgtcaatcagctggcccttctgcctaccttatgtgtgcctgactgcctctcggtcctcgggcatgcagtaacgtagtaccagaggcgtacagctccctcgttttcgtcgttgcagcggcagcgatgaggggggcagcgtacttgcatatattcaccaatgtgcataggttctgagggtactttaccctgctcccagcccacggaacgacgattgggaagcctactttgtactagcgcactgcgccccatttccatgtagccatagagatttattgtatgtagttgatgggtgctggtcaatgtgcccagggcataaactgtagatgcacatatacaatcctccttctttccgcaccatatgcatgcatttgtgctatagctaggagtactaattaatattatcaccaattagaagcctccatctaacccatcacacacaaaatgcagccaagaaccagctagctgttactgttaatatatagacatgcagtgttgcatgcatgcaatacaatgcaaatgcagatcgatcgagaaaatgcgcatgcagtgcacaggattcgtggtgatcacaatatacaggagcagtacatgttagatcacggttcagtgtgcccaagctttacttcaggcaatgcaccagccaaaactccaaaattttgcgaatgaccattggttcgtatgcttgcagatgatgcatgatatagctagctagcaagaccacacacagcaggcaagggtaactagcaaccccctttagtctacagtcttcttctcagtctcgcactttagctgccttcctttatttggacagacattctatggctcccctaactccactgctcatttatcatcatcctctcctcgatccctctgcatgcccatgttcatcttatagctagctagcagccaccgatccatgtgtatgctcatccatctaatttctagttagttcctcatttctatgtcattttcgtatgcccaaaacatatattctaataataattttggcaaagttaacttattttgactatacagattctagaacgacacttatttgtgaacgaattgaagggagctagcagttggcatctagtttagacttaaaaaatttcccgttaaaatttttgccatagtcacatggtcgtaggagtgaaaactgatcggatattatctgatccgctctgaatttgatcggatatggtataggtttttagaaatctagtgaatatggatgcggttgcggatatgatatctctaaaatcctacggacgtggattgtccaacattctgctagattatccgataggtcgtttcccggataattcgaaattattaacccatataaccactctatctgttgcatataacatgagatggcgcatctaatggcctaatttaccaattaacctaaatttcttagtttgaggctttcaccatctatatcacacttgttagttgtatttttatattatgaatatcatgtattcatattgtttggtacttaagtacataattattaagatgggtcgttcattgattattgcattgttgtcccttgcattactaactcgatggtgtattttttgcatacacacataacatccgataaatttaatctgtttccaaaccgagtccacaccaactccgcaccattttggacatccgaaacaatcagctctgcatccgcatccactccaaattcgcttaaaaaatgctttaggatttggtatgaccactatccatccgaatctgttccgttttcacccgtacaaggtcgtgtactaatgtagcatgcattatgcagatttggttgtcccatgatggtgtgttacaaatagcttttattaatattaattctatagatatatgtagctgaaaactaaattttaacccaacactttcttttaagaaaaaggacaaacgaaatgtacatatatcatcacctgtactgcagtccaagctacgcgagtactctctccgtcccaaaataagttaatctagtagatagtaccataaatctaaataggagaaataagttaatctatactggatatgacacattaattttactatgaatttggataacttcaaattcatagtattaaaatgtgtcacgctcgctattagattaatttattatgaccaggggtagtattgattattctctagtagcactcaggcaaattttagtacatttatgttctgaggcaaggacgagtacaatcatgatcgaccggtgcgcgcgcctctttggccgaggcgactgtcgtgcatccatgtcgatcgttctgacatttaattgtttgcccaccggccttgatagtaatcggtcagctggttatagttgagtgttggatgttgcactggagatggagagattagcaagcagtttctgtttatgagctgacgtatgcacggagatattgatggtaggtagcactacacgaaccgtccgaatcagccatatacactgattgaatgtgtgtatgtacgtacgtagtcacgtacaagcgcttgcagcctcgcatacatcatatctactcgaggtgtctacttcatccctttggatagtgatgtaggccttgtcattgtgtcaataatttgtatatggagttatatacggctctgatcggtcgagcagtcgagctgctacgtttgacaagtcaaattatgaagaaagcaaccaaagttaatacataagtataaatttaagttttaaaatttaaattttgactgtcgataagccaataagatgaggagaacctatattcgggcttaggtttattggattaaactcgtaagcaactattttttcttatatggtttatgagctggtggcttttaagccctcaagtgtaatggcgctacttaaaaaaagatttttgtatgtggtcagaattgatcttcgcaagtggctggcggaccgcatgcacgcaaatgtctgcggaaatcagcattttcgcatgcgggaggcccaactgcttggggagattcattgttgcaggccgatgagctatgtgagctggttaagtcactgaaagtgtcattcttaaatgtaaatattacatttctcagctccttagcaaattcttgatatagtgtatcaaaggtcttccactaaagagca

SEQ ID NO: 12432 - DNA, 18876 bp, Oryza sativa
  unsure (1)..(18876): unsure at all n locations
tgttgcttgttttgaagagataaacttttggttgaaatggggttagctcgggttgggatcaaatatatgggcatatcatcgcgggcaggactcttaagggcccgcttgcaataaccgcattatcgcaagcggccctttaagatgccctcatgtgataatgcacccattatcgcaggcgggtctcttaaggggggccctgtgataatgtgttaccacagacgggccttaaactaccccgataaagtgatttttacatgcggaggcagttacggcctgtctgtagcctggaaagggcattgtccgcaaaaatcaaatctatagcattgtggtggtgtcacttttccactttatacaagcgaaaaaaaagttactccaacttagttttagcttaacagtataagggtgacttgtgcctttataaaagctaaacgaaaaatttgcctatttatttaggtttggacttttttcttataagttaccttgtaatatatcgtgcctgaaaaaaaagagggcagctagggacaaagctagctagtagcaagctcgagaggtggtgaacagagaagaattcaatcccctttgtaatagtttgaatcttaatggttggagttgtatgtatactatttatgtaccaaaacgcgtgtatgggtaaggtagtaagaaatataggattgagacgaacgttgcccatgcttgctctcgatcgatcactttctctttctttctagagcagctatgtgcaagttgtagtatcacattatcttgtccatctctacccatctagcttaaatattgccactctcgaattctcatcagtagccaatagccggtcgatgggaactaatgattttcctcagcgatctgcagggctttttgactgattaggacgtgtcgtcgccgtcgttgcactgcgttatcgatcgattgatcatccgagcatctcgcgctcgcgggcccctcgtgcgggcgcaacagtgccatcgattgctccctctcatggctgcataagaattgcagtgaagtacactacccatcctaaaatataaggatttctgagttttataagtaattataaaagtagataaaattaaattaattatgcttagacggttagattaagatgagagatgattacgatcgtttgtaatgaaaaggtagatggagaagttgctatatcatggaacaaattttagacaatacaaattgctattttttaggatggagggaaaagtcatttttctgtatattattgtttggttctgcgtcttccacccatgattaatttgatcgatggcgacgctctgaaaatgacattaatatacaatcgatcagttccttaccgtaatatgctacatgctcgcttttttacttcaaaaggtgaatcatgtgtgtgcaccaggacttataggtcaaaagtagatccaacaaacaaacagttcaccaatagtattacgctccacattcatagaaactagcgatctgtattttatggatctgaggaagagaagagaaaaaaggcgaacttcgttggagggggagtatcgaaaatccgatggtccttgagggaggcagcaacatgagattgtgatatgttggcggcggcgtaccgcaagctatggcatagtaggaggcgacgaaatagaagcgggaggtatagtgaggcataaggcagagggaagtgtcggatttcggcattccttgaggtggtagcgatggggatcacggtagtagcacatcgtcccgaaatctcataggccctgggaggtggcgtgcggcattaacggacttggtattggtggaacaaacgttgtgctgtccgccagccgcactttgttaccggtcgccgttcaacactggccccaagtcttccactcactttttggtattaccggtgggtgtaggtggttgttaccgttgcagttgtgttgtctttcaagtactaatatcggtgacgcctatgggagtcacaccttcctataagcgttgccgcgatgcccttcccggtggacatccatgctatgcgatgaactgtcccggtggagatgatgttctagatgtctgaaatagcgatggtgatatttaagatgtcgcaaccttcttgaagtcatagcattggaggtttcttgttagtgtgatgtccttatgatggtgtccccgtcgattcgtatacgatggtaattgtggtggtaatctgggcggatgattgttaactactctttgatgttgacttcctctttggtttgacgttagtttgctgatagcgatgggagcgaaattcaatcaacaaatgatgttgtttttatggtttgataaagacatgaactaatacaagccgttggtagaaacaacggttatttatacttggacctttttagggtgctattgttgtttttaatcaagccataattgtaattcataattattcatcggggagactctataaaagttggttgtaacttctatggagtaatgggaaaaaataatgctattataaaaaaaaaattacactccaccttcataacccgtattatggcatgatgtttcatagaagcatggcgatatatatgtgcatatagcagccgtaaaccctttttttttaccaaaaagcggtcctaaattttgacgattgatctgtgtaaaaggtttaacatgtagttaccgtggtttaaatgtatggtttacctgtccaacctattcaaaatctccattatatttcggacaaattagctactacacatgggtcttacagttggcaaccactaatgggcccgggtattataaatgcatatgtacattctttgaaagttcccctaaatgcttagcccctccagatgggacgagccatgcacatatgcatatgcatcatgcatagaagctaacctgaggttttgttcttgcttttttctacaaggttttgactctagaaactttatgctttgagacgtgaacgattatatggtctgcacactgcgaatgtggtgtttaaacttggagtgttatcgtttaaacgatgtgctcgaatgttgatgctatgctagtaccatttgtagtgaaacatatggcctcaaaggtcgatgcaagccaagacatgggtaggccatgaacgtcttgtgtcgtgtgccgcgctatagggccacgtacagtaaatggtgcccatttagcaagagtcgatactctgttaccacttgtaacacaccatgcgacaaccaaaaataatccacactgatcgtgtcaattgtggtacaccgcgcgacaataaaatccacacaatgtctaaacacccatgtggaacatctgtgtatgggtaaaatctcacctggattctacttatttagaagaaggagagagagagagagagagagagagtccatttttctactttaaacttttgagtctaaaaacccctcaaaatttgaaaccggatactattcaataacgtaaacaaagaaatccgtcactcccaaattcacctatattttgagtttttttgtgtcaattggcaatttaattatgtggctcaaaccgaaaaacaattttagttcaattgataacttacaagattttgcaagttttctcgtttgcaccacaaaaaacaatgtttcaaattaaacaaaataatctttagtggaataattgcaatccattcaacactatatataatttatctagcctgttgatactgctatatatatgtaacttttctttagcaatttcttgagtgcacttaataagttttataactcaaaagcattatttgaatttagaaaattaataaatggctttgaacaattctagaatttttttaaaggtggacgttgatgtatttataaaatttatcgatccacaaaatatttgtgtacttcctccgtttcatattataagactttctagcattgcccacattcatatatatgctaatgaatctagacatatatgtgtggctagattcattaatatctatataaatgttagcaatgctagaaagtcttaattataacctgaaatgaaggtagtattaaactatattttttgcattccgattgtaataaatttatccaaagttacaaatatgctgatagcaaataaatttttataatttttgttaagacctctagctagggcgatcaagtagctatttttgcacggcatgaattaattaaatgtttattatttctagtatttattttaagactgttcttgctagtaaatcgtgccgtactgcaattaatacatgcaatctgcaacactgattactgtcactgcatgtgatttactttccccgtcccataaaaaaccaatctaactagataaataccccgcacaatgttgcaggagaattgtgtgataatagaaggcacaaccacccttaacacaaacaccaagaaataattattatcatcttgtagtttgaatcatccgagttagagaatgtgagagtggaggatttaaaaaagtagtaatttaatggaaaatatatcatagttaatggtatgcatgcatgcatgacttatattattgaacataaaaaaaagtggttgtaccttatattatggaatggaggtagtatatatgagttctaaaattttcttccttatctactatacggtttttttcatgtgtttatctattttttatacttttatcaattattcaaatgttataaataattgggttgtatggtatgccttttgggggaaaagatgcaatttatacccttgatgaatcatccaaaggctaaaaacaattaaggtgatgtggctttatgagagaggagagaattagcattaactacacttactcgggatgaactttatagatctatataggatactggatgtgacacatcctagctagtactatgaatctagatatatctttattcagatttgtgttctagatttgttttatttgggacggagggagtaggcgccaaggtatcccaaaccactggggccggagttatcgcgccccggcggtaagcacggttaccgcgcggtaaccacggtaaccgtggcaaaccgtacgaaaccgtgtaaaatttatcaaaatttcaaattactttttaaatttatttgaatttaaggaggttaccgtggttttctttttaccgtacccccacagtaagcgtggtaaccgcggttaccggcggttttgtaaaccctggtaggcgccaatgccatatatgaattgtgtcgaattaattaattagcttgtgggtaagtagctgcatggagcattaagggggtgcttgaagaaaggattagggtttcgtaaattgcaatgagtgggatgccagatctatgatctatctcctcataggcttatatatatgtttgcaagtactagagcgccctgtactctgcgttgtgttgatttccgaaaagaaaaaaaaattaccatatgcaaactaactttcactacttgtcactgtcgtcctcctacctcagctccttctccatcgtcgctccaaacaactttaatttcaaactcttccttctgaaaaggcactgttcatgcatgctacaccccttcactctctctaaaaagttcgtgtgtttgtacatgggttgtgggcgcgtacattcatggccctactgtgccgaatcgaagagagacggtggccgttgtgaagcagccagcgacctgttcaattaatttccttgcctggtataaatttcttttatgttctgcaaccatgcacggctacacggagcctaatcattgataattcaaaatagtaatatctaatcgttcatttaaggacactgcggtaaagaaattttactatctataagagataaaaataattggtatcttatagtatctgagatacttgagagctatctatcaaaatttagatttcaaagagtgtgatacctctcagtattatccacttaacattgccacataaatgatcatccatgtcgcctcatcattgtcggttcagtgtgaaccgacagcgatagcgtatcattgtcgatccaccgtgatttatggtccaaactgatcacataatccagcagttatactgagtattattgtcggcttttatcacaaactgatagtgtttgtatcattgccagcttatgccatgaaccgatagagaaaactggttgaccaacatttgaccagagctaggagaggttaaaaatttcctaaggctccacggctgaaaacataagttgttggtagcctatcagtcgccacccaccccaccccaccccacgtcaacaaaatcccctcttcttctctcatagtttccctcttcttccttccctcctaatctgaccatggtgccaaccgcaccacgctagctctcttcctccctgtgtacctctcccttccctatatcgagccctttccccctccccctttttttccctttttttttcccaagtccaggttgaggtctatcttccctccctctcccatgtcgtaggcagctggtgtggtaagtgaggaggataggagacagctggcgaggtggggtctagatccagtgaccccgagctaggagtggccaaattcggcccacgggatggcagcggctcacgtggcatgatgacttgtaatctctgtgggatcctttgaaacaaaggttttattaaaggaattttgtagatatgaatcctttggaatattttcctatatatatgctcctttggataaatggaatggaccctttcaaattcctggaatatggccaagttcataaggattttggaggaaatctaacatgagctctaattaagctcttggaaaattaactttatgccatcctctctctaaattcatatattgtttttatatgaagtatccaaacaatacaattgagcaattccttgggatcacattggcatgccactccaattcctatattgttattattcctatgtttctcaattcctacgttttaaaggagccctcaggagctttgtacaagaccagctaccatatcgggggtccacacattttatgataactagtttcatgtcgtatatgtcctctaatagttctggatcaccccattagggattagcatgaagtacaaacccagtaacggttgcatatatcttatggaatcgttatatatcacttgatttcaaacggtttctgtgagaatcgttagagattagttgtcgaagattaattggctagctattttctagttgtgtacattctagcttagtattattgggcatgcatgtctgtactgtacatgctcaatcagtactgagcattcatatgcgcttgtctcctgcatgtatgtgctcaaagctaatttactattcgatcccccatttttttggccagatcgatgcacacaaatggactcgattctgccacaagatatgttcggctatatatctcttataaatcttttttagaataacaataagcagatctaacttatatatatgtttattggtcatatccagacaaaatataggagaaaacgtaatttttgatattggctaaactagctagtcataaattttgaaaaaaaaattgatcttttatggttaacatgcatccataacttaatttgatcactatatttttaatattatgtatcagtatactagctatcaaattataatattgagagattaattaaagcattttatgaagagtttactcctatcattttcatatagccaaacatactttctaggcaagttttggttagagcacattttgactgcacacatattgcaggcaatatataataaatttcccctgcatgtatctcatttttatttcaatacctaaacacgatatatttgcaaaaaaaagtcagatacgatatagtttctcaaataataaattttcccttgatatgtttctcattttttaatacttattaaacgctagtatttgcgggaaaaaataaaattcagatacgacatagtttcccgaattaagcagatatagataatctaggaaacaatttatacggtatatatgaaaaataattaagggcaggggcatatcatgcatgagagagagagagagagagagagagagagagagagagaggatgattcagcattcaggtggatgggaacatgcagccctgaccacaccagtcaatggtctacagcaaaacactacacctacaatacgtgtacatataagggatgcacatatataataagcatccaacaatatatttgtgcaccacataccatatttcatgtcgtctacagtagtaacataagtggcctgttcactctagctacatagtgtgcatatttttctatcagttgtgtgcccgtgcaacaccgatgcacccatccatcccatcatatgatcctatccggcggccacactgcaaatctgcaaaatgatagaatttaaaaacacaaaaaacaagttagggtcggtcaaaaatcgacaagaaaagcagcagcaggagagaaacaagaggccatcccctccagattatcctgcagtcatgtcatgcttctcccctccctgcaggcctcaaggcatggaaggaattgcaaagataatattattgctagtacatggatggaatatatacttgaaaatgaaatatatttatacaaacatcctaactttatattgttcaaactttggaattaagagagtgaaaggtaaatgggataaaacaaaaaagaaacatctttaactggtaggtgacatcaccaatagtgagacactttgtgacttcagcaatctcaagacatattagctgtaatttctggtaagtgtgtatggtgagtttgtatattacacctcccagaaagctagctataaatatgcacacacccaccatacacactttacagaaattatggctaacatgtctgaaattgccgaagtcacagagtatgtacagacgacgacgtgtgcatctgtattgtatttcgaatattaatttctctttaattaactttcctgtcattttctcaccccctgagtagctagcaccaagctgtctagccttcctataccctactaggctctactacacccatttctacctcacacacctagctagcaagtaggctctctcactccacacccacactactcctcccaggctgcctgcctaaaaggctagacctatccatctcttccccccactcctccagcatcgccatcatccactgttcatccactccatctctctctctctctctctctctctctctctccatcgatccctgcaggttcttgctgctgctgctgctgccttgcttgctgtcaagcatggcttgaccacctgagagcgaggagagcatagcgtagtacttggctagctgctgttcaattcctcatggatgattggaggatcgctagctaggtcgcccggatccacggacacctctcctcgtctcgtgctcgtgcatgccaagatcgatcgatcccagctgctgctgcgagtggagcagtggaggaggagatcggctgctacctgacctagatcgggaagcagattcatccggtacatgttatatatagatatagatcgttgcttaggttcttctcttcttgtttgatttcgtcggagcaagaaatgatgcttgcttcttgtgattcaggttgcattacggcggcgaggcgagggcgaggatggatcgtcaccattaccaccaccaccaccaccaccatcacatgatgtcgggcggcgggcaagacccggcggcgggggacggcggcgccggcggcgccacgcaggacagctttttcctcgggccggccgcggccgccatgttttccggcgccgggttgttgttgtcgggcgcggggaagtcggcgggaagcggcggcggcggccattgccgtccaagctcgtcgccgtcgctgagccggtcgagtcgcaaaaacggcgggcctggaacacgttcgggcagtacctgcggaaccaccggccgccgctgtccctgtcgcggtgcagcggcgcgcacgtgctggagttcctcaagtacatggaccagttcgggaagacgaaggtgcacacgccggtgtgccccttctacggccaccccaacccgccggcgccatgcccgtgcccgctccgccaagcctgggctccctcgacgcgctcatcggccgcctccgcgccgcctacgaggagaacggcggcacgccggagatgaaccccttcggcgcccgcgccgtccgcctctacctgcgcgaggtgcgcgagacgcaggccagggcgagggggatcagctacgagaagaagaagcgcaagaagccctcgtccgccggcgccggagccgggccctcgtccgaggggagcccgccgccacccggcggctcggccagcggcggcggcgacacgtcggcgtcgccgcagttcatcatcccgtgagttcttctcgatccccatcgccatctccgcatctccattgatcgatcgagcctcgcagcaagaaattccaatctccttggcagaaatgccatcttgctttgccagtacaaggcatcatatctcttctttcctcctgaattggtttcgatctctcccattttgcaaaaaaagatttctcctctttttaatttcatctctgtctcgctttctaagctaggacgaaggtcatgcatgagtgagtacttagtttaattcttgtttttttccttagctttgggacgtcaattaattggtagctgctgtcttcgatcgatctcgtcccgtttggtttaattattttgatgcaagaactggagtaaatttgatgagaatctcaagctagctagcctaattaggagttgtaatatttgttttagtctgggggatttgcaagaacaaaagtagcagaagctgtaggcatagcaagctagctagtgttagtatctgtagaatttgttcttgtaatagcttgtcgccaagctagccaagtgcagtggcgtcagcaatgcttccttctatctatcatgtactagtgatgatgtcttggtcttcctttcttggttgagcaaaagggcaaaaagggagagatcgactagctgatgagatgatgagtgatttcaattggtagcttaattaagacagaaacaacatgtgttatgtgtacttgtcctgggaacagattccatatatatgccaaatgctttaatttgggctatgatctgtgtgcaatgcaatgttcttgatatattcatgatcaagtgctccctttggtcatcatgtgtgtgctggtagctagactttatacaaaaatatgttgcttttgttctttgctttgaacaatgttttgttgtgtagtgccagtttttgaatggtttacagtactggatactaccttctttcacttttacaatatgtgcaaagtggtaacagatgaagaaacaaacaaacccaaccaaagaagaaagaaagataggagtcttttcaaaaaaggagagaaaagaaggcagccaggcccccaaaaatatataaagggttcaattgggtgtgcactagtacgattggggtgattccctatttttnggccaaggtttgaaggcttttaatccctttccttgttcaagtttgaattgctggatttgacttgatttaatttgtcttcacttgtttattattcctgatgatgagtatatatagtagaactgacctgcacatatatatatgtttctgtaacaactcaaatgatcaatgatcagaggttttttcaaaaaaagagaaagaagggagaatgcatgttcaggtagctagcagacagcagtaaaactacaattctctttgtggttaaagttagtttaccacctttgttagaacctgatcagatcattctttttgcatgaaaactattcacttctaaagtcttttgtgtccctatcaatgcaacagtgccacacacatgttctttcacttcatctctgctgtccccatgtatatatatgtatactatatgatatggcattgctaccagcttagcaggagggcattcaagttcctgttttcacacagttgatgcatctatcactatcttagattttgcttgtcctttcaatgcatatatatgtgtagttgagaaaactttttctttcatatatatatggaacagacaaattaaagtcgactgttctatgtattgcttctatttaatttattcgacaactttgcgtgcaactcaatctgcttctcttttttgggggattcaaaagaatttttagcacatggccggcttcaatctttatgtgagtgatatgtctgattgatatatatgtactgactgactctctgtagccacagcttgcttgattgtggttgcataccttgcatgcatgcgtgatgagtttttctacctaattgagctagtatatatactgtatattgattaggtatcacagtatcgtcagtgttttatttgacccctaggcctcctttggaatacgacaattactaaatttccttcgttgcattgcctatatatatgtgcgctccacttagtttgatcaatacatttttatgagtgcttatattcatgaaaacaagccacaatattggctctaattttatacatttggtttctgcaaaggtgtataaaaatatgttttagcttatatatgtgtgtgataaaatttatgctcttttaatgcaatatgattgttttttgtttctttgattccaaatatataggtaataacaaatactaaacattgtgttgtctaaatgcaaatatagttatccacataatgtctattgaaaaaaataatatcaatatcaatggtaaacagttactcaccataaaacaccatattaggtgtgtgtttttcatcattgtttattttcttaagcttaattttatgttttttcattatattctattttccagcatttgcccttaaaccgctcatagatatgaaaacttgtccatgaattttttttcttacttcatttattttttttcgtgatttatcagccatatagctcaaacaatcataacccatttaactatagcaacaataaatgttaaaaaaatatgttgattacatgcacctttaattttatcccaaaactgcattatacatcacaaaaaccattcatgtaggtttcctgaaaataaaagggggcactcatgcttttatctatccatggttttcttaattttcagcagctaacaacccatagaattatgtcaaatttcttaactaaacataagcatggacacttcctcccaacatagtgtcttaaaaaatgtcaatcaacaagacatctaatacatttattataaattagaaaattatttcgttcattttttttgctacaagtcaagtaatcaactaatttaatacaacacttgatagataaaggtggtatttaaatgtaaaggctagtttaatttcacactttcgacacgcatcacactcacaacacgtatggatgtttttttaccgtcattttgggaggtattgagagatagatgtttatcatagctagcgttaatcatgacgtacacaccaggattaattatcacaaaagaactatatatatgacataaaagacatgttatccatgcatagattagcatccacaaataaatttagcagatcatggcgatggaacattttcttaattgtagtttagattgttgttgctgaaactccttggattaatgcatgggaacctgatcaacgacaagtgttttgttgtccctcaattaaattccttactatgcctccatgaacttcttgatcaattaatcatctcggtataccttgttgtaactagtatagggtttaaagcgatctttagtcctcccttggatgcatgtatgcttaattttggcctttaattcccatatcttctgttgaagtgaatattggccatggcacatctcttgtccacattattatagaaaatgaaatataagaatagatctaatacaagcatatatatccatgtgcatgaattgtacatgaaaaatgaaggtacctgaaacctctactagtcattctagttattcatatcttatattttgcggggtatatatatatatacacacacacgatcgatgctgaccaaattaacacacaccttggagcaattaacagggatttattcttacattgcatatagcgatagagctatatatgcattatactactttggcttctacttcaaataagacggacaataatcaaacgttggatacagatacacacagctgcgtttaaaatgggaggcagggagtagaagtatttaagcatggggatctgttcattgaaagaagtagatagaaactggaacgggtgggcgccaaaatttggcgaaacaaattcccccctaataaatgaaaaatccctggctcgcgttctattggttcatgttgcctgctctactgatactactttgcatgtacccatgattgacgaagagtacgtctagctagtgcagggccgaagaggctactgaaattaaggtggcccaatcgcacagaagaacaaactcgcacgtacgctgatgtgtcgtaatctgagaggagaaatgtatatctagcagcagcagcagcaactcagtttgcaggctcctttgcagcttctgatgcatgcagctgagactgataggtgagaggcatcaactagggacgagtttagtttcaaattttttcttcaaactttcaacttttccatcacatcaaaacttgtctatacacacaaatttccaacttttccgtcacatcgttccaatttcaacaaaacttttaattttgacgtgtgaacgaaacacaccctagctctgaatcgctctgatcagcaatgcgaaggaggaagaagaagaagaagaaagagagtgtagaaaaaatactactacactgctagctagctgctgctcgatcgatcgtagaaaactccatgagagtaatcgtccatggatcagaaaaatttagccgcgggatagatctgtggcgtttgtgtccaggacaaagggccactgttggcgatgtcattcaattcatttccaccgtactgtacctaccccgctctcccttcatttactccgatcctaacgtacagtatactgcagtcgtgtatgtgtactccactacgggaacacggcttaattttacccacacgcagtgtaccaaagtgcaccgtacgtatttcatcaatcttactactatattggttcagtgctttagtttagggcaatcacaattaatttttgttcttcattcgtcatcactgctttgtacgtaccaggtacgtacttctggtatctaggagtttcggtttagaaaatgtcaagatatgtactatgtttaacacatgcatggtagactatatagtacatacgtcctcgttccaaaatatagaaaaaataggatttaaatcttatgctataatacaaggatttttagcactattcacagtattacttttcccatcaatcatttaccattaaaatttctttccatcttaccccctaactaacctcccaccgctattcgttacaaatttattgagatacatcgaagcctttcttttcttaaccttaatatctactaaataatctagaaatgcttcttgggggagtatcttcacccttctcagcgtaggtgccctagcctaccaaccagaggggactctgaaggaggcccggttgaggccttggtaaggcctccaggaaggacctagtctagaatggcaccatcctcgaggtggctccggcaaaatgcgacttcacgaagcatctatgacgagaagacgggccatttagggtgcattcaatgaacccaaccatcaatgacgtatccgcggcgagagcaagcaggaatgccgaggcgcctcgatagcgtgcctcggcctcgagctgtctatcccgagattcgtcggaaccccgtgatggggggtttaatggaggcagcccctttctggtcgcctagagttttaccttcttgctctcgaggccaagcctgccagccagcctccacgtagtgggcggaggccaaagggccccttcgtaacttcccatataatctctagggatatataattgtaattcgctcctcgaaagagggcaatggagacaacgatagagaaatcgcgttgtttccttggtagactctcaatccctgttggattttattccaacaatgcttacagtttggatcggatagagcaaaacatttctgacttagttaaaatgctcatggttgaccttagaaggtcttttcggttgtgttgctgtagcttgccttctacgacaagtgccaagtagctagacacagggtagaccagaatgagacagaagacccgtgtgacagcaacaaaagaattattattgtggccctgtttttccagctaccagattattgtcatggattatttgctccgttccttccataatatatttttttagagaaaaatctttattctaatgcattacctagatatcttgttatggactattaatttcaaaatatttaatttatgtcaaaaaagtgtaactataattcactgcaataataacatggttaataattcgttttaaactactaggccttatagcgtttcaccaaatcgttttcgtttcttccaaagatctgcgtggtacaaccgtacaaagcaaccctagtagtcaatttggtcaggaggagcagcagcagcagaagctggaccagtgggctgcaccggtgacttggtgagcagtgctgctgctgattcaggccagggaacagatctgcctgcgtggggcctacatctacagtaatcatatgccattttgggccgggatcaatccgtcaggcaggccggccgttcgattggttcgtttagcgaagagttgaatccagacggcccataatctgttgcatgggcctagcaaaattgaagttagagctaagcccaggcccacagtcagatgaatagccaagcccattagtgagattccctgtgatcctgccatactgggccatacttttcggcttttcctttggcccaacttaagagcaaggccccgggtcaatcagtcactccagctggttaggtgattttactggaaaaaacgtaattaaccactgtagtaagaaaagtattcctaccagctggtcaaaaaaggtaaaaagtaggctgacatgcaagcaaagcatatgcatattgcatggagtacatgggcatgcaaggttgggcggtggtcaagccaacaaaagctggccgcttttgctaacactgacttggacccatccatatgccaggctgcttgctgcctgcctagcttcaacccttcaagcatgctgcaccacacagcagatcgatcgccgatatatgccgcattgtcgcgatggatggctaaaaaaaaagggttggaaggagagatgcccggccctccgaacattttcaaagaagaaattacgaacgggttaagaattaaacacgaaacctcaagattaaaatcatacaccccatgtccccatatcactgtattatcaagcgtaacatcgataatataacctagagctgatcaaaccggtaatacgaagtactataactacaacagtccatgaattggacaacgcttgccaccagcaagagattagaaaaaagagtccattctctcatctctatcctatttacggtatgaaaaatttagaagaaaagaaatcatatatagtgttagaaaacttgcaacgaatttttagcagcgaaagttaaggaggatgctaattaaaacctgagccctagcaaaagcaaaattactctcaaaacttatcctttagctttgtttatcttatttttctctggtatatttaacaatattttggtgcactttagatactgggttgttaaaaacaaaagaaagcaaaaatgtaacactatatttgccatgccatccccccatgcatgtatggaaaaaactctacgatcgagtgcagcgtacgtttgatcgcggctgtgtaagcttaaaagcgaactaaacgttttgtttgtttttcctctgaaaatgggtaagccgaagagcagtgaagcaaactataattaacaccaaatgataacacactagatttgttgccgatcgatcgagattcgagcgtcagatcctttgcttggtttggcaaccaaaatcatatctttggcttagatttattctttctgcttctgtccaaacgcctagcaacgactacgctgcttaattaaattacgtgcagcgagacgcaacaaattgggacatgtgtcacttttatactcagtactgtaggtacacatgaacagtaccttctagttaaacaaatcttgatcccgacaggaacagtgagcaaagtactacatttatattagggtgacatgctaattaacaacagggctttgcaaggtcccaatcctcttgttctggcttagcattactgtatatattttgctattaattattattttttcgccgggctggtattaattattctctctgattttagataatatagatgataccgttgactttaaataagtttgattattggtattattcaaatacgcaaaacgtttgaccattcatctcgttaaaaagttttgtataaatatgtaaaaatataaatcgtagttaagaacctttagtgataaattaaacaagtactcacagaaaaataaatattaatcaagtaaaaagattaaaaagaagaatcctcaaatgtatatcaaaattgattgcgtcattcattaaaaaccgatagtacgtccaaactcgatctttctatcagtacaaaattttctatcagtataaattaaaatgctccaaaggatctcagcaaaagttagatagcttttgtatggccgccatctgtataggagcaatagcttaattaattaattactacctagttaaacctaccttttatatagatcatatcacgttacgtagtcagtgtgctagttcggtactactatccaattaaggcactg

SEQ ID NO: 12433 - DNA, 14607 bp, Oryza sativa
attagagcttgcaattgtcaattaagctagaagcaagcaagttggggataaataattaatcatcaagtaaacgcggtatattagtcggtccattagctgcatgttttaattactttacaatatcgtctctgatggaattagttaggtaaatattaacaatatatgcacatgccatttgaatatatatacatgtatgcatcacgtactcgatatagctcatgtacgtattgtacgtaataacactgtgtacgcattttcaagctagatagcaaattctcttttagtttccttcgtggattaattttctcttctactttaggtcaacatatttgccacacttttggaattgatcgtcaaggacctttttatccactttggataacaggattctaatacagttcatacttatgcttttgtacttaacgtaatatttatatatatacataatttatatgctcctactttgtacattttttttatctcatggccggggacgggttttatttcttactgagattattttttttaactcaaactagctttatggttgtgtgtatcctacattcaaagatagaggatataactatatcttccttatcttaaaatggtcaaggggatcccatgttatatatctatcagttagaggccacgtaaccgaccaaactttgctgctgttaatttagtaaccggatgacgtaaccaatcgacacagccaatgatcagcaagacagcaactaatctgcaattagtattagattagctatgctctgcgtgtcttgcgtatactgtttgtgtaatatatcatttagaaatgatatgtggtcatgtccatagataatttgttctttcttaagtgcatgcgaccagatttcgatcaacagtacaggtctgcatgcatgaactcgtcacatgcacacagcaaattggttgctgcagagacgacaaattaaattgaaccgaacaaatcgatattgcaatccacccgttttgctaattaaacacacatatatattgcaatccatccgatatatccatatctcaaaaccaatcagtttacaatcatgcacagagtcaacatcaggaccagtacttctgattgtgaataaacataaagctgcacactcttcatgatgcatatatgcctcaagaagattccataaagatcagtggtctaattattccttgatgaaaaacaaatgttttttttctgatgcatacatgtatgcttgcattagtatagtgtgtggtcctacccaatctatacatgatatatatgtaagaaattaagcagcaaacgatcaatgtgtaggggaacacacatgcatgatcgttcagaaaaaaaaagttagtagtggtcctgcctgctctagatgctatgctatttattatgaccatagaaattaagctagcagaagcactgtttgacatgcaattaatcaatttgcatgtacttaattttcagtgcacaatgcacaattaggcagcatctgatggatgatgagatccctgtgcccttagcttagctaactgccaaaacaagcattcagaaagcgtggtgatggatggacgttgcgagataggggccccggcgccgatggaggacaagacatcagatcatatcacagaaattaacgagaaagagaacaaacgaacctagacgacaatggccggcttgggtcgttgtgtgtgcttcgttcagtactactgttgtgtgacatacaagaggcagcctgcacccacatgcatgcagcagcaagactgatatgattctcctgacttagcagcttgcatactgttgctccttcgatgattgttgtttattttctttatcagcttaagcttttaagttgaattagttagtgtacgtaactcaatatgttagcgagaccgaaaatctgaagttcaaatcatgtcagatgcacaattaaatcaataattgtagctcatttctatttcagtctcgtctcgaggtttgagggaacctcgcgtagaggtgagtgttggcatataagccggttgaagtaatgaataggttgtgtttgttcacatgatattgagaggagaagatttacctcatacattttcttttccgaactaataaatgatgtgttgttcttaaaaactttcaatagaaatgttgctttaaaaatcatattaatccatttttaaaattaaaataattaactatttaattaattatacgctaatatggttcatcttattttgtgtatcttctcaatcttccacttttccctcctctcaactccttcctaacagtgtttaattaccttgctggggttgtcagtcaattgtgggttagatcctatattaatggccactgcatatttacagcagtatgttgggcaaattgttgatgattctacaattacgtgtataaaactagctggctctcttatgtaggatggttaagttcctctgttaatttgtgtggatcagttagttaagtttgaaaattccacacagatacagcaatgaactaaaactagctctcttatgtactaggatatataattaactaaaaccaggtagctaatattaactacctgcagctgttaatttgtatggatcagttagtgaagtttgaagcttccacactgatacagactgaaagatacagcaaaggactagaaaaagggttccaaattaagtactccattaatatatccacccatcaacagaaactgatcattcatacattatatgtacacatgcatgacgacgtctgctactactgcaatctcaatcaaattaaaggctaagatatataatttacctccaaacaatgcaacagcgctatacgacgtaccactataccctatacacaggtgcgcatgtttgcatgcacaatcaacgaaatctgcacaagctgatcgatggaatcgatcaccacgaaacaaatcagatcaaacaatcgaggtgaaaagaggttattaataataaacgctagctagctgcgctgcagaactgcagctagctagcagctgggagtgtgtgtaagctagctaagctagcactagcagcaccgacacctatggtggatcgtcacatcggcatcaggccgttgtaattgtagtgctcctcgagccctagctccatcagaccgcactgctcgccgccgtcgaccctcgatcccgccgccgacgccgacgccgccacggcgccgccgtcgagatgctggctgaagtcgaagatgctgctgtacagcgccatgctggtggtggggatgaactcgttgagggagccgccgccgccgccggtgacgggcatgtggtggtggtggtggtgatcgggaggcggcggtgggtggctgctgtagtggtggctgctgctgcaggcggcgagcgacgccgggaatggcgggggcgagtgatggccggcggcggctgggtcgtgagacgaggaggagttggagtagcatccacccgccttgatggccgcggcgctccgtgccatggcgatcaccgcctcctgctcgttctccatgctgtacgacgactccgtctccgtctccgccttcttcttgtagaacactctgcacaacacccaatcctcctgcatacacatatgcaaaattaaacacacaaactcaagctcttgattaaccaaaagttactactatactccttcaggttataacacgttttaactctaataaagtcaaactatttcaagtttaactaattttatagataaatatagtaatatttatgatactaaattagtttatcaaatcaataattgaattaattttcttaataaatttgtcatgggttaaaaatattattattttttctacaaacttggttaaacttaaaacagtttgactaaacaggtcttaccataacccgtgctggattttatttatttgaggatgaaaggagtaaggaaattattggagaaattagttggattgtgaggactaaccttgggaggggtgtgagggttttccatgcgaaattcgtgcatgacccagttggttttgacgccgttgggggcgcggccgcggtagaagacaagggtcttgcgcatgccgacgatggaggcgcggcggtgggcggcggcgtgcagcttggggttgtggatgacgcggtccttgccggtggccttccagtagccggacttggtggcgcggttcgtgcggagccccgtcgcgtacttgcggtcgcggaagctgaagaagtaccactcgttcgtgctcagcttcgccacatctgcatgcacaccataattaatttttcacatcacaactcgattaatctagactaatctgagatcaaccgtaatatattcagtatgtggtataatactagctacttgattaattgttcgatatgattctgattaaacttgttcctgcagttttgtaaagaaataccgttaattattcagaaattttggaaagcagatcgatttgattgagggaaattaaacaaaccggttaatttaatctttttcaatattatgtatatttttattgttctcagtttttttttttttgagaataggatgggccggcgcgcggggaaattaaggagagtttatgcacacatatagtagtatgtcctgaagaaaatgttgatatggaatgaaataagttaaattttaaacatgtataaaaattgatgggaaatttgatcgtaatcgtaagagacaaagagaacaagctatagctagagcttagatagcccacttgcagtcataaagaaataaattatagatataggtatatgtatgcttgcaccagaagcaatatataacacactgttgcacatacgcgcacagagatatacgtgatggatcgacccgtgccttgttggttaattaacaagggggaagaataacgacaatcctaattggagccaataaagcgtggttgcgtgcgtaattaatcattccatggaaacggaggaaccatctacgatttaattaaccataatcatgcagaagaggggagagagagggcgcgtggctaagagcaggtacaatagcaagctataagccagctataaacatattttaaaaagataaaggaagagagagaagagcaggagactataggtatatagtcagctgtagcacggactctaagacgtaatatgtgtatgacaggtaggaccaggtattaatagtacagtaagcaactattgtatgaattgactattacattagctataaatgatttggagctagtgagagggtcgcttgtgggagaggaaaaaggagtagtaattaattaattaattttgattgagtaagtgattacctggtagctcccacggctcgtgggtgtggaggtccacctcgaccatggtgccgccgccggcggcggcggctcctccaactccggcgaagcgatgctggttcaccaccttgttatgaaggtagtggcagacaagctcctcgtcgctcgggtagaaccggaaccccggaggcagcgtcagctcgatgtccctcaaccccatgtggctatcacctgctaaatttctttgatgatctctctgtctatagcaatctagctatatctatatgtgattgatctctgtggagtattttggaagtggtagctagctatatgtacatagctaagaattaagctgcagattgatgcagagaagaagaagaggaggagagaaattgataggtaggaacttggaagtagctagcacatatatctgtataggttggcgattgtgtgagctcgggaagaaggcaggaggcaaatatatatagcttggcgagggaataattatatgcgcagctagcagctgagagagagaagtgtagggaagcaagcaacaaagcagcagcaggagcaaagggtactactatactatggctagcaatagcaatagctatagctccgatctctatctctgtgtgtagtacgtcggtatgtaagtatcatgtatatggcagtgagcaatcgatcaatcggtcgagagctctatctcagtaatactgttgcgcctgctgcttgctagctgctgcaagcaggagatggcgctgtcacgtacgcagcgcgcgggaggaggcggaggacgcgggagaggacgcgtgcgcggacgacgtcgcattcactgacgacctctctctctctctctctggagaaaaaaagaagaggagggcaggtggggttggggaggaaaaaggaatcaaggaagaagaaggacaaagagagagagagagagaggagatccagggtcgcaaaaaaaatcatcgccacggccggcccacttgatgatggacaatcgatatgtacatatcccccaagtgcaccgacaccggcaacatacatggcactatcaataaaaacccatttggggaaaaaacgcaacctcgatcgatctctacctgcccattatcattgtgttgggtgcatatcaattcaaccgcgtgcaaaatcggggagccatcgtttcggttttcgtggtccaagtaaaacggcttatttgtaaatgaaaaatattttttaaataaaatttttataatattcttagcgatcaaaaatcaaaggctaaaaaataaactttgataaaaaaaacctcaaaaccagatccaaatttaagattaaaaatttaaattttgactgacaagtataagcgaaaagatgaggacatacgtatatgacacagcttaactaggcttaataattgatccgtcctacgtacagcatctcctcctcgatcccggcctttagtatgcatctctacatgtctctctgtcggtctatgctctaagcttgttaaatttgcttacaagtaagtgcatctatgtgtgtgtactgtgtttgtacagtgcaggtacatacatgggtacacagtgtactgtataggacggtgattaattatgcaaaatgcaagccaacaaaaatatcgagacggaggataaaacaaggatcagcgcccctgaatatatcaatccgcctacacttgctagcttgcgtatactgtacattcagagaagttatcgagcatgttgatcaaagaaatatcatggataacaagtctaggtattaaacctgtgtgtgcgtgtcgtcttccgtgtaattgaaaagagaaattaacggcacgattaataaggtagtctacatccacatacaacttgcgaaccgcctatgtaggtgtatggctaaataaaatggttcaaactaacataagagaccacatcagttacaacttgataattattaatttcagaattcggagttgttataatagtaaaatcgagagatcaagacgaatacaatcacatattaagtaatgaaaaccatttcgctggactaccccctcaaattatttctttctttctaaaaccccttcaaactatttcagcggagcacttagcccctcaaaaaaaatctcattcgcaccgccaaaccatcaaaaatgtttcactttacttcctaacatatttctcttttctttctccctatataagtcgtattttgtaaataaaaaaatgttaggatgatgaccgatgtattgcaacttacgtctcaatatattttttatttttatcactgttttcatagggctgaagcacctaaggctgatttaagcatcaagattctaaaaccaagcaaacaatcatgaagaaaattaaaaatacttttgaactttcatagtggtgttatctatggcactataaaattgcaacttaaaatataacttatataaaaataaaaaaaagagaaatgttattagggagtaaagtgaaccagtttagtagtttaggccaaatatgagaaaaaatattttttcagggagggattaaacgatccataaaatagttcgagcttgtaaaatagaattatttgtttgtttgttttaaattttaaagatattaaaccattaaaataggaataataaattttggactacgactacaaactaaatacaactttgtatttattaattcgaatttcaagattatttggaaaaaaagaagcaaatttaacatgtatatgcaaacaaatgtcccgtgcattctcaacttgtggagattattactagctaacagtacgtgcattttaagcaaggtatacgtatcttagcttgattaccgataattagcagggagagaggctgtcaggaactagctgcaggtaatcaccgtacgctgcttcaccgcttgatcgatcgatcatgcattttgatgcgaattaatcatgagagaatcggaaattatttcttctactccaagaccagaaagcgacgagagagatgattatattaaccaaacggtagaggtagtacaggcatgtcgaaagaaaaggaacgacggagataatgtcagaaataatgtctgttcagcctgcatcgatctctgtacttctctgtagtctgtacactgtactgccgattaaattgaatcagatgataatgatatcacgacggcaaaacgttctctaattgaagtagtagcagtgcataatgtacaggtgtattgttgatgatcaattcaagttcttcatcatcatcaatcgagaaatgcgaggtacaatcattgtgtacatgtataataatactttatacgtatatttgccgtgtttgtcgtgtgctctctggcgtataaaaactgacgaactcctgcagtagtactgtacgtgtgtgtgtcattagggcacatgcgtatatacgcagctagagctatatatacgttacatattaattaattatagctaagtacctattccaaaacagtgggatgcgacttatgcgacggaataaaaggaggatatgtacagtacgtgtacaagtacagtacgtgtaattttttttgagatgaaaaaaagtacagtacgggtattcgtgatcagtatatatcaaaagtacatgtaccatatgctagctgcgtcgtacatgcatatggttgttgcggcttaattatccaaaaattaattaagttattacatccctcccctgatcatcaattaataatctactcttctcattaataatctctatatagctaagtaccttgtgcagaaaaaatatccatctcgatctaggctatacacagcaagaataattaataaaagcggcatgtatgtttaattaattactatatacttgagtatgagtatgagcctatgcaaaagtatatatgttgggaattaaagtagacgatggtcggcgatagatttgatcgatgcaggactacaggtaggtaggcacaagcaaatacatgggcgatggtaaaaaaaaaagagagagagatatggatattgtttctgtgtgatatagcagtattctttgtgcgagttgcagttaactaaaatgattggcttagagataaatactccaggtcaggacaggattgatgagagcatgcatgcaatgcaatttcatggcagttggaggcaggatagataaactaacttggggagatgattgagtgacgtcatgcaattaacaccaaggaacagggcataggacggaattaaaaaagaggcgatcattggctttaaaaaacgtgggaattaatcgtggggaatttttcgcgaacgctgaataatcatggggaataattagcattaactgcttgattgatcaccctgatgtgtatgtatgtatgtatacgtatagtactccctccgtcctaaatgtttgattccatttactttttaaacatatttgattgttcatcttatttaaaaaatttaagtaattattaattctttttcctatcatttgatttattgttaaatatatttttatgtatacatatagttttgcatattttataaaagtttttgaataaaatgaacagtcaaatatattttaaaaaattaacggtgttaaatatttagaaaatgatggagtatatattaactgaggacgagatggatgctgcgcttaagccggcgactcgatctggaaggtgtccaatccccatcacccaatgccagcgatacctctgcagctgggacctagaacaagctaacctagccagagtatttagctgctacaagctgctcctcccgtttcatattataaatcatttaaatcttttactaatcaattttttaaaaaaattaattaaatttataaaaaatataatagcattttcaaccccaaataaatatattatcgaaatatattaatgttaggtatagtgaaactaatttaatattttagatattgctaaattttataaacttagtcaaatttaataaaatttgactataaaaatattaaacaacttataatataaaacaaaacggagggattactaattaacgggagctaggatattacatagtagatttagctcagaaaagattagccaggagggaacaccgattcagacatctcctgcttagctgctggtactggctagctaactggactttttctattttcttcagagcctgaaatcgttggcatcttactccaaaagggcagtggaaaagagaaaagaacaagaccggtaaagtactacataaagtacttgctactacatatctgacttgttatgaatgatgcaaacaggagattaaaatcccaatttgttaagctatggctgatgatgagtcgtagcgaaatgaaagaagcaaccaaaaataatttataaataaatctcttatatctatactattcatggcttaaaaataaggctgaaaaaaagatgctactacggtgaaaaaaaatcataacataacttttaaaattaaattttgtttgtggctgataagccagcaaacagacgatgcatgagatctgtttgcagtgcagtgtgcacgacggacatatgtctgagaaaattaaaactgattagcagcagttagatattgtcgcacaagtgcagcagagtcgaaaatccagcaagaaaggtatggttcaggcagggagagaatcagagaatcgatctggtccagaaacagtctcagtgaccatgctgcatggatgtagctacatgtctgaggaacaagtcagtcatggggtgccatcgagtgcacgcggaaaagcaaacgcggcatccagtggagatggagagcattagagcactgtgcagtgcttatgtggagtgctagcttgtgtaatccaaactttccaaagtgtcaatcaggtctacagaaatgttaattatgctttgttcgttgtcaatgcacagtacattaccatcccattatcggataaaaacacacagtatattatccatttcttgatagtactaattgattgatcctgctgcagcttgctatcaaggattcagtgaaaagctcctgtccaaatgtttggtggtagagttgttcttgtacaggtaaaaggtgctggaaaaaaggaacagtcaagattgtgatttattttctcaccaacaattcatgagtttccacttaagtaggccctatatataatgccaagatatgcatatataaatgaattgtttatgctacttctggaggcatcttaaatttgtgagttgatcccctgtccttctctgaacagaaacagagaaaagacagacgacgttgtgatcgtttctgctcttaatcggaagccaatggaggagatagggatccctaattaagaatactactgccacaacacaactaaaaagcataaccacatttgcttagttattaattactactaataagcttcttaaatggaactggcccttatccctttctctagaaaagaatataacggacacaatcatcatgagctgatggcattctgtacatatttttataattattcagagatttcttttttgtccctgctggagtttttctagggttgtttataggaagagtgacggctccatactccatttcttccaccaattccttcctactaatcagactcaacactaacagtgccctttttcaaatcctaagaaagcgacagaaaccaaaagagcacccccaaaattctcgcttttaaactagttttctctcgagtagtagtatatctcaaagtctacatgaacattccattgaagcattgactcacggaattaaaacatgtaattgcaactagtattatattgtcatgagggcagggttaaggctaaagcaaagtacgtacgcatgcaaccgaagctgcatatgtaatctgccatcaatttgcacattaagaacaaaataaaaacactaccctccatatctctcaactctagctgcttggatgatgttgaatacagtatatatgtttgtacgtagggagtatatatggaagtaagtaactgtaggaacctaattaatactgtaacattatacagacagcgacagactgacagtgtcggattaatcaagttggctagctattgcagtgcagcatctaccagcctgatgcttggtttttggctgcgtactgaaaatttatgcgagatcaagagctcaatcaagctttcctccccaagaaagaaaaagcttcgcttatccttcctctgtctcttttccttgctaccattaggatccaaattacacgaaatcatcaaatgtcccatcgatggtatatgcatgatgtgcaaaacggccatgcatatattttttttttctatgtgcagtgcttgcattgggctcctctgatctccaagaggaattatgcaacacaaaaaacatatatgtactgtggtgatattgagtgggctgtgtgtctccatttcaggaatggcctgtgcactatgcatggacagcattagttatgcttaatcgttgagtcattttcaacgtcgcatatacaccctcctaagctagcccagctctctgaaggccagccaactgctgcatgaaccatgcatccactgcatgttgaggtaggttaatttcattttgttcaggaattaatgaaagcaaatatatatctgtataacaagtagtcagtctgatctttcaggaggtagtagtagtaactaaggctgtgtttagttccagcggtgaaaagttttggcgtgtcacattggatatacggacacacatttaaagtattaaatatagactaataacaaaacaaattatagattccgcctgtaaactgcgagacgaatttattaaacctaattaattcatcattagcaaaatgtttactgtagcaccacattgtcagatcataaagtaattaggcttaaaatatttgtctcgtaaattagtcgtaatctgtgcaattatttattttttaacttatatttaatacttcatgcatatattgaaacattcgatgtgacatagcgaaaatttttatcaggagatgtaaacagaccctaagttaacctgagaggtttaaacttgtgccatctgccatggatgcagaagtagcaagaggagacgaggacgcggccgggcggggagcagaggcggtggtgaaggagaggtcggaggaggcgtgcggcgaggccgtgtggcaggcagccgcaatgattgatacgactcgtcgtcagcaaatattccctcctagacagcgacctcgtactatactacactttgcagcaaggcacgcgtcctaatgttaacccgtatgcatgcatacagattagcacgcttaattagagcaaggataatgtgagctactccctccgtctaaaaaaactcaatctcaaataatgtgacccctcctaaaacaacaaatctagataaaagatagttatactaggagcggtcaaatcctctcctagattgagttttttttttggaacggagggagtataaacctactgtaagctacttcctccgtttcatattataagactttctagcattatcaacattcatatatatgttaatgaatctagacatatatgtatgtctagattcattaatatctatatgaatgtgggtaatgctagaaagtcttataacctgaaacggaggtagtagcttacgtggaggagaggtgtaaaaaaattaaggatgttagctctcatacaagagctagcttaatataagcttgaagacaaatatatcaaatgtataagtaagagatagaaagaggagaaaaaaaattatagcaaaccttatagctaatctctattatatatgttagctttaagataaactaatgaactctactattattcttgctcttaatattttctctattataaaataagtgcaccataaataagtgcatccgtatattttaaatttgaactacatttaagtcagagagagtattattactagccaattaccattgtgactacgtttaccgtggtatttattggtagcattttattatccgtatatatattattaggataaataacctttaattgttaatgtatgagttagtatatgatagaaaattaaagttacttctctatggtactgtggcagtataaatagaggagtgaatttaaactctcgacgggggcattccctctttatttatatgtcatttaaatagttataagataatttgaaaagatgaattaatatgtgatagatcacttcacaaacatgcaagttaaaaatgtaagttgagaaaaaaaatatagatagctaacatatattcacagtcaaattcatttttttattacatgtttgtgaagtgatatattacatattaatctatctagttgatttgttttctaaataaattataagcatttagattacatgcaaataacaagcgaaatatt

SEQ ID NO: 12434 - DNA, 17558 bp, Oryza sativa
  unsure (1)..(17558): unsure at all n locations
gggggttggggggtggtgtagcttgacggggtgggaaaacggttgtctgcaagtaagctccggtggatcatccgatcgttggatggcaccgcacatatggcatgcctagcttccaggcctggacactgacccctccacctgtccgcctcccattggtcgcctgcctcttccttgattcatttctcttcctattctctcatcgatcgatcgatcgatctcttcctcgtgaaaatcaaggctccttgacatcgcctcgcgacaaacctcgcctccctatcacggccgatctatcagcacactaatccatcatgtagatttttattagtatcaattctgtttcagctaactcgtcagtctgtctgccaagccgcgcgtcgagcatgcacgcccccctgctttgcccatgatatattaatttaattaactaattaattggtattctatccgtcttgaaatataaaaatctagtattacacgagacatatcatagaaattctatcaagatttgcagaattagaatgtactccatatctcatttcttactccatattttcggataaaggtagtactatcagttaattaaaccttggatgcacgaggaataagttgatttgatcgatcttggtgaccctttttgccctgtattgaatgctaatttgctttcaagaaacccccaaaactgacgcggccgatcgatccatcgatcgatctcgccgccgaaaaggagggaaaggagaatgacaccaactgcaagagaagagattaaatgtggagaggttgacagcatctgatcccctccactaattagccagaccgcgagctgatcgatcgagcgagctcagtcacagcgatcgctccagcgacaaacgtgtgggggatttgatgcttccatctccgtcgatcgccctaaagctcaagatcgatccaaatccagctcctaattaagattaattagctatggatgttaagggagaaagagacgtccatggcgatcatccatcaccgacgcaatctcgatttcctatctatctatctaggtccagatccatctgcatgcccatgcggcactaacagtacaaaacagtatcattactgttaaactaatctttgcgataatccaaaacgaccactcttgggaaagagtcaagagctaagatagcagctagcctgcaagatcacacactggatcatgctccatccacagataccaacaaacggttcacgggtcgatccaaactgaacctgccattcgattcagagttcagaaaatggccaaaaggccttgctgtgtttctgatcacagattctaatatagatacagccaggtgcaagtgcaatgccgatggggatggaatcatcctcgccgatctgtccggcgaactgccggctcggcgttgcaaacggacatgctcgtcactgtggactgaatactgaactaatctctgaataatatgcggcggcagctgagcactcgatttcagaagggagggaaggggctgagacccaggtagatatatgcaggaaaaacggtaggtgaactaccctacaataatgccgacagcaactcgatctcgattcgattgatagatcgatcgatcacacagatggtagcacatcgatcaacagcgaatcaaggagaaaatgatgctctctctctctgtggtccagggacatctacttcagctctctattggccgataagaatcaaaaacgctatctttcagtttggtcggttcagtacctcccagtagaagcaactgctggttcagagctcgtggtgaaagtgaaatcgatgacatttggatgccagttttattttatttttttgaaagttcagtaattagcaagaaacacatatttgcatatccaattaagctacaaattcagcattgaattgctgcatctatgtcatatgtatacagagcccacaggttcagtagaaacgagttaccgatcacagaggaaaggaacaaggcaccagctgaccagcatctacacacaaatacacaatctcttccgagtgtaacagtggcgatgagtggaatgcaacaggtgtcaggcactcaggctatcagagtgcagcaagacgtaaagggtggatgcaagtggcccacttcaattttcatatatgtgctgaatgatttctaatccaaagtgttgcaggagatgtactgctagatggatactgtgaacagagaatatatttgaaagaacaggatagaccactgtttctgaaagttccttttcttcttgggaataatctgtttctgaaaattctgaaacttgctactgtatctgaggtggatgccacttaagcagccccactataattggtgtaaatgtcatgttaatgtagcagatgtatatgtatgtttgcacgaaaatgaccaagcatggacaaaagattataatatgtggaataatgtggaatgaagatatttacagttcagaggcttgccccaggatggtgtattgtcattgttggcaatgaagaagacaaatgacaaatcttctttgtttcatagatggtaatattctctcattttactgaaaattaagtttctccgtccttgatcaccaaggtgcagacaaactgaacatagaatgcaaccagatacctatctagcatcttctatatttgttttcgtcatgtctccatctacaggacccgaaatgatgaactggcatttttaaattgagaggagttacaatatggagtagtcaattagtgatcactatgatcggtatttctgaaataatacaaataagtataaaataaaactaatacacggtgcaacacaaaaagaagatactgtaaaaaagagagagaatttacaaatgcacacagaggcagcttggtagagtactagagtacactgaaatataaacttactgagggcaaatgtggggaaaggtaagcccaagaggcatgtggaccaggcgtggaaaaaaggcccatatggcccgtgatggaagcaagaagcccatatggtcggcttgcggatgaactgatcggcccgaggcccaacttgacccattataacattagtatacagtacaacgtgacaggccgtcacttgttttctcggcccaactctacattacatatacaaactctaacgccacaaaaataagtacaaaataaaggaataaatgatgtagaaaaatcagaaaagaaaagagaaaggcccatataaattcttcctagttgatggcttctcctgcaagcagcccggagtctagacgaaaacctcaaatacaaattcgaaatcctccccccatatgtttcgtgcttgccacgccaaaaaaaaaaaaaaaatcagcaacgagagagcgatcgcgcgttgcagcgtcgcctcagaagcacttgtcgccgtcgtcatcccccgccgcggccggcctcgccgccgcggaggggccgccgccgccgcctaccgacgacgacttggaccgccccgacgaggtgccccccgacgccctcgccttcctccgccgctgcttcggcgccgcccccgcggcggcttctccctcgcagttgttctcccccacctccgtcttcggcggccgccgcgacccctcgctgcctccgtcgcgccgctctttgccccgccccgcccgccgcggccgctccgcctggtccgctctgccgccgcctcctccttggttctcctccgcctcgccgccttccgtgccccccgccgttggcttgaactcgttcatctgcgaccagtgatcggagcagttagagacatgggagatggcgcgatcgggggggaggagcaaggcggcggcgatcacccagctgggcgcggtgacggaggcgttgtcccagccgatgtgcgcgacgtgcttcacgtccgtcgggttcccgatctgcatctccggctccttcacgctcggatctgcaagcaaccaaccccacaacaccagcgtgcgcgggcatgcgcgtgttcgtcagacaaggtacacaatctctcacaacgccatcccgtaatgcattttgattttcgttgtgtggatgaatgatgatgaattatcaatgtgtggcatgaacaatgttgaggtgaattggattggggaattggggaatagggattcgttagacttggaaattgatggtgttcgaggcgtaccgaaaatttgtgagatgtatcggaggcccttgagaaggcccttcatcttaaccggttccacaggcggctgcccgcccgcggtgctctgcgaggaatccaccacttatatgtttgtcctccaccccttgtcccttgatctagccttcacaagtaagcaataacattacaaatttttcgccgggccaatatcatttaaaaaacaaaagtaagaactaacaattctatgaaatgggatacaacctattgaccataagcttgattttacaaatatgaaataccaccgtgaacagagataaaaaaaacgagaaaagccatctgaatgtttcgtcaaaatacaatgttgataatgctataggtgttggggtgagatttacatctaccgaccacgtagcattgaaaacaaaacaactattgtggtctatcgtaatatgatttgctggaagatgaagattcagcaatgtatatatttgttcttttcaacattctgaagttcagtttctatttgacacacacaaatttgtggcgcctaattgaatcagactcacataccttgcaaagcagatttaagagggtgatgaagcatgatctaccgaatttcatcttctttatgacatcttcattgtgtctgcagcaattctcttcacctattgctgtttgatctatcacaatttagtggaattgcaatcccttccaaagctcaaacaggaacaagcatagattctctcttccaagttggagaaatggaagggcagaaagtttgttgcctcgatctatttatggttccctatttttggtctaggctccttttggttgaagttcattttgacatacagcagtttgtgaggccctggttttgcttaactggtctgcagcgcaaatggcggggatggacaactcagaacatgaaaaaggggtcatttagctaacaagccaatctgcctcttattttgacaatttccgatcatatcccatatcctttcgtaggtagttaacgaagcttgcattggagcttgagttcagcagcgcaaaatgatctaatacttgattcaatcagtatggagtgtccggtggaaaacaacggataaagtatcggtgcaaatgttttgatatatagtatgattatcgtaggtttcttagctttttcgatcaagactttcaagcggcctggtcatgtttcttaatgtagccaaattgttttgccacttccgtctctagtccactggaagctacaacaaagaaaatgaaaaataatcctttaaacaatatttacacacatggtcggaatccaacaagttgattttctttttcctaactcactgtattcttaagaaatagtgaacaaatttattgcagtgtcaagaacagtaggaaagaagaatcatgacgatgttattgcagcataattccaccgataccaaacatttcgtgatgtacctttacaggattggcgttcctttcttttgtagtattacaaagaaaatcaaagaattgtataatacacacacgtatcaaaaatggggaaaaattgcgatgtagctgcttctccagttcacaaaaagcccaatcgaatatcgtcacttaagatgtattaataaggatctgtaaatgctactatcatgcttttacctgcagtttaggaaagtagagagttattttagttttgactcctgactcctgagtgcgtctaaggccatataattatacaaatggattaacagaaatcttactgtggttaggtatctctcatgaatcttcagtgcccctctgcatgccttctttgcatccagacttccagtgatatcgtttaatatctgtttgcaggggacaagcacataaacaacataatcgtgtatagctttctacaatcatcatctcatgacacacacatggagagagagagagagagagagaccttcacgacatcgtctagaccttttgcatcagtcagtatctgcttgtttctagcctctatgacactagccacaatgaacacagatagaggtatctgctcttcctttttagccgcctgtaagtttttctgttcgaattttccacactgctttaaggcattttcatcttttgtgtttgcttgagatgtactgttatcactctccaacatagaaaagagacctggattgtactccatagaccacatgagctgcaacatttgtaaatcaaggaaacagccttataaaccttccacagtacaaatcaatacttgattgtaagtagaaaccacattttgattatgctttattaggataatcatgagataataattgaaaagtcaagaaaattcttatggtgcagggaactaatcaacacacctaaaaggttaaattatgcgaccttgttgggaagcttacctcccaaaggtacattgtgtctacaaaagagaactcccttcggaaaagaaccatcagcatacggaaggcaaataagtattcccctccatcaagattttctgcaaaaataatcttttgatcatggaataaatcacgctacttatagttcaataattcagaaagaaaaggcattgttcctttggccattctaatgaacaatatttggctccaaacaactctacctaaatgctcatgtagcttcggatcaacggctttcattacggatgacaatatggtcagttgagatcgaactccaatggaggttgaactactcacgaaatttcctcgctgcagagttagcatgtacaatatcaatctctcagtatctgtagaaaaattaacagagacagataacacatgcagcaaaaccactataatcaatcttaggggtttttttcccatataatgttcattagttcatatcaatatcaattattgttttgataggccatgctaagttgcaaaaatatttccagaaaacggttctgcatattacagcgaccatattgaccttttaagtttactgtaacattactgcagttgtgcacaacttttaattaacatcatatatcggaagtataaattgtacccttagcagcggcggagtcaaggcccagccagccatggcaaatgcccaggctccgcctaagatgctgcagtagattagcaattcattaatcatgcaaagttagcatattttttaattaattaccttaatgaatgctagattagttgagaaaattagcaaagcatataattaaggctcacaccatcacatgtttgcagtctatcagccccatctttttgcttatgcttatgcttattagccaaaatttgaattttcaatcttaaatttaaagttgattttgaggtttttttatcaaagtttatttttcagcctttgcttttgggtcgctaagagcacgtatattaaagttgtattcataaattatttttcgtttgtaaatatgttgtttggcttattcttataataagccaaacgatggagccctataggccatcacagcttatatactgcaactcgtactgttaattttacttgtgtcaatggtaaaatggtctgtagagttgtacaagttcattttcatttgtacagtactgccagtggcttgcccggggtcaataaaatttctagatccgccactgacccttagggtaaaggatctggatatttcttagtgaataaaaggctacatgtgtaaaggtgcttaccaccctgcgcataagtcgctcaaagcaccaaaacgcatccgcttcgtgttccaagaggatcgacattggtgagcaaagatcactcattcctgcttacaaacaaaaggattttatgggggggaacagcaaaatttacataacatgacatttagcaagctaacatggttaagtgttccttttccttttactatgactggatttgcaaaaggatcagttttgcttctgtaacgcaccttgacaataaccgatgtccttgtcaacccatgaataaactgcaagaatgtcccacaacctggccaagttctcttggctctcataatagactagttgacgatctgtacgattaacatcaagacctatagttgaatagtggaataatcagaccaatgaaagtataaaaaaatataacaatatgtgcccagtgaactctctcttttttttaaaaaaaaacataaaacggattgagggatgctgaaaagagaggattagtactcaccaatctggtgcagagttagcttccattgaattacttcctttggtaggggtgtgtcactagcttgttgttctgcatcaactgagttaggatcctgtataggctggccatcttctgttatgacaggcatagtaattacccttccgctaccgactgccgtgtccatttctcggcactttgttttcagtttctcatattctaacctataaaaaattagaatgagatattagaatgaatatacatgatcaaacaataaaggtgcaattaagaatgaaccttcgctgttgtcttaattggctcttttgttcagtattgcttttagggtcataacaacccagcaaaaactcccaaacttctcctttgatatttgggtgggtaccctgtttagccaaccaaaataaacaaggccttagtgtgaggtcatgattcatgaatgcaggaagaaaatgaggaattcctgatgtcccatcatgtttggatcatctgtcaaccattgtctcattgacatacggacctaggcttgtgttgttagtgagaaggaatttttgcaaatatctatatattactaaattattaaaacaaggcaaatattagcctccacatttgcacttcatcaggctacaatttaccatgttaattggagaaaaataaatagttcatagttcacattgttgattgtgtaacagatccatattagtgtagattaaaatgaagagtcaacatcaatacaatgtaggataactgaaaatctcagaataataaaaaaaactagttatttgatttctaagcatataacagtataattctactttctgaaaaagtataatttagcctggcgctgtggtgcaatcacggcgtaaattcagctagttcggagcatgcaagggattaatcgaaaagtatagctcaccccacgctgcactcttttgatcattccagctatgtctaggacaccttcttcattgtgaagcagcttccatctccttggacttagagtgaggccaggctgccaaaaggaagaggaaacagcacacaacgagtcaatgcacttcataatcaaatacatggctggcactaatctcgctagtcagaatcctcgatgcttccgctcggcaaatcgatctgagacaacaaaattctaccttcaaactaaatgccctcatcatcttgcaagatcaatcgattggccatctgagcctaattcagctcatccaggtaacagtaacagttaagataaaaaaaaaggtaacagtaacagttgataattagatactagatccaatccagcgcaagatgggcactgtcaaaatggggacgggggcataggggacgcggaattagattaaaacggagaattagaaatggatagaatgaatcaattaccctgggcttgaatcgcgtcttggcggcgtcttcgcggcactcggggcggatggggtagaccgtgtccggatcgatgagcatgtccggatcgttgtagcagcacgccatgaacatcatcctgttcatcttgaccgcccaaatcgagccgcggccaaagaggcaggagggatcgagacgagaagacgccggccgctgctggtgatcagctggaaccacacggacgggggggcagtgcgcagtgaggacgaatcaagatttgttcttcactccctcctttcctctcctttcttccttcctttcctgatttgtttgatgatgtgccttctctgtgattgagatccttggccgtagagagagagagagagaggagagagaacggaaggtggtgtaacggctaaatttggggggtcgggaggagagagacggggagacnnnnnnnnnnnnnnnnnnnnnctgcttggtttgtatcagggcttcgtcgctgagatggacggtccgagcttgagctggtcgtatatttctctttcgaaactgatgagttttcttgattgttccgttttatataagcgttctaggacttgtttgttagtagttgccgtttctgttggctgattgagggaatgaactgttgaggatacactatttaaagatttttgttagattattcaattagtaaaccgttggttcgaagagaaaatcattagttagataatctggaattcttccgttaataatcgtaaacacgagtgcacaacaacttcttggatcttgggtttcggaatatctgctatctctctcctgacttggatagacgtgcgtgcttgcttgactaccgaacaatattcggttgaagttttccacaccaatctctgaatggatcgtccaacatgcaactaaggtcaatcaagcataaagaagcaatgtactagtaactgggggtcagtacgaaattgtcaatgcaagcttcaggaccgctaatcaggcccaatgtttatagtatgtactatcatatagtgtagtatcatatgataaaacccacagaaaaatgtcgctgctaactctatcgcaattgtttacctaatgcatgtgcaagccaagttctggcttagactggagatgctaaggctccaacctcccaaaaggccaaagaaacgaactgcatttcagcgagtaccaaacaaatcatgcacgtacatgcgcaagccaagttcttgtcttaaactttcgaagctaatagctcgcatgatataatgtcgcttaacgatgtgaagcaaccagatgccgacactggcacgatgttgaaaataggaaccccatcaggtgtgcaggaaccaacaccaccttcttcaagctcggcgaatgcctcagaaaatacacgggacatcacatccgcagtcactgggtgctctactgaatagtagaatcttaacatctgcagatttcagcccagagatgatggttagagttcgggaaaaggcagatgcaaaatgattacaggacagatacgtaccgttaggttgtcccaggaaaagccattatctatcagaatcttagcaagctggaatgcacaaaatctagccaaagctttcaaatgctcctccgagtggtatagttgttcagttgtagaacagattttcaatgcaatatcatttgtgactgaaacaacagcagagcaaattttcccaccgattgtgtgcacctggcagcatgaatcatccaggtcagagtattgtgcgctccaggcactaaaagcttcgcttgatgctggcaatgaccctccagcctcctgttctctggttgggactccatcatcattagtgggactggggacatacaatattggttttatctccacgtatgctctgaaaaaatgaggaaaagtctatcttaacttaagaagagcacttgacattgtggtgcttcaagtatgagagtccagacagcactaaagcatttctctgagaaatagaatgacggatatccttacccttttggaagatctgatgcaaatacatagagaatggtgggatatgatccggtatttgagcaatccaaactggtgatgtacgaactacgaagtgtatgttcaacttgttctttttcactggacgtcaagtgtgcagaacagtacaccagaaagtgtattgccgaagaaaaaatggagcaaccaaaggcattagcaacagcttcactgtttcgtaatgcgaattctagttcagccgttgggcccccaggacagagcttcatcgtagggggatcaagccccagctgaccagccatatagagaatctctccatgaagtgttgcctaagcaaaattcaaaaaactttaacactgagaatgtacaactgaggagaaaaaagaactggtagatttggctagcaactaatctacaggaaccttgcttatgaattctatgtagaatattgtatagaagcatacaactttcaacatacccatgacatataaccacatagtgcttctcttacctggctataaggtccgatgcaactaggagcccagcatgaaatgctttgtacatgtagaactctcttgacttgctcctttgtaactagaacttccacatatgcatggcctaaaccaacctgaactagtggcaattcaactgtactacgtgaaggaacacccagagggcatttttgttcagtaataaagctcacataaacttcattggccaatccaaattccttcatgcttgaaatgaagaggtgaacatacagaacattcatccaacctaacccttcttccttgagctgattctcgattctgctcaaaactgctactagatctgtcttcaggcctatagacataaggagatattaaatggacgtttcccacaaatgaagatgcaaaagaaaggagatattcctgtcaggcgggactatggtcaatttaatgttacacagaacaataaggcacaagagcatgcaccttctgaagtaccacagggatcctgaatccaacaaccaatggagaacaactttttgccagtctttgagatgcataggtctatatttgtgcaagcatcaacagttgtaactggactcaaggtctcttgtttcttttcgacatcactgtgtgcaatagctccatctacttcatacaaataactagaattctcttgggcaatagcactatcaccaacggtgccaaaagaatttggcttgtgttcaagatgaaattttaacgggtgaagaattcctactggagcgatggaatcaggcgagtggagtataacttcaaaatcatcaagaacaattcttgcattctgcagtacaagaaactcatcagttccatcttggtaacaaaatgcttctgctgcacatagcacataatagtagtataaattatgaaatgcttcagaaatctgataagcatgctcagaatatagtcaatagccaagttacagcgtttcattgaatgtgattcatgcttaaggactggtccacatgttcagacaagtggcatcagattattcacattcagctcttatctccttaaacttacacggaatagagggcagtcaagagttagtgtttcatattcgccaccttcaccacagacattgattccataactcctagtgggatatagaaaaacaaaaggagaaattacaagctgcacagatgcaagtgactagtattgaccattagtaagaaaatcatgagaacagacataaagagagcgatatgttgtgatatgtttcttggaaaccactccctcattgatcactacgagaagctaaggcctgggtcattaacccacaagttataacaggatacaaggtcttctaatacatgaaacctccaagaggaaaatggctaaatgggatctatgtaggcagtggggaacatactcattcagttggagcagatgacacttaagttcagccagttctttccctaagtgagcagaaggtttgagccccattgcggcaacctataaagtccaaacatcagatattccatgtgataaacagttaaatacatacttgcaaggaagttaaaaaaaattatgtaccaagagaacaaatgcatgagtgtgctgtatataccttgacgattatagctactatgccccttcttatctgcaaacattaataaccaaaacagaactagtaatttgagtaaacagtttctgatatgccagacaatatgcagaagaagaaaaaatgaaattgaagttaccatttcatcaagaagcaaagtctgatcctgcttccacaaatacgccagcgataccaggcccaaccttgagcagacactctcaacacgaagcctctgataatcagacgcaatggcgcctgaagacactgcagtgatggatgggatttgccttttaacctcgctcaagagcgcaaacatatcctccacttcatcgcctgtggtaacattatatttaagaccctgctccctacaagcaagtccaatcaatgaaattgcatcaaatttcatctagataagaacagtagcagcatataacaacaataaagacaatccctgcacagatgccttgccttgaggatccacggatgcgcctccggaacagaggcaagcccatgcatttcgcataactcacgacaatctggtgcccaacctgaagcctccagccacatcaacaataggcatagcaatcagcgaatttgacagaataccagcaacgaatggccacagcccagcgctagaagcagctgctaatcagctaacgatgagtgaagagaggagtgcatacagtttgatacatgtagctgtcgagctcgtcgacggcgtcatcttcggggatgaggttggccagcgcaacaatctgcaagcattagcatgtcaatgaaaaacggatgatagaatagaactgggtgattgggttgcgctgcggttcgttgccttgccttgtggccatagtccaggcatcgcatcatggcgaagcagctgtccttgccgccgctgacgagcgccaccacctccatctccgccgccgccgcctcgcacctcctagggttggagctcgttttgttcaatttcttcttccggtcaaaacgctactggattccccccttcttcttcttctcctactggatttggggcggagcgaggtttgtgtaggcggctgcgcgcggcggagcaggacggagcagggcgcggcggacggtgcggcgagtccacggcggcggcgcggtgtgtggactgtggaggaggcgtgaagcgtgaggtggtgcgagctcgaggctaccgaggcccagagaccgagcccaatgttttggaaaattttgtggcccatcagaagatttaccggcccacgtaagtgcgttcttggagcccaggccaaaaatatttcctcattaactccggaaaaagaatgttaacacaaacagaaagatgtgtgaactacaaacttcatcataacgcttacacaagaaggaaggtgtgccaactttctttgccataaccaccgacaagccacgttgccgcaacaatgagactgggagctttgcacaggggagatcctttttatcaacttctgttgaataagcaaatccagagttgaataagaagggggggatacacgaatacttgtctctcaggaaaagttgccaagtccagggggggtaaggtaaagaaacataaatatgttgaatcttgaccacctctaaattaatcatcacaaagctaggacttggccctaacgcaacagcgaacacacacaacaaaaacaaattattgctatctatgaagcaatgatacaacagggccggagcaccatgaaattatgggatgctcctggtgaactgttgacaaataggtgataatcctgtcatttacagagtcgcaaacagcgtttcttcctttctctttccgttgtggagattcctctttctcttgccatattatttcctcttaccgccaccaagggacagcagctccaggctgcggtggagaggctcgtcgcgggaccctcttgcaacggctgctcgtgagagagaagtggcccttgtctctccaaccgatggattaaccctctgcgtgctggaaggacggcttccactgcttgagaacaacctgcttgtccggctgtattgctgctccattggttccaccgatgaacctggcctgctgcttgacgcaaccgctctccttgatgcactgcctgtacgggaggatgtacggggtctttccacggtcctttcgccggaccggtcggtgctatgcatctgagaaggtgaaccatttcatgatcgtcaaattacacgtaggagagatacacaaggggaagacattatacagcataggaactggactcctatctcaagttcatgcggggacggattcaacttacgatttcctttagtgacattgacggccgttgtgcataattgtcactctgattcaaagaaccagtaggattccttctgccagatgcttccctgcttaaaataagatgttcttacgggctgtattgtttgtattatagttttgttaggcgtctttcatgggtggaagaacagacctggggccttttccatcttctccatagaaggtcccgcagctccactggttctttcacttggctgaatcaacaagaagaacaaagtcaaatcaagtgtatcaaacaggagagcattgtccaataattataacagcagaatgcataccctcatcagtggtttggagcctatctggggatatttcaaaatggtccagtcaaatacataatcaaattgatatcctgtatcaatgatgccattagaaatgtgcagaacttatcctcagtttaaaaaaaacactgagggaagatggaaagaagtacaatttatgatcatgaggtaaggatttatgtttaagagaacataccctcccggataaagagatcacggaatagcctctttaagtaagaataatctggcttgtcttcaaacctcaatgaacggcagtagtggaagtaagaaatgaattctgatgggtaagatttgcaaagaacctagctcaaaaaaccaatataaaagtgtcagtttgatgcagtttgatctttgaaaaaaacaagagcagataccaaaagtatatatcatgaattacctccacaggagtaagcatctttttctcacttattttgtcgtacttctgcttcttagtgcctgctttcagcccctgccatggtaggctgttggaagttgaatgatagcaaatatttagcattgtttacagaaaatgatgtcaaaaacattacaagaaaaccagatgtctgcaatgctgaatatcacaaaccaacctgcctctaaggaagtacataaggacataaccaagagattctagatcatctcttctgctttgctctgtatgaacataaaacttaaattaggcaaaagctcttatcaaatgtactccatcagctagaagacacagtaaactcaccaacaccaagatgggtattgacacttgcataccgagctgttccagtgaggttcttgttctctctgcataatgaacatgacatcaacataaaaaaggtgaaaagagaagtgcattgagatatttgccaatgtccttataacattatacaattttgtgctggataacaaataaaacaacagcatatgcagtaggcataggcgtaatttaaagttgtacaccaacctgtatgggatgtgcttgtgagtctgaaggtccctatatttcttcgcaagcccataatctattatatatacctgaaacaaggtcaaaaatagtcaaaattaactggattcaagatttgctaaccaaatcttgtttctttctatcccacaagttatctacaattattattaacagaccacagttgtattttaactaaattcaccagatatcagagcattaatttagggcctgttcactttgatgccaaaaaaaccttaccaaattt

SEQ ID NO: 12435 - DNA, 859 bp, Oryza sativa
aaaacccaagccatatcattctactggaacatctttttggaccttcatagcaatgaagagcaccaagttacgaaaaatttaaggcgttagggcaccactgtatcaaatggaataccatgaaactattgatgtggttaaacatgcagaaacacaaaatggtaatagccaggtaggaacgcaaacctgattggctttcctaccaagccccataaggaaattatcaggcttgatatcacggtgaagaaatcccttctgatgcatgtactcaactcgattgatctggataacgaacaaatggtgttacgtcaggaatctatatagggcaagatacagataccagtttgattctacaacgattaacaaattagaatatatggattgaggaaatttgaaaataaagcatcagtgtcctcaccatctgatcagcaagcatgaggacagtctttaacgagaatttcctactgcaatagttgaataggtcctcaaggcttggcccaagaagatcgatcaccatcacattgtactctccctccacgccaaaccacttcaagtgcggaataccagctttagccaagaaaaaaggaaggtcaactcaatcataacagtcatagaaggcgataacaaagtaacatttcaacaaaacggatacgctaacaggctctaggcgcaaacttacttcctccctgcagaagcatgtacagcttcgactcataatgaagctgtgggtgcttcgtcttaacattttcctgtgagaccaaagcaaacaggtcagcaacaccaatgtctgaaaggtttccctaataaccaaattcccaatagtaccaaaatagtaccaaaggaccaacattcgggctgcagg

SEQ ID NO: 12436 - DNA, 907 bp, Oryza sativa
cttggacttggcccccacttccttgatccatttcttggctggtccgatggtctcaaccaaacgaatcaactgccccccccccccttttcccctttaatcccaccccgagatccaaacccgtcgaggcgagcggcgccgcgccgaggcaatcgaatcgggattcgggcacgagggcctttaggacccagatccaggcaaaccaccaagaaatccggtcgaccaaactcttccttccccccacaatcgaacgaataaaaaggcaaacaaagggaaaaaaataaaaaaaacgaatatgaacaaatcaaagaagaatcggcggattaacaggaggtgtgcggatccggagaaacggatacaaaaaggggatttctcctaataaaattccctgcgccctctcggcgaattcgccgcgagaggtagagagagaggggaagcggcggaacaaaggggaggagagagagagagagagagagagagagagagggtggaggaggagaagacgaagacggagaccagcaagagaaaaagagtgaaggagaggggacgattaataaatagacaccacccgattaaagaaactgattaactgggagcaggttgtttgtttttttttttcgtttttacaagtaattgacaggtgcggccatcttggtttgttgctcttttcttttccttcttctttctctctttttctggcactttattgtttcttgtttgttatggtgatgggtgtagtccgcatatagtagcagcagtttgtttggtccccttttccttacaatgcctcaaaacaaaacaccaacaaattgtttagctttaaaagaaaggggagggtcaaaaatagttgcttcaaacaaggggagtatctttagttgtagacttgtagtagtggttgaacgtaccatgc

SEQ ID NO: 12437 - DNA, 1233 bp, Oryza sativa
  unsure (1)..(1233): unsure at all n locations
ataaaaggagtgcatttgtgtctctaaacaaatcaaaatcataatatcctactccttcgaatgccttgtacggtgagaattgaaactcgcgcgtgtaaatatgttatcatatgagtatttaggtggcttctaaaggtaggatagggcattcttaggataagggttgacgtgcgtatagatctcaaaatgggatacgacatgatctggttccacgtcatataatatttattctataactgttttgtttgactcgttttaattgctccgctaaacgacatcattccttttggttggttggatgttatgctcacggacattgtctttttttttccgcctatgccttcagtggttctggagtaggaccaatgtctagaaccctagcaccgagatagatggtggccatgtcataggcggatgaaaacatgtccttatagtgtcgaccttgtacatacgtaggcggataagccattttggtgacgacgatgcaatcacgagcatggtaaggactctctgtaattgatgaaactggcgatgagagtgctcatgtcaatgtatcaaggacgggatcagattttacgaatagtagagaaaaaattgtctaggggcaacaactcctaataaaatacaagaagttatggcatgattgattgtgatggaactcgccatatttgaagagtgaaactcatggcggagatgatggaccattttaatttagattactaagtgaattattgtctcggattatctacttgactatagagataaactaaatatttttttaaaaaataaatttgatagataatttaaaataggggatctaaataaataatacagtagaagaaagttttttaaggaagcatattttccgaagcgtaaaataaataatccgatttataatatgaaatgaacatgatcaatgattgtgcacaattgtgtcttcatcttatggtatttgcaggatcattccattcctactacccaatctcaccacatcgttcaaacaacaatatgccatcctcccatcacataataattttacagccaatctaaaaaaatataaaacctttcatttagttatgggcccggaaatctttctactatttactctgttttaaaatataattattttgagaatttaaactttgtaccaaaatatttagcatttatagaacattaaaatataagtatttcaaactaatcagnnnnnnnnnnnnnnnnnnnnnnnnnnnnnnn

SEQ ID NO: 12438 - DNA, 1066 bp, Oryza sativa
ccgattggtgcctccgcctacacggctggcctggatgccgccgctggtgggcctttaccaatttacccgccggcctgcttccgtcgccgccgatgggtgcctccgcctacacggttggcctattatgccgccgctgttgggcgtctacgacttcaccgccggcctgcctccgtcgcgccgactggtgtctttgcctatatggttggttggtcacaccaccgttgttgggcgtctacgacttcaccgccggcctgcctccgtcgccgccgactggtgtcttcgcctatatggttggttggtcacaccaccgttgttgggcgtctacatcttcaccgaccggccgtctcgtccgccgccgactggtgtttccgcctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctgttatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgtcttcgcctatatggttggttggtcacaccaccgttgttgggcgtctacatcttcaccgaccggccgtctcgtccgccgccgactggtgtttccgcctgcacggctggcctattatgccgccgctgttgggcgtctacgacttcaccgccggcctgcctccgtcgccgccgactggtgtcttcgcctatatggttggttggtcacaccaccgttgttgggcgtctacgtcttcaccgaccggccgtctcgtccgccgccgactggtgtttacgcctgcacggctggcctattatgccgccgttgttgggcgtatacaacttcaccgccggcctgcctccgtcgcc

SEQ ID NO: 12439 - DNA, 716 bp, Oryza sativa
ccctatggtggttcttgttgaagttacccgggtggtagggacggtgctgccggataatcatggtggaaggtccaccgtgatgtcccatcgtgaaacgaggcttctgacacttcccctggggagtcctgaactgggctgccttcctcttacggttcattttgttacactgctcctcttgacggatagccttgtccacaagcttctcaaagtcctcataatctctagagaccaactggttggtcaattcatcatcaagaccagacagaaacttctcctgcctctcggcatcggtacgcacgtcctcaggggcgtagtgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagttggacgggtcaccatgtagttgtcccaccaaatagaagcgggaccttgtagctggtgtgtagcaaaagcaaccttctcctgctcgttgtattgcaaaagattcagcttcttctcaatggcatgaagccagtcgtgggcctcgattgggttggtggtgcttgagaaggtgggcggcttgacacgaagaaattctaacagtttggactgaggaggtggaggaccaaactgcaggttctgctgctgc

SEQ ID NO: 12440 - DNA, 666 bp, Oryza sativa
cagttacccactcccgcttgtggtaagcacggtaagtttcccagggtttcccgtgaaccggtctttaattgcaatgggtgcgaccagcaaaaccatgcaaccccaacccaccattcaatgtattttaattaactaacaccattgcggtggcaccaatctaaaggtatgccaatagacaaagtctatgtaataatgtgatccctttttgtgtgctagttgagctaagcatggctaagcatttcctaggccaacatctagtcattttgatccccaagttatcaatggcataaggtaaccaatatgtggctgaggaataggacccatcccacattacattgtaaaacaatgcaatatttaatagaaatgcgggacatttgtaaattgggtacaatatgatcaattgcaatgtatgacttgccttgctctcgcactgatgagatcacagcaacgtcttcgagaaactgcggatcgacgaaacggccgaaacctacgcgacaaacaaagcacacaagcaaaacatgtataagactacagaaacaggaaacaaaaccatttttaatggattctttgcatttttcttgatttactgagacttgaatggacttaaacggagctcggatgaattacttatgaattttagaagataaactgtgtttatttctataa

SEQ ID NO: 12441 - DNA, 841 bp, Oryza sativa
tccactatttagttaagtactcccgttgtttcaaaataattttactttttacccatacatgccaatacaaaagaaaataaatagaatacccatactttatcaaaatacaattattatctactttatctatttccaatacaattattgtatttttttactttcacaaatcccgatacaattactaccaaaaatgaatttattttgagacaaacggaaaagctaaaaaataaacttattatgagacggatagagtatttggcttgttattactaaaatatgtcaataacacacataagttatacaaaaaaaatggcattaccgacgtttcagtaagatgccaaaattcgattgtggattgatcaccagatggaatatcccgtgtacgctttccactgtgcaattagcaaatctggcaccaccatccgttgctcatcatctgaccttttcctgagtggataatcatgccctgcacttccaacttccagcacaccacacaattcaagtattcaacctccttttcataagcagaagtatctttgtcacactctactactactagtctactagcactcctaatgatcgatccttcccacgttcgaagcttcccctgtcactgtccatccatggtggtggtcagacaaccccagcacacaagaaatctgccatttgcccagtccaccgctgggttgcagtttttgatgaagagattgacttgacctgagcacccttccgattgtaaatagcagtttttgtattgctgttggttgagtgattgggcaatcatccaatacatatcttggcttcttggctggactccagtacccgaggtcgcgtgcctccg

SEQ ID NO: 12442 - DNA, 6251 bp, Oryza sativa
ttataaatttttcaaataagacggacggtcaaacgttgaacgtgaatagtgcaaaactgcacttattttgggacggagttagtacatatatatacacattacacattgcatacataaacatacaaccacactgccctctagctatacacatgccatgatgccaagagccaatgatcaccacccaaatccttctagcaatagctccctatggcacaaacagtcacagctgcacaaacacacacacacacacacatatcacccattcatctactctagctaatctaaaggcactagcatagtactacaatcaaccagtagtagtagccctcatttgcatgtttttatttcgcccaccaatccttggaatgttttagattcccccctctcactctctcatcaaggaatgagcatcccccattctcccccaacccctcatattttcagtttctcactctacctttcccctcctcccctagctaacccctctctctttctctctctaaagctccaatctttctacctttctctctctaaaagctggagtagcttaatttctttctttctttttctttctcagctgggattgcacagtgaagctagggagaggctatagctatgggggtgatgtagctgggcagtgaggctagtgacaatctctctctcacacacacacacacaaaaacacttgtgtatttttggcagatgatgtcctgtcaaggaagctgcaattgcaagcccagatgttggacgtgcacgctcgccctccctattaaacccgccctcctccgatgctccctctcctcctcccccctcgccgccgccgccgccaccttctccggcagctcaccgtcgttgtagtagctctggtggtggtggtggtgacgacgacggctacggcggcggcgacggcatgctccggtcactccactcctcgtcgtcttctgacacggataacaacagcggtggctgcaagaacaatggcggcggcggtggcgaggccgccgccgccgttgagggtggcggtgatcagcgtgccgttgcggcggcggcgccgtcgacgcgggacttgctgctggcgtgcgcggacctgctgcagaggggggacctgccggcggcgaggcgagcggcggagatcgtcttggcggcggcggcgtcgccgcggggcgacgcggcggaccgcctggcgtaccacttcgcccgcgcgctggcgctccgggtggacgccaaggccggccatggccacgtcgtcgtcggcggcggcgcggcgcggcggcgtcgtccggggcgtacctggcgttcaaccagatcgcgccgttcctgcgtttcgcgcacctcacggcgaaccaggccatcctcgaggccgtcgacggcgcgcgccgcgtccacatcctcgacctcgacgccgtccacggcgtgcagtggccgccgctgctgcaggccatcgccgagcgcgcggacccggcgctcggcccgcccgaggtccgcgtcaccggcgccggcgccgaccgtgacaccctcctccgcaccggcaaccgcctccgcgccttcgcccgctccatccacctccccttccacttcaccccgctcctcctctcctgcgccaccacggcgccccaccacgtcgccggcacgagcaccggcgccgccgccgccgcctcgaccgccgccgccgccactggcctcgagtttcacccggacgagacgctcgccgtgaactgcgtcatgttcttgcacaacctggccggccacgacgagctcgccgcgttcttgaagtgggtgaaggccatgtcgcccgccgtggtgaccatcgccgagagggaagcaggcggcggcggcggcggcggcgaccacatcgacgacctgccgcggcgggtcggggtggccatggatcactactcggcggtgttcgaggcgctggaggcgacggtgccgccggggagccgggagcgcctcgccgtggagcaggaggtgctgggccgggagatcgaggccgcggtggggccctccggcggccggtggtggcgcggcatcgagcggtggggcggcgccgcccgcgccgcggggttcgcggcgcggccgctcagcgcgttcgccgtgtcgcaggcgcggctgctgctccggctgcactacccgtcggagggctacctcgtgcaggaggcgcgcggcgcctgcttcctcgggtggcagacgcgcccgctgctctccgtctcagcgtggcagccgtcgtcgtcgtagccggcgacgaagacgacgatggcgacggcggcggcgaccacgggctagggtttgccaagctcgattgatcgatcgatcactactgctcccatatataaatagagaatatatatatatatattatatatgaacatttgcatagatgcaataatattggctactcgatctctagttagcatgcaagatctcatggaggttttgggaggatgtgaactagttgggtttgcaaggaggaagaaaccctaaccctagctagctgcttcattaattgctgttaaatctttggttgttttgcttgcttggctagttaatcaaaagctgttaattaatttcgatcctgcaatgggatggagaggaggatttgagaaatgcatcatagcttaattagcatgaggatggcaatggagtttgaagtgatcaagaacatggtgagaggctactactacgtactagtaccaattccatgttttttctctttttttttccatttttttttgtttctgcatgtctcactagttcctgttggagatttacatagttctagggagattttgtctatatgttggacctaaatattgcactactattaatataatttgttaattttgatgtgaggatttgttgctacacatattattgcttctatatatattctcagtgttctattatttatttggatctgtagatcttgcaaaatggatcatatccaccatgcatgcactttttctatgaccttcatgtttttttagtcatgtgtgtgtaatattaatttcttaggcatggaggccaggaggggatcttctagctagcttctatagctcacttgcatggcctcattttataatcctacatttcacttgcttgttggtgcttgatgcccttgttagtattataactaatcatgcgttctttggccagcactaaccataaactaatccctattttgggaggttgtttatgtgggagtaatgatcactcctgtagtgttgcaacttgcaaaggcaaacaaatcaaattgtatatatatacagacaggttttgtatatgatgctaattaatacacctagctatagctagtgttttctttttcttctaatgtgctcttagggagaaattaaagaaaatgttgtgtgtctcctctcctgcccagggagaaggggtttgggggtcttgttttctgtgacacatgcccctgatatgctggtaagctgtctttgtgagggcatggcatgatcccatgcatcaatgccaccctaatccctgccccctgtcccctcaaacaaaatcatgggatttctcaaaaccaagccaccccttttggtggccaacttgcccccttaatctctctctctctctcatatatgtggttgcaagagtagtttctctctctaagagtgaaaaagatcattcccttttggaaggacccatgttcctctctccattgccttgggatctttgcatgcatgccttcttaattggttcctcaaagagagccatgccggccatgccctacttgattccctttggttgcctgtctctcatgttttaataatttaattaagtatagattggtacctcttcttttatatctgttactaggcagttgtttttagagaatttttgtgtgaggcgtgtggtgggtatatatgtctgtgaaaaaaatatataaaaccaatcacacttgagttcagaaaaccaaatcataaaagtgttttattgttcgttaggagaggtgagtttatatcatatttatcttcttaataatagaggtaccacaaattaacaatagagtggtataccatggtacaacaagaaccatgaaaagctcaaatcataatgttgcccttttgttataattcaaatcatcagttctttatgtgatcacttgttgactgctttcacatactccagcctttccctattaaattttgtcatgatttttcatgaatggatggattatcaactagctatttttagatccgatgtaatctgaggttcctttggggggcataacttttgatagaaccaaatctagcaggtgtggtcaaaacattaattttgagataattaattatatataagcatattggttttagtagtagtatatatagcatttcatgtcaacttgttgtacaacttactagcgatagtgaatagttgattagacatatatgatataatcgataatagtatattgtagatggatgggttagtggggtacacgttcactatgaacaaatttgcatcgaataccttttactgccttgatatatttgtctgaaatcttgcgccagtgtaatgtggagtcgtatatacttgctactatataaattaaagaagatattgtagtatgcttaattaccggcagtaagattaattaataatgtatgggcccaagctgtccagctcaatgccatcagtgggagtgtcaaaccttatcttaatttcggtgcatattacaattatgctgaccttaatcttcctcgcacacatgctgcattgcatcatcctcacatctctttgactttgattaggctataaacaattgattgtagcttggtattttaacctcatcaatcttttcctcaagaaaaagtgacattgactgatatgtctgcagtcaggccctagctttctttgccttccaaccaatgtgtttggcataagaaaaaaaaatcctactactacaatgcctagtattctactacctcctcccataataagcgcagcggtgggtttcagtgcccaactttaaccatccgtcttatttgaaatatttttatgattagtatttttattgttattagatgataaatatgaatattactttatgtgtgatttaaattttaaatttttgttcataaatttttcaaataaaatagacggtcaaatgttgggtacggaaacttatggcaacatttataatgggacgaagagagtaatgataacatagctacattcacaatgtactgtaggagtatttgtgtttgcatggacatggcatcttataatcttttattcctagtatatgctgccccagctatgcactatatctatacgcattccataccataggtatatatatcataattaacctaagggagcatatgtaatatcacatccactccaaactactcctagctaggagtatgtactgcctacctcttgcttactctacttgccttccttgtagaacacctacaaaaaaaaggtggttcaagaaaacattttttttccttgtaagaaactcgaattaatagcaatgcaacaaaggtaagtgtgcggtgcagcacaaaagtttgttagaactgtcgtcgatcgatcatgtagctaggccttttgattactccctggattttgcgagagtttataggggaatctcttcaacttagtaactttttggagaccgatgttacatgacattcagcttcgtcaactccaatgaatctcatctgcaaaaatttttgtcaactacttaccggaatcatacgactttgtaatcttcctaaatgattgccatcttactagctactactaactagctagcatatatagctatcgatcacaaccaagctaactatagatcgggatcgctcaccagattcattaacctttttattacacatcctaatcaacgcataaacgttttcacattcatatatatgttcaagtgctatgaattatacatgaagataaatattgcgcgttgattttcgtttctttgaacatgaatcgggggggggggggtgcattcataggcgtgtgagtggatgtagcgtgtgcagtgatgtgtgtacatgtgcatgtactatgcaatcaaaaaaataatactaggttcaagctactccatccgtcctctaatataagggattttgacattttgtttgcactgtttaaccattcgtcttattaaaaaaaattgaattattatttattttatttgtgacttactttattatctaaagtactctaagcacaacttttcatttttatattcgcacaaattttttgaataa

SEQ ID NO: 12443 - DNA, 1620 bp, Oryza sativa
gaatatattaattaacacgcatacataacaccctatcagtaaccagctagtattcatataatgtaatttgtatccccagagtatttgcttttcatgttcctcttaaaaaaatgattgggccgtgttgctattacaatttcagtaagcttccatttctctctttcagcacaagttaattaccaattgcagtgaaggtttgatgaagtgactacttaatttgcctgggtggccaagatgcaaaacaacagttggtactcacagcattcactgccatgatataggaggataggacagaggatgcatgcacacacatcatcatctggtaaaggggcatgcagcatttgtgtgtgcaatagagatcccaatgctgatatacacatttgacgattggattctagtagtagtgggaggaagaaacacaagctttggttttgcatatctgtctcatgcaggcagtgcaccccagctgaatctttgggagcatctctgtcatctttttgtgtgtgtgatgtgcatgtttctgctctctctctctctctctctctctctctctctctctctctctctctctctctctctctctctctcttaaatgccaatgcatctatgcatatgctttgtaccacattcatatatatggatttattgcattgatgtgttgtgttgtactactgatgaggcaagcatcatgagatcatgctgaaggatgagcatttgggcatcaatgctgcccccctgtgtgcatgtttacccatgcacggttcctacagggcatcacatgaatacatgatcaaaccatctttattacagattttttttataagatgctcacctaagagtatggccaagaatgcttaaaaatctcccccccccccctaaatctccttttgaattctgtaacgatgatttaaggattaaaaaatatacttctttcccatatatagcctaaatttgactctctaagataaaaaaatgtggccacctataaatcccgcgcacgatttgcctccctcagcgctagtcttgctcgctctttctctcaagcgataccacacagattgcagattggaaatgagtgcgagtcaacttgtgtagagcgacttggacgagctggaagggattttcaatttttggacaggtggttaggctgttggacccatgttttcaactaaaatcacctaattttgggattgagaggagttttggagaattgttggccatgctctaacaattccaatggaacttcgatcgatatcagctcgcctttcaaataaaacctctaccattagttatctttctttacatttaggttgaagtggtgcattatttggacagattatttaatttgacctttaggctgctagaatttagataaactgcattccactaattatattaattgatatatacaaattctcgctcagaaaagttggtgattttatgtggcattttgcattatcatgtgtgtgttttttaggtgtagctagcctagctacatatatttcagtttgctgtattttcttaattaacctaaattatcttccttctaaaaaagattatcgtgatgtcgatcacgtctttgtccaacgaaaattaaccatcagactctggtgacctgaa

SEQ ID NO: 12444 - DNA, 1468 bp, Oryza sativa
tgataaaggaaccaaaaaattcatttttgtaggagcatccgctatatgttgggctctatggttcagtagaaatgatatggtttttgataaatctccgtatgtatcttatatgcaggtccttttcaggataacatactggctccggttttaggctcaattacaaaggtgttatgaggacatcaagctaataaaatctgcatgtcgactacttgagacaacggtcatgcagctttttgccaactttggttggaggttcaccaataggattcaataatcaatgggtctttgttttacgtggttatttgttagcttgtgtttcctttaccttactagtgtgtgttttttaagacttttttgtgtgctggtttgtgtgaatttgtgtagtaattgactgtaacttcttgagcaaaggctgagattttattccattattgaagaaagaattaaaattggagcgcgtggaattaacacaaaacgcatggagaggaacatgaaaaacgctattacagaagtgatattttgcttttttttttaaaaaaaaagggacggaggagaaagcgaacaaggagaatcacttgcacgttgggggtctgagagaggggtccctgacttggcagatcctccagcgatcccgttgcagccttgcccactattctatccactatcgccctcctctcctctgctctctgccctctgctgctgcaagaagctaccaatccaatcctatcattgcaacatcctcaacatcctcacacacaagcacacagctcatccctctctctctctctctctctctctctcacgggcataaatcacatccgattggcacatcaatgcatgccaatttgatgagcatgagcatttgctgctaaaaaaatgtactcctattttttaaaggaaaacaaacacagtaggggaaatgtaaccccacagtaaagataattgcaaaaaaaaagtattaatcccgtatttataaatatattggtttgatgattcatgaatcgccgaaggatgtcacacatttataaaatttaattggagccttggtaggcttcagagagaaagcaggtatagacccctcgctacgaaaccatttttcacctcatcttttattaagtacatgaaggaaggatttagagtactagtctaatgaagggtcttgctcatgaaagcagcaccacattcatcattcctttagatgactggtgaaaaatcaggccatgtttagttactacgaaaaacttttcactctgtcacattaaatatttggatacatgcatagaatattaaatatagacaaaaaaactaattacacatattgcttataaattacaagatgaatttttaagtctaattactccatgatttgataatgtagtgctacagtaaacatttgctaatgacagattaattatacttaataaatttatctcgcagtttacatgcgaaatctgtagtttgttttgtt

SEQ ID NO: 12445 - DNA, 12224 bp, Oryza sativa
  unsure (1)..(12224): unsure at all n locations
ctgtaacttgcatataattacactgtaacaatagtgtaacttgtatgtaactttcaaaaatctctctgtaatatgttatttcggtaaaatggaggttatgggaacaaatccttacacatatgtgtgtgctgtgatttttttcttcctcaccaaaacaaatcttgtaatagatttaacgattcaaaattacgtgaaacttatatacaagttacactgtagttacatgcaaggtacagtgtaattacatataagttacagtgtaattacactacgattgtactataattacatctgtcaattttttaggagaaaatttatcgataaatatatagctggtcccatatttttatatatttttttcttttaggagtagctaattgaattgcatctcctagctagatgtcacacgtgttcttcgtatcattcattcatgtgtgtagagtgtcgaccctgtagtcctgtagcaggcattggatagcagctggcgcctggcacccaaaacaactatgagccgcgtcagttccaaatccatcagaaccgttggtgtccaaaaacactaaccctagttttacttttcctctcccctcccctcactatgagccgctctacctcccctcccctcaccggatcttagccttaaaggaagtggcgggcggcggcgacacagctcgaccaaccagccccagcgccagcggccactccgcacccctcatagtcggatctgaccttagggaggcggtgtggagctcgaaggccgcggcggcggctgaagctcgacgatagcaaactcatgccgctcgtatctcttgcgagatatggtagctagatttttgttcgatttgggttttctttttctttgtctgcctttatcaactcttgtatttaggatctaattcaagaaaattttgtaaccaatttttgtatgttgtatatgcaacttctcctggtgtaatactaactgatttaaattttttgtgttatttgatatggactctgaatgacttttgtgtgttggacttgggatgccgcggatgaaaacatttaggtgaggacgttcaatttttattaggggcaatgtatcatgtgcacacatgcactcatgcaacggcatccttccgatctcaatccaaaggctagcatcatggttaaggaattttgcaaaaaaaaaaaaacaaaaatccctgacgaggcttttctcttatctcatcttcttatgtatcccaaatcttcatctctatcaagcaattgaactgggaagccccagatctggaacgagaaagaaagaatcaagcagcaggtggcgtacgtacatgttctattgaaaatcaaatctctaatttctctcatctcccgaactcgccggcctttttgtaggtggcgccgatggtagccacatcggcagtggcggcggtgcagctgctgctgcatggctacggaagcatcggcagcggtggaggcgccggcaaccagaaatcaagcacccacatacataatatgatatagggcctgttcactttgatatcattttcactttgataccactttaacaccttgccaaaattttagcaggtaccaaaatttggctgcaaactaaatgtagccactttttagcaactttactaaaatttagtaaggttaaaaatggtagcaaagtgaacaagcccatattttacatctaatattaaatatattttagtactatattacttttttataaaatatattgaaaagaaggaagtttcaatttaaaaaattaaaacatcttgtaattaatatactcccccatctcctaaaaaatcaatctagtaccagatgtgacacatcttaatatatattcggtactatgttagttttttttatcagggcagagagagtaaactactcgatcgagtactctttttcaaaaaaaaaaaggtacaaattgggccaaggtatatgtagcccatgcatgaagctactccgaatcactttgagcatacatggatggattcctccaagcatggagggggagagagagagggaggtaggtagctaatgatcgatggatggatggatcgaaaagatcaacgcagagagagtgagagagatcaggctaagctagctggagtagctctctagacgcagatcgagatgccacgctatctatcttagctagggaaggaaagaatatgcgttagtgtactagtactacgtgcatatgcacgcacgctggctggctggctctctctctaggttgcttgtgcatctcgcacaaatatggcccatccatgtggacgatgtcatgtaacgtacgtacgctgtccctccctcccttccccccactccgttcaatcaacctctatagctacgttgtagagtaccctgcctagctgcacactatgcccaaatcatttacgtcccaaaatataagtattttttaagttagcacgggtattaagaaagtaggtgagaataattgaaaaatgtgtgtgattggttgaaaaaagaaagtaggtgaaaaagaatggttgtgattggttcagaggagaaggttggtagaaaaatagcttcattttagaataaagtactgtgctagaaataactacattttagggcggaggagaagcttgaaccccgatcgagcgtaggtatatcaggtatgtttgcaagtgtgtttgctactagaatattcttgtagcgctttgccaatttcaaaatatacccatatagtctttcgaatatgtgcgtgtgcaggtttataagagcatggtcagccgttttccctaaacatctctctcccaatattaaaatgagggggttttggttgaaaaagtcgctctccaacgatctcgtaataatctatttaagaattggagttccttctgtgatggagctaacgtagttgtcctccaacctggatgcatggctaatagcatttcatggcaatcgctcaatttttgtacatattgatggtagtcggtaatggaggcacagtgacagagcccagatagtcggccaacctgctcaagagctacctccgttactaagttcatttccccatgaaagtctcactctccacaagtcaaagcgccgtgctcgttcccaatcaactctctaccaaatcaatcgcgcgaatgcaggatgaggggaagaacagtttattggtagtttgggggtagctcatatttttatcttagagtcaagctgatttcaggctatctgttggagagttattttaacatttgtgattggaattttgagaaaccgttaatcacgctttaaagatgtgagcgtctacgcttgtaccacgcatgcatgttccgttcgtatagcatattcttgtagcatagtatgcatgcgtgcatgcatatgtctaccactgcacgctacggcatcggccaccgaccacatgcaaagcatggatggatgcagaaaggtgttgcagctaacgctacatagctggagtagttgccacgacgacgacgacgacgaaccgatcgatcgaaacgtacataccggccggccggcagctagcacgcaatgaagcctcaagtctgtcgatcgtccagtacttgataggcttcagctaagctagctagacgacgacgacgcctagctatatatagagccaggcctagtagagctatagacccgtctcgctcgcctctgccaccatgccgtgtcgtcgtcgtccctgacatgatcgatgcatgcctgccccagccgcaggcgcgcacggcggctggccggccgaccggccgtacgtgccgccgagatgtttcgatctgggcatcgatcagggacgacgacgagacggcgcctcgccgtcgtccccggcccaataatccggccgacgtcgagtcggcaataattgggaagcacgcacggaagcgtccgtccggccggccgccggcgatggcagggcaggcggcgacaacggcggcatatactaccttcataatagtgcaactatgagtttctgtatccaactttgaacgttcgtcttatttaaaatctttttataattagtatttttattgttatgagatgataaaacataaatataactttgtgtgtgacttatgtttttaatttttttaaaaaaaataaataagataaatgtttaaagttggacatggaaaatcatggctatacttaaaatgagaccgatggaggatttgtttgcactaggaaataataaagcgaaaggaggggttacgcgctatgtacctgtgaattgtgatgacgagcagctagctttcgccatgacaaagcttgaagccatccgtagcttttttatcagatcgatcaccacgtgcagcagctagcaatgcaccatcgatcaaacaagaaaccgttacctacaatgtacatgcctgcacaggttagagagagtccaggtgaaatactacctccgtctcaaaaagacggagcactatctagcatgagatttgatatatatcatatacaaagattcattatattaagatagatcattcaaatgctatcctagataaaaacattttgagaaggaggaaataataattacatgcatatatacaaccacacaggctcattctgcttctaccttgtctttagtctttacaggattattttcttattacaaaacggagttacggaggcatgtccatcaggaacacctgccgcgcgagtgtgtatgtgggctccggggacgacacagaaagaaaacacgagccaagccaagccaggccaggccagcgccggccagccaacaagcgttgtggcgtctcacacgacatgtcacaacgcgcctgccttcctgccggctcggccggcggcggacgacgcgtcccgtcggcagctagcgccgacgctgacgttacagacagccctgacgtacgaatccatgatgcgacggacgcatatgcagcagagatcgatcatcgccgcccccgacacaatgaatataatttcgtcaatcatcacctacggtggcggctgtcgtcgccgtcgtcgtcggcggcggcgacggagacgatctcgaccaggtcgggggaaggtggtggcggcggcgccagggcgctgcgcggcgaggccccgaagtggtcgctcctgtaattgctcccctccgtcgcgccggtggtggcgccgccgtgggacgactgctgctcctccttcttcctccgggcgtccagggcccaccccgcgacggactcgtgcaggcccgacccaatcccttgcagcttgatgcctccgtccatctgggaacgccatcgtcagagagcagtaaaagtgaaacatttcatgaagtagtaaaaaaccttcagaaggagattgggagtttacacgagcgaattgatgataagattaagatgagaatttgatttttaatcccaatatcttgtttggtagaggtgatggatattgatagggagtttagttgaaaattaaatcattaataaaaacggatggctgagatttgcttagataaagtaaaagaggaattccctcccaattacctacccctaccaggtattgaaaaggagggagttccttcctcaattccccatccccatcccaccaaaattctcatgtctcccaaccaaacaaaacacttaataacctcatccctctaaactcccgatccctcctaaaaactccctccaaccaaacggaccgtcaaaagagagagttatttctggagcctacatgtgtaacgatggcgtatagtggtagagtgacgtagctgcagatcatttggatgagcacactgcattaaacagcaaataattagtcattatcaagacgactctaagtaatttagtagaactaagggcataaaaggtcaacggataagtaatgttccaactcttattgtgctagcaggactatgcatgtgagaaagaacgaatcttgcaggtaattcagaatttttactgacccaataacaagcctagaaatggcgtacaccttcttctccataatgcacgagtcgaacccgaatgttacctgtcgagtgattcctttattagctgcgattctgcgaagtcataatcattaaatgcttgcaattgaagtgggagagcgcaatggacaataccaagacccagatgaaaaaaccaatctcgaaagagttctggaacaggatgaaatggatcaggttgaggacaatttcaggtctgccaaaccagaaatgttccttcgatggctttacataaggagttctctctgttccgtgtgataatgatgccactgctgctgcctcttgagctaatcgggtaataatatgctctagctttgcaccaacaacaagcaggagctgcaattttactccattatcaggaagtgcctcattcagatataaattcattctatgtttacttttcaaaaataacagctaatgtagatttgagtcagaatttaaaagtagatgtctcaccaaaaaaggaagaattctaaagtagatagcaggaagtagagtatatgaattcaacggaacccatgtcaaaaggagaaagtttgacttacaaacagaggcaagaaagctaaccagaagtatgtatgccatcctgcattggacaataatcaaaggatgaagagcattacaccccacagaaaactattacaaaccttgctccataagagaactgataccactttctgaatcctaaagttgatatgcaaatggcatgctaattcatacaaggatagtagcatacaatgcagaaacaccatgttattcacaagccaccaatggtagtgttcaaataaagcatgtactggtaataataagaagataccatgccattttaatcatttactgtataccactatactggatccaatgaatcaaggggacatgtagactaaccgtttatattcagcaataggaaaaggatgacaaaaagccacatgtaccagctgcacacaactagctaatattaacgtcatgtacaaatttaagtcaaaggttagaactgttctatgaaaacaccaacctgataccaactactctcttaaagtcatgttcaagagcacgaatcaagtacttgtagaaattgaaggatggatgacttgggaaatgtttctgtgaaaacaaaagcaccctgttcgcttcaatagcgatgtaaatcaatgagcaaggcttgaaataaatgatgtgtcttaccaagccgaatgctgatctaagtgctttataatctgatttactcacagaatcatgaaactgcttaaagaaagcaatctgcaatatatgtagataaaagcttttagaaaaaaacaccttcgtaaagttatagatacatgaggcactactgaagacagtaagcaaacatcataagcattgcaataaacacatacatagaacatagtaggagaatggtaggaaacaatgtcttgcggaaagcatttaactatataataaagaatgtttactgaatgtattgatccaatatgaacatcagacatgtgaccactttgaaagatagcatttttttgcatactttccatactttaatggcactgtggcatgcaattcgtgcaatgatataatcattgcttatttacatcaatcatgatttggatcaacttacggccatggcagcatgcggatatccacattccaaaatatatgaaatgagaaagcacaaaagatttggcagatgacttactatccagcttacaacagccagcttcatccataacccctttgttcgctcactgacaaattcaccctgttgattatgtgcaatacgcccaggtgtagcatctcttttttgtactacaaccaatttctccaataaaaatgagatcattacacaacgaatgaaaatgttaaagtgttagcagcctagtgcttctaacaggaaaatggagacacgatcttttatacagaacttcctaatggtagtaactagtaagtctggaaagggaataatcagagcgtggtgcattaacatcattaagaaacactgcaaaaattggacattccaatatgtggtttatgcatgtcgtggtgactgccttgttcatgaatgattaatcctgggtatcaaccaaaaagaaactaatatttgaccaaaggaattgctcatcagtaagtatatctaaagacaaaaagggtcttcaggagaagtgggcataccagtgaccaaactgtacaaccaccccactattggaatttaaacccatttccacttgtttggcataatgcaaagtgcttatttggttaagccaatggaaaactcaattagcaaacataggttataggtacaggcattggaataagcacaaatccatttttcagtgtagtatagaagcattacatccaagcatattgagctatcatgctaaagtgctctgaagccagctcggtagaaanaaaggggtatgtgaccaaaacgcataagtcataacttaacccacatataggttatggacagacaatgatgcaatcatgcagtcacaattaagaaatttatgaaactgaattcttcctcctatggtaactgaatttcagtgacaatgacaatggttaaaaagaaactgaaaggtgttcagtcgcatgcaaatggcttatcaatatatgcttatgccttaaaacaccttgaaaccaaaggatggcaggaacaagccagtgtgaacaactaggacaaaatacaaaaaacatgggaaaacataagctgaggggatgtgcaaggttacagagtatgttctaacttaaatcagtgaaggtaatactatcttgtgaaagctgaccctttctacgcttcaatatgcattcaagaaaattgtgtatctttatcttttataattatattttattttggaacataagttatttaaaaacagaagcaaagaatagggaaataacacacacatttctgttgcatttcctgttggatttctgtctcccaaagcttccattttcttatctacaaagtttaaccaggcaaagattaatcaatggaagcatggtcacatatcacagagacttatctatgcagatataccttcgctccaccaagtaatattgttgtagcacagaacacaacatggaccaaaccaagtataaatatgaagatgtgcagctgatgcaatgcctccactgataacaaggggaacttcaccctaaaacagagcaaacctgttttgttacaatgtttattgaaacagttctgcaaaacaaaattggcacaaggttttgctaaacaacaatgtgtaatttgtatgccagaatggaatttcaaacatcatagaaccaggcatccactttcaagaaacaatttcccacaaaaaagttgcaagaaaaacaatcagatactattttcatttccaagaaaaggaatccttaatattcgataatggtgtatatccctaacctttttcttgcaaagcttaacaccttctgaaagctggtaagtctctttcttgcatggaagcatcaaatgcatagcattttccgaaacacaaataccaacaatgaaaccttcagagaggctcaggacgaaggaaatgaatcccagaagcattaactctgcatatgtagacactcaattagataagacgttaaagaaataaaattttaaatgaaatagcataaattttgtgaaatacaaatataccgtaagcagctattttgaatatttttgtttaaccaaaataagtgaaattctacaacagatgtaccatgtttatatattgaagtccggttaacaatatcgaaaataagcaactgaagatattcctgaatgataccttcttttagtctctcgagagctgaatacaatgccttctgatctttatgtttcaagaactgtatgagcaagaagaaaagaagaacttagcagtttcttaatagcattgtcgaccattattactaagtcaattcaacaaatgtgttgagtattaaaactcatattgaatattgaacaatgcactgtattttttttaatgggaaaaaatgaaagttaagctctgactgttattgtttcaacagaacataaaaagtttgctttcttagaagtccactaacataaaatacccagtaattaaatcaattaatagaagacacgaacaccatcatttgacgcctaaccagaagagctaactgacacacagcaaggaaacaagggagcgaagttaactgggtcaaaggaggataactatattgagccaacaatggaagtgccttgccaaaaagaaaaatgagattatgcatagcatgtgagctatcaccttacctaacaatgaaattatttgtattggcaaactgtctggtcctagaaaaacggacgagtgtgcttgtgtgatgatgctggcaggaaaaatgttgtgtctgtcaactagtttgtcagcttaggatgtgatgagattaatcatacaacacatttggccataaccatgtagtactaaattactgtgcattcgtagcacagcgagaaaaatccatccacagagaagcgaacatctacacggctagctattccaactgagcactcaaattctagctcctcaatccagtaaaacaaggccatatgtagttgcaaacaagttaaatatccatccaaaaccagcccgcccttatgttgctggaaacaagatgaactcgattgcgatggcgtcaccagttcatcagccattattatgacttagttacgagacctcgattcccgcaggggaagagaagagaaatcacggcgagcgctcggatcggatgcctgcaaacccgaatttcctgatcccccaaacgcgagcataacccacagcgcgtagcaaatccaccaccgcgtacgaatccaacacgaatcggcgggtgcatttggagaggcgagagcatataggggtgggataaaggagggaggaagggaggtgcgcgtgccttgccgaggtggtggaggaggcgctcggcggcgagggagacggagacgatggcgaagcagacgacggccaccacccaggtgggcgtgtgcgtgatcgacgactcctccattctcctcctcctcctcccctcagctcgcgcgccgcggcgtcgtcgtcgcccctcctccggaccatccgcacgcagcgtgcagctccgcgggttaaaggggggcggaggcggaggcggcgacacggaaggaatcgtggtggcgcggcgcggccatccccgcggcgtgagcgtgactgccccgggttgcttgccggcggcggcggctggattccatggctccagcctagcgcgatgcggcgagtacggtggcggtggaaggaaagctagcggaagagggaggcaaagctttgcttccaccgccggtctcgtcccctccacgcggcggcggcggcggcggcggccaacggctaccacccagcctctgcagtttgcgtgggccgggggtaggctaggcccatcaagaggctcagaagctataaaactattggaaataagtccactttgtgtcccttaattagtggctgtatctgattcatatatgtgaatcacaatgccgatatttgacccctaagtattaaatccagtgcaattaaatcgggttaaaaattaaagcattagtctgttaatccttttttttaactcccaatgcatgcttattttggtggagctataattaactcgtgtcgtccttccccttcactgacttgacagccacacatgtcgctcccaactcaggtatttgtatcggagggtgccggtatttgttaccggtccgaattttaaacaaaattttatcaaatttgaatatatattgccaaaattcatggaaaattaaaattttcggccgaatgataccgtatcacgggttcgaaattttgaagatagcctcctcgctatctggtgatctggtcaagcgagagcgttctcctgaccgtgtgaaaatagtttttcactatacgatatccaggttttcactacaatactttcccagtaatctatgcacatgtacaatttttataagtacatataaaaaattcaaaacttttggtgatatttattacttcctctgtctaagaatagttaattttaagccccttccatcttttatagaataattttatcttttaaagtaattattatatcatagtttgtgaaagtagataataaatatattgagaatatataagaaaaaataattaatttaggatttgataaagtggaggtattttaatttttttggttttgtattggtatacatagacgtaggatgagtgagaaatgaatttatgtatagtatatactccctccgtttctaaatatttgacgccgttga

SEQ ID NO: 12446 - DNA, 26696 bp, Oryza sativa
  unsure (1)..(26696): unsure at all n locations
actaatgttgtaatgcatgccttgccggcatcatcacacaaatggaatacgtaggcatgcaattgaggacctaattaacattgaccaaatcgcaatacatcaatccaatatatatgcattaattaactactccgtactagtttactatactcgctgcgtcttggctacatattggtgccaaaacacctgccaaattgcaaaactttacacgagaccaacccagcgacgagtggaacagaagctaagagcagattgaatagcacactctataaacatatttcgaggagataagagaggagagagaagagcagtgggctacagatttatagtcagctgcaacacggactccaagatacatgtgtgtatgataggtggatccaggtattaataatgtagtatatatatgtttatatgtaactattatatgaattagctattaaattgactaaagataatttagagctaatagctggctatactattaaacttgttctaagcacgaatgcagcttgtgcacgactgcacgcaggtaatgcccacttattaatttgaatattctgataagcaaatgataaggttttataatttcgttacacacaaatctatcggagaaaagaaatgacatttgaacaatttttgacaaaaatttgaattttcagcgaaacggtttcgtaacgatggtctgttcggttgaattaatagtttcgtgctgatggtctaaatttttgaaaatttcaaatcgaatttttttaaaaaaattatgtagcaattatctcatatatggggagctgaaaattctttttaaaagttgcagctgctaccaagctgcaaaacagagccctaagagcaagtttaatagtatagcccactgctagctctaatttatttgtagccaatctaatagtcaattcattcatataatagttgcttactatacaattaatatatggtcacacctgtcatacacacattgtatcttggagtccgtgctgcagctggctatagatctgtagcccgctgctcttctttctcattttttatctcactaaaatatgtttgcaggtgactaatagtctgctattgtacctgctctaagggagcggcaatatggtacaagcaccccggtgaacgaaaaacctaacatatgcatttgccatgattgatggagtgtcgtgcatgtacttttttttatccaaattaagtgtacgatatatcaatgtatatattgatcgcttttgcctacgttagatgcgccctagattcgtcaccatccataaagccaatggtgccctttttcgtcacttagaaatttgcctattattttttttaaaggaggacaaaagctttgccacatatattaatagagaaggaaaaaattatacaaagtatgtacatggctagtcggagaagaccggcccgcaagagagaagttcgttaggtgatatcttccaaaattccgaacttctgcagcctagccgttccggctttgactcaagctttgccttcctttttgacctttgcaagaattgaggccggtgttgaggctgtacttcgaaagatccttgcattacgctccccccagatctcccaggtgactagcatcagtagcgttcgcagaggggctcttggggtgctgggggattcgacgacaaggttccaccaatgttcaatcgaggggcagtcattccatttgtccatttggaggtcagtatgtgtccatctttggatttctgcccaaatcctcttagtgactctacatttggccagaaggtgaaccgctgattcgtcgattgtgcggcagagggggcaaaccttttgatttcgctagcctcaattccccaatctgtcagccgtccatagcctattctgggtagcaagccaagagaagaatttgcatttcggcggcacccacgctttccaaatcgattggtagaaaacggatcttgctgctcccatgaactgcagagatgaaatatggatacttcagtcattaagacccacacgtcagtgagacataacacgtaccactttaacacctaaacttaaacatcacaagacccttaagaaaaaaaacttattcatcacaagcaattaacccttcaattaatttttcagaagagaaaaaaatgaatccaaaagacctggatgatgaagggtaaaaccgccattgacgtattgaccactacatgatccaaatgaagcctatgttagctagtgcatgttaagggcatgtgggcatgtttatattgtagccaaaataaactttaccaaattttggcaatgtcaaaattttggcaatttggcaatatggccaagttttgttaggatttattatgtatttaccagagtttcataaaaaaactaaatgggtgcacatatttgataaatttaccaaaatttggtaaggtttatttcgactacaatctgaccaagccttaagtgaccacgtagttttagtgtaagtacaacaaagtgatataaacatattgtaagagtttttatatcaaatttatgtcaagttaaaaagaaaaaagtagctacaacagatttacaactagctgcagtataagctccaatcaactttttatgaaaatgagttgtactatagagaaagtattatatacctaaggagacatcccctcgtatattaaaaactatccaaatggtcatagaaagttctttaaaaaaataacaatattcaaacaacatatttatgccacatcacaaaatcttaactctaaaatcaactcacgtatcgagatataaagaacaaatctatgaactgtattttgcactcaaatttatctctttatttttctcaatgtctaggcgattaatttttttaagtaatagatgtcactatacttataacattattaaaataatttaaatttttctaataatcatttttctctaatcaacattggatttaagtgataaaggatctgtttagattggtgccattttaaaccataccgttgtttggtaaaattaacaaatatatggttgcatttagtttgttaccaaatattggtaatgcatagaaaattttggcacaacatatttattccaacatatcaaaatttggcaattctatcaatttgtcaaaaatttggtattgtcaaattttggtaaggttattttcggaactaatctgaacatgccgaaaggtttagggtgaatacccaacgtgatccttgaactttcgcttaaggatcaatttagtccctgacatttcgtgttgtccaaataagtaccttaagttcattgtgtgattcaatatggtccttagaccctctaaacatgccatgtgtacatgccacatcatctatgcatgcaaattcaatatttaaatatcctttacacccttatgttttcatatgaaataaagaaaaactattgagaaaacacacaaaaaaaagcttttgaccattggcaaaaatgtgtagtaggggtgaaaacggttcggaatttttccggattccggacctgttttcggaaacggaatcagccggtcgaaattttttcggaatttctcggaaacggaaatattttttcggaaacggaatcgaatatgataatagcagtttccgtcggaactcggaatcggtcggaaaaaattccggaaagtttgtcggaatttccgaagttaaaaaggcccatccaaatagtccataattcctccagcccaacccaagtccctactaaccgaggagacaggctaaccctaggatagaggcggcgcatccaggaggttgagtcgagcacgccaccgctggccgccgtctcgtcgcccttcctctctcgctcattttcgccgccgccaccaccgacgatgacgccgacgacgccggccactggccacaccgccgacgccggccacaacaccacactgccgacgccggccacagccacacgaccgacgacgccggccactagccacaccgccgacgccgccgacgcctcgccttgcaggcagcagcagccagtagcccagtggcagcaggtgttcctgcttctgcttatattatgttctgttaattttgtagaagagaactgtattattaatatgttctattgccattcaccaagcactccaataaagacagactgctagtatgtccagctaaagacagacggtgttcttgagcctaaaccgttgatttgatttcttttatcgtacagatttgtgatttgaactttgttttgtgatgactgatgaactatgtactaatggagtgatgtgttatgagattgaactaagtactgaaatattgatgaaattatatgaagttatagaagactatattttgctgtgaagctcagtttgagtggtttctgtattccgataaattttcgttactgtatccgcaccggttcattttcgctccattttcggtttcgataatattcgtttccgttttcgtttccggggtttccgatttcgattccgattccgaaaaaaatatgaaaacgaaaacgataaaggttgtttccgtccgtttccgtaccgttttcacccctactgtgtagcattgatagataaaaaaattaatattttttgttttatgattgcttcttcttgtttttcttttctttatttgatagaaaattgaaggttaaaatggacatttaaatgcacgaatgacgtggcatgttcatgtggcgttttaagtggtctaaggactatattaagccgcatgataatctttagggtcatgtttagacattataaaatatgaaggactaatttaacctctgagcaaaaagttaaagtactgaactgactattcacccaaaggtttacgagggaatacttctcgaggatcagtggtggattaactgaagatgagatgctctacgtcaggtcaacatcggtctttgcttgtagcatcgttcattccacgctggtagtggtactatcttaagctagaaggccggccatctcgtggtagagacgtggacgcctctgcccttgtgtgcccctcagttgtaatccaccacgtctggctccgtttcagcctcccgttgccctatctatctagttatgtaagctagagctggactttgcttgtactccctccgtctcctaatacgagggattttgacattttttgcgtataccatttgaccactcatcttatttaaaaagtttgtgtaaatataaaaaacgaaaagttgtgcttaaagtactttgggtaataaagtaagtcacaaataaaataaataaaaattccaaaatattttgaataagataaatgatcaaacagtggaagcaaaatgtcaaaatctcttatattaaaagacggagggagtagcatatactatttcctgtctgtctccactgaaatttcgtgagatttcagttttcaaaatggggcctagccatgcacgttcgttggcttcttgcaagcactggatgatgttgtccttgtccctgagatgctgaattctaaactaatcacgcattgcttatcttattactacctccatcacaaaatgtttgacgccattgactttttaaaaaatgtttgaccgttcgtcttattcaaaaaatttaagtaattgttaattctttttctatcatttgatttattgttaaatatatttttatgtatacatatagttttacatatatcacaaaagtttttaaataaaacgaacggtcaaacatgtttaaaaaaattaacgttgtcaaacatttaggaaagaagggagtaattctcaagcgtcaagcgtgcacgctgagcttcgttatggcgttgaagattgctgcacagtagcagcagacagagaccttggtcaatcacactacagtccctgtctttacagctagcttgtggcctctggcactcatcagtgaggattgatcaatcaatcagagccttccctttctttttggcttttctttcctcatgcgttagacagcggtaaaggttcatctctgtagattctctacctgactatccgttacttcctccattttatattataagactttctagcattgttcatatttatatatatgttaatgaatctagccttatgatttgctgaactgtgaaggaaatcacttaagctcgtctccccagctcgtctcttcagctcccagatctgcacctgccgccgccagagctgaccggcggctaggacagcggcagcggcgggaggggggggcagaggatggtggaggatggcggcggtccgacagcaggaaggcgggtcggcaccggcagccctagaggctacggcggcggtggttcccgtcggtgccggcagccctagaggctgcggcggaggatgacggcggccctaggggatgcggcggtggctcccgtcggcggccctagaggctgcggcggcggctcccgtcggcggcctagaggttgcggcggcggctctcgttggcgctggcagccctaggggctgcgatggaggacaaaggcggcttccgacggtgccggcggcactaggggctatggcggcggctcccgtcggcgctggcggccctaggggctgcggcagctcgagacagtggcagtctgtgcactttgacggtggatgcctaggattcgggtgaagtgtaagtcaatcccgtaggttcgatcgtgtttggttggctagttccgactatacggcgaatgacgacggttgagagtggggccaacaagcggcgcgtgacgtcaactctcctgaaactgatgaagatggcacaaatggaggtttgcatcgacggcgcactaggggcggcggcgaccggtagacttccactcgtcaaatctaggcagagaagcaggatgtgtcgaggtcgtttggttttcttttcctttttggttctgttctcctctttgttgaggtgtgagtctaagtactcatatccttttggctgtgtatatccttcatggatatagagggccggattaataaaaatctattatctaaaaaaatgttaatgaatctagacatactatatacctagattcattaatatctatatgaatgtggacaatgctaaaaagttttatagcctgaaagggatgtagtaaataatttccaatggaatggtaaaaggaagccatccgaatgttataagattattaagagaaaaaagatacaataaacacaatggaaggttgttgaggttggttgtgcaatacagtgtacatccacgaaccgagtcaaccacacaagcacaaacccctaaaagggaaatatagcaccgaatcgaccgccgctatgtgtggtcgatcactgttggatctataacaataccatagatcaaagtctctaaatacgttgtcttgtaaaagttacaacgttaacgctgtcgttgtcgcccatctaaggaactggacgtagttttcatatagagtttctcgccaaaagagggagagaaaggtacatgtgaaaatcactgtagaatctaacctgagaaggtgacaaaaggtagattctgcttgttcaggaactgacgcacaatccggtagtttggtgctcttcttttgcagcctctgttccagtgttccgggcaggcagcagtacagcacaaacacaaacacgtttggataattgcagaaatgattcagggtttcctgcagaatcatgtcagttaggtgacacacaaacggctcgtcgttctctgtcaccgggggaccttgtgcagtgccgcagttgcgtcttgtgtgcatctctgaatattcattcagtcatcggaaggaagattcagacagaaaatgcagggctcacagcagatagcagcggatagcctgcccctgcctgctctgtgccaagaaagccacaggctagctactctcttcgccgctaaatgtaattatttccagcttatttagtagtaaagtttaatataaaagaaaaagatttcctttcagagtcatcaaatagtcaaaatcttaaatttcgaattacttagattccttctctaaacacctgattagtcaaaaatatttttgattcccatgcagtgaaaataacgttgtcccatagaaatactttatatcgtgtacaaaattttaatcctaaacactttttattttacaagggagtagtacgtagcaaagacagagaaacgcctagaaatcttccggctagcttcacaaaggtgatggcttatctggtataggtgaagtctcactcattaaatttatttgatattagatcattccctaatattcgccttccttttatgtatgtctagatttattaacatcaatataaatgtgagaaatgctagaatgatttacattatgaaacggaggaagtagcaatgatcaaccgtcagtgttagagcagccggccatgcaattaccgtgtgttgtgttgcgcccgagcgaacgatacggtggtggagtggaggacgtacgccgatgcaggatggaccagcattttcaagcgcaaacggcgacagccattggcattcgataaattcgatcgtggctaaccacactagagcaatagctgtggatatatctatataacattaacaggataggagatacgcgtgcgttccctccactcgcgcgggctgagcttagcttagctccccactcactcgccacttgctgcaattgcaatggctgctgctgctgctcgatgcgccggccatggcggcggcggcggcggcggcggtttcttactccggcgacggctgctcgccaccgcggcgttcctggcggcgtttgggctctgcactgctgctgctgatgacgctgccacggggagaggacaagggcatgatcatgtgatgctgagcgtggaggacatgttccctgactcgtcgtcgtcgtcgccgtcgtgcgacgcgccgccgcgaggtttgattcgttttgctcgccatggcatggcatggccacttcttgatcgagctctttccaagtctctgtctgtcatgtcagaatctcagtgtgagtgtgaggtgtgtctgctgctgttgcatttgcatatatcatgcattcattcatgcatggatagatgcttcagattgctctctgcatcagtgcttctttttctttttcttttcttggtttggtttggtttggttaatttgtttgcttattcaattgatctatcacccgtttgtttctggacttcaggtttctctggtttcagagctgcttttgtggttgttttgttgtgctttgaatttatatatacttacatacgagactggaaataattttgctgattccagtggattcacttacagctttgatattgcaaatgcttccaagtaagactctctctaaacaaaactaaataactgtagtaaatgtttctaaaataaaataaaaactaaatagatgtatgtaagactttgtgtcgttatctgctcaagtttttgtcttgtttgtccgttatcagaatactgtatcttccctgttttgtatggtacagtacacaacaagcgtaaggaaactgccatgaatttaaattgatggccacagtacacagggccatatacttgacagtgattttattacaaaaaaaaacaaatcacttttaaagattttgagtcggaattttttttggaagaccgaaagtatgacaaaaatggagctttggctctcacaggaaccccaaacatttgatactcgtaaaaaaaagggttaaatttgcattttaaaatatgttaggtgttaaaacaataacccttttttttaagtgcgagaaggacacacactcaaagcttgtgtgtcctaaaaacgctccaaaacataagaccttgcaaaacatggcacacacgtctgattttttccaccaaacaagcacacttgtatataaattttggtagataggcagatttacataaatctaaggatcggatatgtgcgtgaggaataagatgaaggcaatgatgtttctagagcataaatcaattaacaacgatggcacgttagtgaataaatgagtaacggttttgctagctatttgtggattatctaaacgtggtcaaaatacaaaattgtagctttcaaataactttattaacttttagcttgctctcttgggtttagctagctatatgcatgtgtttttatgttgctattgattatagggaaaattgcaaaaaccatctcataagtcaattgaagtttgacattttacccaataaatcactttgttgcaaatacttactcatctatttgttgcaaaaccacatgttttcataaagtgtgagccgtcaatgtattctttaccaaaattaaatattttcatagtatagtcttgacactttttttttgagattccacaaatagaattgctgatgagagcttaaatgttgatgcattgagtttctctatatgaacaaaaaaaagttcaatcaaacatgaaaaataagtgtaatgcaagcacttggagaagattgatttcgctaacttagcatgtggtgactctacatcagcgataatgggccaatttggttaagcacgtgcgcactgggtggtttttgcaataaaactgagtaggtgatgggtattagcaataaaataacttatgggatgaaatgttaaaattcaagtgacttatggggtggtttttgtaattttccctatagtctctttgttttactagcgaaccaaccgttcgttgttacaggaattagaaaaatcgcattggcatattacaaggaagaaatctattttttaattttagaattaaatttgagttttatttatctttttgtgttttagccataaaaatatttctagcggactacgttgacttcctgtcactaaataaatgctcctcccttcaaaacgttgcatcatagataatctatgaattctaccatatatgcgttttgtttgaggaggggcactgatttcacatatgttttggaggttaatggtgggtggtgaaagatgcaccaccgctcccttttataagaatatagatactggtaagtggtaaagaagttgaccattttttttgttagttaatttcaagcattatatgtttcaccctaataaaaagaggtacgtagtaaatatgtgagttgttttgtgttgacacttgatacaatatttcaaccaaaaagaaaggtgattgacaaataagttacccactcagtgaatagatgcatggtccaacaaatgtctagtttatatgagaggaacgtattttcaacgaagaaatccgggtctatcatattcctgatgaaaaatatgtaatactctgtccgtccctaaatataagggattttgaacggatgcgatatttcctagttatatgaatttagacaaggaatatattcaaattcgtattactaagaaatgtctcatctgcctaaaatctcttatattttgcgatggagggagtagttcactactgcacaaataaacaattataacctccctaaaaaaaaccctctcgtgctttggttgggccaagtgtactttttttttcatttatgctgcattattgttcagacacaactgaatgtactagaaaaatataaagagtaaaatccatcaccggtccctaaacttgtaccgttgtgtcatcccggttcctaaactcgcaaatcgaccgttcaggttctcaaacttgtttgactgtgttatcccggtccctaaacttgcatatcactcatttagatcctccaacttattcagttgtgtcaccccggtccctaaacttggatttgaatatcatctgggtcaaataggacggtttaaagactttatatttaaaaataattcataactttttcatgtgaactataatgaagacaaactttatatgaaacttgtagccctcgacgcgatctacaattttgttgttgaatttttttattttaagtcattttttcccaaaatgtaattttaaaattaaaatttcaaaatctataaacatgcaacaatattttgggaccctaaaaagttttaattcaaaaacttttcaactacaaagttctaggtcgcgtcgagggctacaattttgatataaaatttgtcttcattagagttcacatgaaaaagttatgaattattttttaatataaagtttttagaccgtcctatttagggaccgggatgacacaactgaacaagttagaggacctaaacgagtgatctgcaagtttagggaccgggatgacacagtcgaacaagtttgagaacctgaatagtcgatttgcgagtttagggaccgggatgacacagtggtacaagtttagagaccggtgatgaactttactctaagtaaaatatagacataaagtgatagaaaaaattctgaatttcattttctgaaataattccgattgatccaagctgaacatctccctggaaattcagatcacagacatgacgccacgtcatcaaccactaggatgacgatcgtccaccggcacggcccgtgctcgccgctagccgccgcgcacggcgagccgccgtcccacggcgagatcctcgccgccgaccagagccgcgccgagtcgatccaacaccgggtgtccaccaccaccaccggccgggtgaatccaaagcgcagacgccaccggcagcagcagccgccgtcggcgccggcgccggcggcgtcgctgtcgtcgtccaccgcgtcgctcccggcgtcgccggggcgcgcgctgggcacaggcaactacgtggtgaccgtgggcctcggcacgccggcgtcgcggtacacggtggtgttcgacaccggcagcgacacgacgtgggtgcagtgccagccgtgcgtggtggcgtgctacgagcagcgggagaagctgttcgacccggcgagctcgtccacctacgccaacgtctcctgcgccgcgccggcctgctccgacctcgacgtcagcggctgctccggcggccactgcctctacggcgtccagtacggcgacggctcgtactccattggcttcttcgccatggacaccctcaccctctcctcctacgacgccgtcaaggggttccggttcggctgcggcgagaggaacgacggcttgttcggcgaggcggcggggctcctcggcctcggccgcggcaagacgtcgctgccggtgcagacgtacggcaagtacggcggcgtgttcgcgcactgcctcccggcgaggtcgaccggcacggggtacctcgacttcggcgcgggctcgccgccggcgacgacgacgacgccgatgctgacgggcaacgggccgacgttctactacgtcggcatgacgggcatccgcgtcggcgggcggctgctgcccatcgcgccgtcggtgttcgccgccgccggcacgatcgtcgactccggcacggtgatcacgcgcctcccgccggcggcgtactcgtcgctccgctccgcgttcgccgccgccatggcggcgcgcgggtacaggaaggcggcggcggtgtcgctgctggacacgtgctacgacttcaccgggatgagccaggtggcgatcccgacggtgtcgctgctgttccagggcggcgcggcgctggacgtcgacgcgtcggggatcatgtacacggtgagcgcgtcgcaggtgtgcctcgcgttcgccggcaacgaggacggcggcgacgtcggcatcgtcgggaacacgcagctcaagacgttcggcgtcgcctacgacatcgggaagaaggtggtcggcttctcccccggagcttgctgatgaaatgtgccacgcgtcacccccagcaaacgtacacgtcagcacgcagaatgaattaactgtctgcactctgcagtgtaatgctgcaatccaccaggtggtcagcgactggttttattaccatgatttctgaagatatataatcatatgattacaaatatgctaatattattttctcttcttacatttatgatttgcttgaaagaagggaaaagcgaagattgatagaaaaaaaatatgtaaaacaaaatgagctattggcgcatgattaattgagtattaattattttaaatttaaaaaatagattaatatgatttttaaagtagcttttgtatatatatatttttaataaaaacgcaccgtttaggacgggggagtttttctccgaatccactgctgtagaacacaaacttgtggtccgatgatttctggcaagcccaaaaaaatcattagacgttttatgtaaccatctatactatgaataaatttgatcgggttaattggatcatgccattaaaatatactggttttgaaatatgatattagtattcgcatatctgaaaccataccattataattttccacatatttgagatataccactacttacccattggatgcatttttttttaaaaaaataaggaccaaactatccctttttccccttagtccttctcccttcttccatggcgtgacctgaccaccggcctcctcctgcacgtcatctccctccacctcggcccgccgctggcctcctcttgcatgccagcgtgtcccagatccagctgcctttcctcgctccgagctcccgcggtggacatcgccggcgacaggatttaggaatcaatggcggtggtggtcgctgagatcaatggcagtggtggcgccgccgttgcgtgagcagcacgacgacaacacaacgatctccctaacgttgaccgctgcccggagcctactctgtaggtcgccgtgcttggcaacgttggcgagcagcgccaccgacgcggtcgaggagccgatggcctcctcgtcgagcggcatgacaagcacccgtgccgccaggacgtcgtcgagcaagaccgacgacgctgacgaatcagcctgccacagcgaactacacgatcgccgtggcgagtgcgcgcgccacgccggccgacgcgaggcaccgccgatcctggttggactcccgcgcgaggcgcccgacctcgcacaccaccgcaccgcgcctcgccgcgtcacttgcccatgcagcggaccttggccaacacacgtcggtggcactgctgtagggaagagagaggtagaagatgagggtattttcgtctgatacatgcaaaatacgtatcttagtggcaccattgagattacatacaagtagcagtatcatcgttataaatacgtaaatagtattggtacatttcaaaaccggcaaatttttaatggcacgtatctaattaacccaatttgatatggtacaaaacattgattcttggttactggtacatattcatgttcttttattatttttcaacctatcaatatttgaacaatagagattcaatatgactataaaattatcattttttgtggtttcaacctaatgttcgacctgaattgattttatcagtaagaaactctccatctatcttaaaaaagaatccattcctaaatatgaatctaggtgccagtctatatttatttttttggattggacttttctaaagcaggagtaattcagttcatataaacaccgggtgcggtgatgagcgacgagcgacgagcgtggcggccagtgtgagaagggggcacggcggcggcgggaagaggcgatggcggcaagtccaaaggccggaggcggtgacgacagcgggaagaggcgatagcggcgagcccgcaggccagaggcgaggaggcggcagcgggagagggcgccggatctggatgggacggatccggtgaggcggtagggggttccgtcgtcatcgtcgtcgaccggcgagtgaaacaggagatagggtggtggccggcaaatgaggaggtgaggcggtggcccggagacttggcgatggccggcgaacaaggaggcgaggcggtggcctgaagacgaggcaacggtcggcgagcgaggaggccagcccggaggcggcggccggcgagaagagcgcgaatgacctttttttttatttttttcatttttctcctttcccccttctatttctttgtgatttcttatatttcctttaagattcttttgtttgtagtaattgatattttggtggttttgatgaatttgaagggggtatactcgtcgccttaaatgtaggggtgattgtatccactcatttatcctactcttcctaaccaaaaaaaatggatcactaaatccaccttcatccctacaaccaaataaaaataattggatcgccatattcactccaccaaacaaaaaactggatcgccatattcagtaaaatatggaccgccgtatcccatccaactttgactgtgaaccaaacgcaccctaaaacaaccaatctggatggtcctatgacatttaggttggatcttttttattgagggagtggttgggactagagctgtcaaaaaagcttgaggctcgactcatcctaggctcgattcaaactcggctcgacctccaaacgagccgagcccgagcctagctcgagcttccaacgagcctagtaatatattatttttattgttattcaataatttaggatatcaaatatattatttacatgcattgtattaacatcatatatttattttattctttttcctcttctattaatatgatgaactaggaacaatctcggtagtcaagcttgagcttcatctagctcaaaccaaatctatctgaaagctcgaacattttatgggctcgagtttcgagctcgctcattgacagccctagttagagcaagtttaataatataaccaactattgtttctaaatcatccatagtcaatttagtagccaattcatacacatatgtatcttggagtctgtgctccagctacagcaaatctgtagccaactactcttctgtctcctcttttatcttcttgctggtttatagtccgatattgtagtcatcttaggacgggaggtttttgtaaatcctatcttacaataaatttatcccccactaactccttaaacttaacatgcaaagatgccacatcatcattgacggagcgtggggctcctcaccgggagaccgagcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaaccccactcgccccctctctcctttttttttttggtgggcaaggtcctccttttatatctcaaggggatactacatgcaccacttctacctacttttcttctgggtggggacctactctatcttgaccaaaacttggcttgcaccttcgcctggaagctaaatcacaacttgtccttgagtgaggctcagcgccgtctctcgcctgacaccggggatctccctgttactccctcattaatgggcgaagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccacaacgtgtcagttcagcatgctacacgtctgcccttcttcatacaatgacttccttgcaatggttgcgatgaagcctggaatgtatctggccggggctgacgtgccaactccaggagttcccacgccggctccggctagggacgagtgcctggaggccctcatcattcagacgggacggggcgaggcgtgtgtcaggccgcctgttgccacctaacccgcgatctgaccggtctgtgaccggtcacacactgtgacctgtcacggaccgaacgagtgtgctgcactgcattaaatgcggcgtggggcgctcgtccaacccgcaataaacgcggttaggtgagcgccgctgtgctcacctaacccacacacgtggcgccaaacccacagggggccggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagataccctcggtcccatgtcaccgacaatcatccactaacaagatgccacatcatcatccactaattaataagatgccacatcatcatccactaattaacaagatgccacatcatcatccactaacaataatcacatttaaacatcatgcaaacatgctatatctttatagtttttataatttaagagcttttcaaatacaatcatgttaaattattatccaacataattcacataatgttttaatgtatatctttattatattttatgatatcctatctacttatatagcttatcctcacttagttagtgcttaaatgattaatctatggtccaaattatatttctcattttttcctctaattaagtcatatcacatcaattgtttttagcctttagatgattaatctacggtccaaactatctccctacttttcttcttccgtaaattcataccaccttacattttacgtttgaatcaccattctacatactatttaaatttaaattatcataaatcatattaatttacttaatctgatattatctagctattttacatgttattttttcattgttatcgtactaaatttccgaaacagggtttaacttagttccaagaaaaatggaagcctagcaagcggccactgtttcctcagttgtcaccagacgtctgactcttatgagttctgacacagcgagaccgggacgcatagccctctctcactgaaagtgggcccggataggggacagctctccagaacccaagtgcactgcaacccctgcaaagaccctagtactagtactactctactaccgagtaccgacaaacatacgctccgtaggaatgccaccggaagtactcctacgccctaactttacgtataccgtatcttgtcagagaaaaaaacggacggcccagatgcactgcacgcgccacaccggtcccaaaccttcccaacgcgcgcggcgcatcggacggccaggattcgccgcggatggaccaccgtccgatcttactccccaccctgtcgctgtgtgcctctctctctctctctcccgtgtctctcgccgcggcgtcctccggccaccaccccgcgccgcgccgccgtctacggatccccgctcctcgctcgagcgagcacgaaagccctagcgcgccgccccctgcaccgggtgggttccccaggtgagcactccattcgcgccgcggcgccctctctctctctcgttttgttcccacggatttctgcgggggatctcgttcttgggtggaaatgggaggagggggttggggttctagttcgtttcaaggtggttgttgacttgtggtggcgaattgggtgggttttgggagggttttgtgtaggattggggggggggtgaggtgaggttaggttggtggcgattcttgatttgttcttgcgcggcggcgatcgggctgggttgcgtctgtcctctcctaggttttttttttctctttttcgctcgtgtagttggattctttggtgggttcttagcggaagtttactgttttttgacggagcggtccgcaggaatgggggccaatgttttgattttggggtatctctgcacgccctaaaaacaaaagagatttgaagggagagacttccctccaaacatttttttaagaagaaattgtgagcgttgttggggattgaacacatctttgtagcgagatgtcggcttttatgttgaaagtctgaatggtacatttttttgtatgagcatacatggtttattgtggggaagtataagtgtgtttctagtatatgtttcttttttatttcaccattctgatttaggtggtatggtggatggatttttttgctacccttatagggtcttaaatgactattccgtagaagaaagttaagttttttttttccatatacttttgtttgtctctttatttaggttttttttttggggggtgggggggggctctactagggagtttagttcatataactgttggtgcactagttcctcatttatgaaggaactgctgaatttcatcctttcaggtgtgggcacctatatgtgcgttatattttactttatcgcaatttatttatcaaccagcattgactttgattcagagatcatgtcggctttgcaggtttacttgtttttatttttaaaaataatccaagggttttcagaatataaataattgaatacggtcaaatgtgcagctaactaattatcatgaaatgccatcaatatgtttaaagacttacatagttacgtttagcaggttgttgagctagaatgggagtggcagggcacaatgatcctttgataggtgaaacgacatgtggatctttgctgcagcaacttcaggtgcctttgtctcttccaatgttcttttgtatgtgtgctttataatgactggaactaaggatagcagcaagccattttagttccctatctacaccatagcatctgtgcaacgaaaagttatatgagtagtgcataggattggacaagtgactgactagtgtcatttcagttgatatgggatgaggttggtgaaagcgatgaagaccgtgacaagatgttacttcagctagaacaagaatgcttggatgtttacaggagaaaggttgatcaggcatctaattccagggcacgcctccttcaacagcttgctaacgccaagtctgagctttctagactcctttgtgcactaggcgagctgtctatttctggcattgtaagtatcttgataaatattttcatgaatataattccttattttccccaaaagtacacacacacctacaatatgctgcatctggctcattactgctgacttttgcagcctgacaagacaaccggtactatcaaggagcaactagaagcaatatcacctttcttggagaaactctgcagggaaaaagataagagggttagagagtttgctggtgtacaacttcaaattcaaactatacgtggtgaaatcgctgggagtctgcaagttggtgaccacatggaaacaccccgtgttaatgaggatgatctttcaacgaagaaattaaatgaatttctttctgaattgcaagctctacaaaaggaaaaggttggcactttgtttttcattttcacaatctgccaactgcctttttctggacctgcttatggaataatcttccaaatttcatagcccaaccatgctaaagagattctttgttttgcataataaataataatttcacataatatctgctggtcaaattctcttgataagcattgtataacatcaaacatccctatgatggatgatctctaaattttgacgtaccatattagtaccacagaagcaggcatacggccactgatatagctgatgataatctttgcattatacacacattttcgactatttaaaatttattgacttgaaatcgtatttctttccattttcttgcattgcagagcaatagactgcacaagattcttgacttcgtgagttcagtgcatgatctctgttctgtccttgggatggatttcctgagcactgttactgaagttcatcctagtctcaatgactcggttggtgccgagttcaagagcattagtgacgcaacattatccaagctgtctaagatggtaattcaacttaaagaagagaaatcaaagagacttgaaagggtaattctacaacgagcctcttgttcttactcatccaaccctttttgtatctctgtaacatagtacatcctggatattatttatgattaaatgctatgtttctcagattcaagctctagcttcccagctaactgatctttggaacctaatggacacctctgctgatgagcgacaactttttgaccatgtcacatgcaacatttcctcaacattggatgaagtaacagcaccaggagctcttgatattgatttgatcgaacaggttaggagattttcttctcaaagtgctcctaggaaaatagcataatattttgtctgacatgttttgcgctccaaaggctgaacttgaagttgaaaggctggatcagctcaaagctagtaggatgaaggatattgcgttcaaaaggcagactgaacttgaagatatatatgcccaggctcacattacgatagataccagtgctgcaagagatagaatactgactgttattgattctagtatcttcgagccttcggaactactggctgatatggagaaccagatacttaaagcaaaagaagaggcactaagcagaaaggacattctggagaaggttgaaaggtggatgtcagcatgcgaagaagagagctggcttgaagactatagccaggtaataaaaagtatacagtatgtaacttcttcattgtttgatctcattaacagtcatacatctttacattgatattctgataaatggcaggacgacaacagatacagtgcaaccagaggtgcacatctgaacctcaagcgggcagaaaaggctcgtcttttggtcagtaaaattccaggtatatcctgaatgtttacttggttttgtttcccttgtgattatactacattacatattctaaaagtagcttccactgcctgccttagacctatgctacatctggcataatatgacatggaaaattaattctattcctaatctgacttttgggttcatctgtgactgttacgagtgtagtcattgttgatacactgatggcaaagacccgggcatgggaacaagagcatggtatgccgttcagctatgacggtgttcatcttctcgcaatgctggatgagtacaaagtactaaggcagcagaaggaagaagagaagcgacgaatgagggtacccttctgtccaatccccattaatctttcgcatgtctggctctaaaaccatatctcattccatttgctttcttccaaaactcatttcaggaccagaagaagataaacgaccagctagctgcagagcaggagaagctcttcggctcgaaaccgagcccagcccggccccaatcctcaaggaaggcgcctggcccgcgggccaacggtggcgcagtcaatggcacaccgaaccggaggctctcggcccaccagaacggcggcggcaggtcggtgagccgggacgggcggagggacagtggccggccggctgctccggtgaactacgtcgccatctgcaaggaagagtccagcaacaacaacccggcggcgtcctccccctgacgatcatcctcgccatgattgaccgtacatttcttggtgccagtggtagagagatactccatatctgtgcagtagcaggaaaaaaagaaaaactatagcaagatactagtaggacaagtgattcgaatgatagtagcagtattttggctgtatttgaatcgatttgttgctgtccatttgctggtagtggatcgaatggatcgagtgggtgcagccgtgcaggtgcatccgccatggaagctgagctcatgtcgtcgtgtcccgttggagtttctttcgcctgtcactgtcggttgttgggcttgagcttggcgggacggcgaaaaacgcaatccgtcagttacagtggttatcgcttgaatttcgtcgaatcctatcaaagtttaccgagctgttatcggcagttttgcggttactgggctatcagctgttaggctatgaatttaaatttgaaaatttcatgccagtaatccaaaatttcaagttttggatgatgtatatcaattccgtacattatttaagcactaataacaacttggagtagattacaacgcgacatacatgcaacagcagcgaaacattcgtcagtctttcagacttccgcactcaatcaccaatcacttcatcggtttaggaggtggtttctcgttttggatggataatcaactaaaacaaagcaatcaaaagaagaaaaaaaaggggccaaatttcatagcaatttgattacacaacacagcacagcaattcggtggaggctccacgcaaattgaagaagcatatgtacatcatcgatctgctccttccccggtcagcttttgtctcagtaatccgtcggtggttggttgccgtcgtaggcctccgccgcggcttcttccctctcctgctcctgatctcgccggtgcaccttcttgctcaccttgatccagattgcaaaatgttatagcatcggtgagtggaggagagatttttgcaaagattttgattcttggttgtaaaatgtttcatcagtggagggatttgcaaggattgattgattgatttaccttgtgtgatcttgcgtggaggcggtggtcggaggaagccaccttccggcgaggcaggctccggccgccgcccctgaggcggctcttgctgccgggcttgtagcagctgaggctgccgctggagccgtcgaagctgacgacggacacgtcgttggacccgcagctctccttctcctcgccggcgccggcgccgaggtcgtgccgccgccgcaccacgatcacccgccgccctccggccgccgccgccgtcgagccagcgtccgccgcgttcttgctcatgcagtcgtcggccgacgcctccgacgacgcctgccgcgtcgccatccaccgctccagccagctccaccccacgttgtactccgcctggtccgaccgcgccgcccgcttcttcgtcgtcccgccgccgccgccgccgcagctccgcagctgctgcgagaacgcgtaggccagcgcgcgctcccgccgcgtcgtcgcctcgatcctgctctgcatccgcatcctcgacacgttcgagctcaccgtgctgtcgtcccactcctcctgccacgcacgcatcatcatcagttcatcacatccaaaatctcgcgacacaactcgccgatcacatcactgttccatcatcggttgcagagatttgatcgagatcgaagtctacattgcattgcggacatgttcttgcatggtctgtatataccttcactctgaacgcctgtggccgcgaccgctggctgctccggtgctgcgccgacgtcgccgcggcggcggcgctgtcgtcgctgaggcggaggttgctcagcgactcgccgacctggacctccaccgacgccgcgatggacgccgtagtagggctcctcggctcgtcggtggtgcagcagccgttttctgagcatttgagcttctgcaactgcctcctcgcctgcaacaccagtggatctgcatgatcgatcttttttttctaacctccaatttttgaatttggatcaagaacgcaccatgaatcccctgaacacggattggatcatcgtcgccgcttcgacttggctgtcggtggccggctcggccgccgtcggaggcgcgatgtctttgatggggatgctcatgctcccatgttcttcagggtggccgccggcgtcggcgacgccatccacgccattcgccggtcgagcaaccgtcagcgccgccgcctgcggttcctgcggcattgcgcaggtctcgaagctcttgacggagaccgtcccatcatcgtcgtcgtcgttctcgtcctcggcggccgcgctgatctcgtcgccgcagaggtagagccggagagagctccatctcctcttgtgatcagcagagcccctctcctgcaaaccaaaaatcagaacaatcttcttcactcgattaatcaaactccattttctgttcagattgtttatgtcgcaggcaggcaaaagcatctgcaattgtgaagatccatgaaccgaggtgccacgacaaagtacagaatcgaaagtacattggcctcatcgccggttactgattggtgtaccgagagatcttcactttttctcgtactgaacctgaacccgaacccaacaccgactgcacagttgcactgcaccaccacaaacgtatgccctacacaaaaacagtggacgcaacaccaaaagagcacctacattgtggcaaccacggccgccaccgccggccgacgagcaggggctcttggagaagactcgccggacaatgccgccggcgaggcccatccccaccgtcgccggaacagaagaaaagcctctctcaactatctaggactaggaggcttcacatgtcagtgtagtagaacgacggcgatcttggttggcatcgccatgagccggcggtgctgagctagctgagctctcactccacagtgatggctggcgcgcgcaggcgaggctgcaatggctggcttccccttatagtagcaagggagaggccaacgaccgtgcagtggtggtggtggctaaaatccacaagaccaccagaaccagtttggcttgggttaaaataaaaagaaaggcggtgtgcgagatgcgctttggtgcaagtagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12447 - DNA, 1146 bp, Oryza sativa
catctggtggcatgaacttgaagtgagtcaataataataataataataataataataataataatcaacaaaggtggaaagaaaaatccatgagtaacctttcttttatagagtgtgtttagttcacgccaaaattagaagttcgttgaaaatgaaacgatgtgacaaaaaaattgaaagtttatgtgtgtagaaaagttttaatgtgatgaaaaagttgaaagtttgaagaaaaagtttgtaaataaactcggcctctataagaaatcataagtaaagcaaggatttgacacgtcgaggagcgcacattcgtgcacatcgccaaggtatccccgagaaaatctgaatcgtgacaaaggaaaacgcaaagaaaaagaaagcaaagtcagcgatagcaagacaagcgtcccagcgagaccagcggggtggcgtcatctcattctaagggcctatttgtaaaacttctgccagtggaagattcttctattagttacaactgccactaataaataatttaaaatttcaccaaaattctaagaaattataattataaaatccagaaaataaactaagaactgaaaactaagtttaccagcttctctaaattcttatgagtatctaagagcctgttgggggagcttctagctgctgcaacttcttccagaagtagaagctccccaaaaccgttcagcttttggtccaaattttaagaagctgtagttgtataattcagaaaataatttaaaagccagaagctgaaaaacctattttttaaaatttttaaaaactagttattaaattagttgtttctcagtattttaagctcccaaccagtaccttcgtttcttacaccgcatatcccgtaagttaagtcaccaacgacccaccaccagccgaggtcaacagtcatcctgacacctgggccccacctgccagcgaccccacacctcccccccaacatcgcatcggcacctgccgccggtgcgctgttctcatcaaccgcctcgtcgaaagcaacaacaaaagcctccctctctctctctctctctcttgcggcttcagcgcggccagccgagagggaagaagaatttggtactctttgccctcgatcgaagctaccacccatcccaccttgcccttccttcg

SEQ ID NO: 12448 - DNA, 2588 bp, Oryza sativa
gtgtatgataaggttgaaggaaaggggcttccggttttcttcatggcgcacagggattcgatggatttccttataccttatctttgtttacatgtactctccttgttgatctttgtttccatgtactctccttgttgttttctgcactgttcttgcactgttcatgatggtgaaccctctctgtctgtagttgattgttacgagtatatggtagcgatcagaccgtctcttcttctagtgtaaagaaaagagtaaaattcgtattattctgaatttaatcagactaggtgagttggtactttagtttggttctggcccttcatgctgattgcttgattgtgtcggctgctgctacaacttgcacaatttatattatcatgctgttctgaaccagtttgccaacttgtcccatgcatgagagatgagatgagccacaactatttgttaattttgtttcaggtacaactgttgtttggtgcttgtccagctaggacagccgagtgaagtgccagcatgggtggcatccttggacgccatgacaccatgaagaggagctctcacggctcgaagctcgagacgaagatggtggagtccatgcagcagagagcgtcgcacgggacttcactcaagtcgttcgatagcatcatcatgaagtttccgaaaatcgatgagagcttgaggaaatgcaagatcatcttcgagcaattcggtgagattcgtcatgctgtctgcatgccaatcattgtctaattacctgattatctcctacttttggatctcactgctagtgagattcagtagagatcttctatacaatggtgaaatagtttgaaaggaaaacatagggactgtcggaccgatatattctattttcctgtacacaatgaaatccttaccagaaataaatatgtagtgttgttgttgttgtttcataaggttcttgtcatggactgttgaatttcaataatgatacattatcagcatgagttgtattatataaatggttatgtcgtctttcaaatatttactgatttgtgcaaacaaacagcttctcactcatatatcaaaaacaaccttttttgctcctcagatgaagattccaatggcgaaatagataaacaagaattgaagcattgtttccaaaagttggaaatttcattcacagaggagagataaatgacctctttgaagcttgtgatataaatgaagacatgggcatgaagttcaatgagttcatcgtctttctgtgcctcatttatctgctcaacgaaccagctgtgtcagaagcagtatccttttcttaataagcattgctgcagagcaatgttgggttagcatataggttaggtattgcaaaaatgatacattactatttactgttctattttcttcaatctttcattacgatgtaaatctgattggagtaatgtttattagatggataggatacttagtaactttctgtacctgtatcctattttagatctgtcttaactcatttctgccaggagcttctctgtttccttgacataatgcacagaagattaagatgggattaggaaatcttgaggcaacttttgagaccttggttgatgcatttgtttttttggataagaacaaagatggatatgtcagtaaggaagagatggttcaatcaatgaatgagactgcaacaggggaacgctcttctgggcgtatagccatgaaaagatttggtaagtcgcttgttctccagctctctggtctctgagtttagggcgaaaacaattagttgtatgcccttagatgtacatgttatgaataaattatatttttgtcccacgttttttatttctctatagtaatctaaaaatttctagattgacaattcccatcagtttcagaattaagtcctaacatgtaacactttctttttttgcatggcaccagaggaaatggactgggacaagaatggaatggtgaccttcaaagaatttctgtttgcattcactcgctgggttgggattgacgaaaatgaggacgacaatgaatgaatttcgtgaagataagttgttcaattattaggacctggccagcctaaggaggttataaagtttggtggtaatgacaactggagcatatgatgttgattagttgatcgttgatattgtgtattatcttataggatgattcaacatgatcctagtagaatatcttaacatgcctgaagactccatgtatgcttacaaatttaaagagttccatgacagatagatctgaacttgtacagtaattctaatggttgtacttaccaatatcctggacttgatgtggagaaatgctataattcagttgcatgctcaacgaaaataagatcatatctttatgttcttctcaccttactacatttccagacctacatgaactgtaaagtgatgtgcacactgcacatctctgattgaataagtataagctacaaacatgcactgaacagtagataacaactaacagtcatggctgggtttacagcattacagcctcactaagatcaacagctctactgaagagataactagcaagtcctctaaacatcactgccctgcccctac

SEQ ID NO: 12449 - DNA, 2508 bp, Oryza sativa
ggctttctatcaggagctgtagctgcctttgcacctgtagacatgtttgaaaagagcagtaagttacattctctggaattggaaagagtagcacctgtagacatgttctgcgttatcaaatcttgtttggcactatcagtgtaaacacctgatgactgaaataatgcatagatgaaacaaatctagttacattattttgaagcagtacagttgagaagtcaaacataaacagaagatgtcactgtatagaattgtttttagttacaggaaagagcttatataattttttaacaatatccatgtacgaggttagaagcagcgtgtctgtaagcaatttaataaaactagactatccgatccaatagagaaaacaacacaatgttaaaggacacgtgttatttgacagcattagcagaaatgcagaattgagatgaagtacaaacatgaagtcagacataaagaaggtgcccgaaaggcaacttgcctctaattgttcatgtagccgcttttgcacctccatctgcaactttaaagcctcccctatttccattccccttcatatataagtatgctttgttaagaactcaacatcctactttggctactcgatccttaaacaagatttctgggagtaaagaattgctaagtagtatctgatggatgcatttaaactagacaatgcaaaattgaactttctacttcgaatactacatcaataagtacagatttgttgaacaatattgaatggatgcctggaaacaagataacgaaaaacagaaaaagtgcatattgtatttatgtttctttaatgcagcagcatatcatttcagctgttcaatttatttgtgatatgcatgtaaacaagcaacgtgatgcagttagtttcaactttagaagttctcatgcacatagtgtgcattgctatctgaaaattctgcacaacagaaatattttcaatgctctatgccctaaatggataacctatattgctacagacctatggagctagacgctttccatttgtattgcttaaccacaatgatcagaagaaggaaaattcagaacagtttatcagcataaacaacaggtttatcattagaaaaaagaaaataataattggttggcatgtacatgcaatgctatgaagtacaaaatgaggcaaccttagaatttatttagggtgatgaatgcgaacggaagatgaaccaggaagtcctcatggtcacgtgtcatggggctaattcctcatggaggtaatagctatgctttctcaccattactggacatacctatgtggtgctgggagatctaaactcacaattagaataataatagtttgtgaatgaatacttaaattcagtgttggagaagtaaaagtttatgcgacagaggatgaccatataggtatgtgtggagcggctccacgtcaaattgtaccagactgttgtgctagtagaatatggcaatagaattagattttttttatttttcttaagaggaacccatcaaatcccatggacacaaacagctaagtgaatggaaaagatagtggaagttcacaactattagaagagcacataggctccagatacataccaacatgcatttttttttgaaggaaggagaaataacttacgaggagctttcaatgtcagcaagcaaatctccgagatctttcttgtcagacttggcacctacacaaattaaatccttatttcttaacttgaaaattgtaacatctatatcaaactcttatgttccacaacagcaattacgtaccatcagctgtgggatctggaatgtatttagcaagccgatatttctgaagaaacaagcaattcaatcagtaaagtctagaacataagctggagaatagactatatgcaggtattgagaatctcaagctcaattacttgcagatggcttttgacatgatagatggtcaacccttgaacacccattattctaagaattcccttcggagttgcccctgaaataagaattgaaagatagtccgttagcataaatgtatttagcatcacagggtttgtgaacaaaaaacttaatggagagcaagcacaggattttttgtactaggagaaaagtaattaagcaggcatagtaacttactgtcgggtccaccaagctgtgttacagcatccacaaaacgatcatggaggtcatcagtccaccgtaagcgctgtctggcggcaaagttgctgtttgagctgttcccaccactattagatactacattgttgttaatacgttcaatttgttgattgtgggaaactggatcgttgtgagctagtacaatgcttgagaagggctttggttcatacatttggcatcctctgcacaagacatatataaactgaattaccatgctgtgaaataaggtaagaagatcaaatactcatcttcacaaaacattaaaacaatattccaccataacacaaaaaagtggtataaggagccatatgaagtgaaaataggaactaatgtttt

SEQ ID NO: 12450 - DNA, 1774 bp, Oryza sativa
caaaaatcgccgaagtaaacataaatgtaacgagcatttccccaaatggcgctctcttctgcagcaataacaaaggatttcccctacaaaatccagcaagcagtttcacccgaagcaattcgcaagcaaagtctataacccggagaacctaaactgaccccaagaaccaacgaatccccaactaaattcgccaagaacccagcagcaatggacaggaccacgcacccagatcaggagctcccgagattcagagctcgagcggaggccgaatcggggtgaacagcgagtgattcccgcggattgggagatctccaccacctcctctttgctgggaggaggagagatttccgatgggcttaggtttctttccttcctttttcgtgtcttccagctttggattcgtcagttattttgggttcaggacaagtgaagagccaacacccgtgtgagtcagtcagattgggggttggacacgtggcgtcatctgcttggcctggagttactttggacggtgtatgattgcatcagagatgagccaaaggcctttatttggacagagattcccaaaaacagatggtaagcagagtcagtgagaatttgttttttttaacaaaaaaagaaaaaaaaagatgaaagaacctagattgtccgcagagctcgatatttcagagcctcatcagttggcctaataagccaaaatttgaattttttaattcgattttaaatttgattttaagatatttttaacataatccttttagagttggctttcaagtcgctacgaacaaatatataaaagttttacctacaaaataatttttattctctaaaacttttttggcttattagaaaatatgagtaaccgtaaggctctgaaagaagctttactgctaaagcttctccaaacacggccatgtttgcggacctgattcatgtagaaaattggctcaagcctgactttgccacccacgtttgttatgaaaatagatgcacaacggagacacgaatttaacgtgaaaaacccttgcggaaaaaaaccacaggcgccgaccggcaatgatcactatagagaaatgggatacaaacgcaagggatatattgggctgtcgcaccctccccgtgcggcttacaagggatatactaataggaaactaatcctataaagtagagtcttattagataactaatccgaatatactgtaggcccaaaattcggatcacatatttaacaacgtttttgccgtaaactcgtgccaaaaccacgacataaaactgaatatcacacttgtgatcttgtactatttaaagctatgattgtgccgttaaaccaaacaactgtagttacaataagcaaaatcacgtacaattcaaccaagttgagaaagttcagcatggattttgccattttggacaccacagtccaggaagaccatcacccaggctacaacaatttcagtaacacaaaggctacaccaaaatccagtaacatacatcgggataaaagccaacattttagttgcgcattcatagttggtgcagacgctaagagtgttaatttttgttacgaaaaataattttaaaaaaaggaggaagatcacactgatgtagccagaagtctctactggttgagagcaatccactccagctccaggtccacctatccgcactccacattctgcagcctcagggagacctcctgcttcaccctgccgtcgacgacgctcaccgggctgtccctggcgagcgcattgtcgcgcgacatgagccaccggcc

SEQ ID NO: 12451 - DNA, 16042 bp, Oryza sativa
ataatgtatttcatacctgtacctatctctagtaattttttcatgaatttacaaaacttttaggtataattttcacaagtttccaacactaagctcgttttcaccatatatgtcctccacatatatactccctccttttcaaattagtggtcgtactagcttttccctaagtcaaacatttgtatctttgactataaacatctagaattatacagtttaacatcataagataaatgttagtacggttttaggttcatcacgagaaatactttcataatatataatgcacatgtccctcaaatgcaagtatgcagccgcgctcaagtagcaagagcacacgcgttgcgataaaaatgaaaaaaaaaagcggaagaggaaatgacaaagtctcaagctcagcactacctctgctggtactcatttcagcagctgccaccaaacactcccctccaggtgcgcctcaacgctgctaagaataggcaaattttaacgacaatggtcaagaacagcatatcactttcttcccaaaattacggcatcaatgcagtaatagtagagaaaagagagagagagagagaaggaaatttgccccttgggggatcgagcaaccctcatctaagtcatcttcttccaccgggtagaaatagatcgaccagtccaccgaacagaaaggattgagagcgaacaaaccacagatattcacagaaaccactaagctagcatcgcggattcgcagtgaaatgaagaaatcaagaacctgcctccttcgaaacgaaaatcagcttgaaaaatcccaagaagcttcgaaatcaggaggcgaaccgaagcgccggcgctaggagaagaagaggagagatcgccagatggggtctcgattcctggagcaagcagcaaagactgcaagcgagggagaaatgattggattggattcttgcgaggctcttggcttggatctctagagctttctttttgctctgttgcttctggtcagagctaggagaatcataggtaggagggagacctgggacccacctgtcagtgacatggagctctcgtacacgtaggagatctggtaggaattggaatattcctgatcaagctaacatggaaatgggaagggattaagggaatgatcagatgaaaggttgacattgcatttttttttcccggatacacaatacactttggttcatgtgctcctatttcagttacatttttgaaaaaaaagagaaaagtttgcagtccttttatgtgaaaaacttgaatgtatctgtgcctattttttgtgtaataaaataaaattatttataagcagcaatcaacattttggatgttagcatcaacctaagacaaatataataactatatgaaaaattctcaacctgatatttgctgtttattaaaccgatgactgaaatttatgtcctaatcaaaacctcctagctacttctctcagtgttcttgctaactaaagcctaatctgagacaccaaaaaaaagaaaaaagaaccaaaaaataataataaatccaagctccaggcctccagccatggcgcatgggcatggcgtccccctgatgatcaactctcctgcgtcttgacgacgatggggctccgcacctggtggttcccgtccgaccagacgatggcgccgaacgcgtagttcgccgccggcgcggggtccctcacggcgaacttcacccagaacgtcctcacctcgccggtgctctcgaacgtcagcgtcgtcggcgtcaccgtcacctgcaccccctcgggctccctcacgacggcggccgtgtacgtcgccggcgggccgacgttcctcaccctccgccgcgccgtcgccggcgggcccgccggcgccaggtcgaacgcggtgatggacgggtagttgaagtcgagcgggtcgagcgggtcgtcggggcaccggaacggcgcgccgttgaagagcgccagcgccgtcgcgttgtagccgatggtgcagaggaagctcaggtggtcgtcgacggtcaggtcgtacaccaggcccgggtccatcgcgcggtgcgggaacacgtgcccagcgccgcagctgaacggcgtcgccggcgacatcgacgagttcatgatcggcctcatgtcgttgcccagctccgtcgctgcccatgacaaacggctcgtcagctagcttaataaatacttcctccgtcccaaaataagtgcagccataagtttccgcgcttaactttgatcgtccgtcttatttgaaatttttttataattagcatttttgttgttataagatgataaaacatgaatagtactttactcgtgacttatgtttttaatattttttaaaaaaatttcaaacaagacgaatggtcaaaattaggcacggaaaactatggttgcacttattttgggacggagggagtagagatttagtccggtcatatcggtacctcgcgataccaaatcgttttcgatcgttgaatctagataggcaggatggacattgttagatctaatggtcggaaacgatttgataccgtgaggtaccggtaccttgaggtactttttgttggatcggagcaaatctctaataaataatgatgagttcgtcgtctccggcgcgcggcgtcgtgaggagagaatttctcaccggtggtcatgatggcggacttgatggcggcggggctccagtccggatggagcgtcttgatcaggccggcgacgccggacacttgcgggcacgacatggacgtgccgctctgggcgttgaatgccacccgccgctggtcgtacggcaagcccgtcggccccgccgcgccgctccacgccgcgatcacgctcacccccggcgccgtcacgtcaggctgcatccacgcatacaaaaagatttacctcgtgtgcgcgcggcgcgacgtcgagctctcgccatgaaaagtttctcacctttaggatctcagggttgacggtgttcggcccctgcgacgagaaggccgccatcaccggcgccggcttaacgccgaccaccgtcttcgccctcgtgatgaaggctttagcgccccttcattttcacaaacaccttccgctcagctcgaacaaatcaagaactcgactcgtaaatttgatctttggaaagaaacggtgttgtttgattacttggtggagttgatgtaggccaggagcgcgtggccgtcggcatggttgatgtgcaccgccgggaggacgtgcgcgtcggcgatgacgtcgttcccggaggcctcgtcgttgacgaggatcattgcggcgccgccggcgcggctgacctcctcgcccttctccaccctcgggttgcctcctcgcatgcacaccacgatcttccccatcaccttcttgccgtccagtgctcccagctcgcagagcaggctgtgacattggcatccatccacagagatggttagtgttcgacgccggcgtcggcggcggcggcggcggcggcggcgagagttgatcggtgtgtgtgtgtgtgtgttttgcttacgcgtcggcgggcgggtagccgggaacggcggcgttggcggcgctgatcatggtgtagaaggtcttcccgcgcagccatgtcggggagaggctctggccttccacccggttgcggttgaagacgaggtgcgccgggaacgccctgtccatggtgctcgcggcgacggtgaggatccatggcgcgacgttggtgacggtgccagggtcggggccgaagttgctggcggagcagacgacggtgatgccggccttgacggcgtggagggcgccgatggcgatggcgtcctcgaggtagtcgttggggtcggcgccgacggaggcggagatgacgtgcacgccgtcggcgatggcggcctcgaaggcggcgaggatgtcggagtcgtagcacgcgtcgctgccgttgaagggagggtagcagacgcggtacgccgccacgcgcgcccgcggcgacccgcccctcgccgtgccgccgccgaggccgaacgcctcggcgccgcgcacggccgacccgccggcggtggccagcgtgtgcgtgccgtggccgttggcgtcccgcggcgtcttgtgcgtgtcgttcagcgggacgccgatcaccttcgcgtagccattgttgaagtagcgagcgccgatgagcttgctgcacacacacgcacgcacacgaaaaatgaatcaaatatatatcctttggagaaaattcatatatgcctacattttgttaaattttttcaaaattatttttactctgtttttttcgccaccgaaagtgtacatcggtggaaaaataggaataaaaactccggaaattcaaccctttttcttgaagaaaaaatccactaaatttattgcgacagttacatttttgaatagttttttttaccaaaattgaaagaaatataaagaaaattcatacttgggagtagatttgtaacataaaattacctgttgcacttaaacgttttgtcgtgttcattccggcaagctcctttccaataatttgggatcggaccaagctcacggtcattaaagctcagcgattcaggccacacgcctgaatgtcaaacacaaaatcagacggaattagatttaaaaaatgaccatgttacacagtatatgtaactttcccattcgaaaatcaaatgcacttaaggacgttttcgaaaatgcttatcatcagacgtccgaggaaggaggaaaaatcggacacctcaacccaacggagtagtagtagcgcaggtgcattacaagtgcatgcagccaatggagcgtgcatgcaagttacatggattcaaaatttaaatgatcttttctattaaactatttattagaattatgaactaattataccattggatttgttataattaactctttataacaaagatctcacatgataataatccgatgatttttatcacataatattattctattgtttcaataagtatttactcatgtttcactaattcagatataatgttgcatgtggtctttttatatgctttagtaaatatattttgtgtttcaaaaaaaatacaacttgacgcttaaagagggatataaaattttaacaaaataaagtatttgcaaatattttgcatcatatatatatttttatgtttccctaggtaggacctagtgtttcctgtaatggtggttattgttgtagccagtaatttttatatagttattgttgcacgtgatctatttatatgtttcaataaataattttttttagctttcaaaaattgcaagttaacgtttcaagaatgatataaaattttaacaaatcaatatttgctaatatattgcatcattttttttatgtttcagtagttgggacctaatgtttaatgtgacggtggttattgttgcatttagtaatttttataagttacatcgctctgaaacattttttaaagtgggttgagttatcggtacaagtgataaaataattttatggtgcaacaaaaggttgatttttctaaaaacacatataaaatgttgcatgggcattattttgatgtttcaataaatattttttctgatgttttactagtttattcatgaatgttgcatgtggtactattggatgttttagtaagtattttctaatgtttcactaattcatttataaatgttgcacgttttgcatgggatgttgtagtgaatattttctactgtttcaataattataactcgttgtttcacgtataatatataaatgtttcaattagtaatataatcatatttacaaattttatcagaaatatagccaagtgagatcttattgtaaagatttaattgtaacgaacacaatgatgaaatcggatgatagatcggctaagtaatttagaaggaaaaatagtttaaagatttattggtagagaagataaaagagagagactacatgtatgcatgtactagagaaggttataggcttgcagcatagcagcttaactacgatggttttttttttgcatgcatcagatatgtggatgaacaacgtccgatcttttgctaaatatcgaacgtccgatgtgtagcagccaccggatgtttgatcagtgtatagtttacctaaatatcgaacgttcgatgtgtagcagccaccggatgtttgatcagtgtatagtttacctgagtcgaggttgccgatgatgatgttctggccatacctggcggcctcccatggcgaccacggcgggacgcttccgtcgggcctctcgaggcccaagaactgccacgaccgcgtggtgtgcatccgccgccccctgtccgggaacaccgacaccacgccgggccgctccgccaccgccgccgcctcctccgcctccagcctcgccgcaaagccgttgatgttcttcgtgtacaagtagaagatggcgtcacgtgccttctccctgctgcatttttgcgcacgcgcgcgtgtcgttcgaccaaatgcgtctcgagaaatcatgcaaaagagcgaatctggagatcaatggagttgggagaggttgcgcttactctccgaggacggagccgaggaggtcgtagtgcgactccgcggccgtgcggtgcgcctcctccggcgagatgacgccgccgtcgtcgccatgggagtggcggccgccgaggtagacgatgtaggacggcttcgtggcggcgagggcgggagcaacgatgaagacgaagacgacgaggagttcgaggcgcgtggacatggatcgagccgacatcgccgtggtgatcaccatggcgatcgagatcacgggagaggagaagagaagagagggtgaagtagagtgtggtgcagcttgtggttttgggctataaaggagaggagacgagtagacgagaggtggtggtggcgaggtgagaggctggactgtgtcttactttggctctgtgtaggcggttttggctttgcgatggagaaagcttcacatggccgcgatctgcactgtgcatgtgcatgaatgtaccctttgactccatgtaactatatgttttttttaagataatagaataaaatatctcagcatttactcaaacgagttataaccaattattacatagttcacacaatagcaaactcacacaacgagtctagaaccacagaatgaaaattttaaacaagcacgaactaatagacaccaacacaagataaagatcccacaactattgaattctatttgagaacctccagctgcataatcgttggctcaagtttacgacatgcatcattaattaggttaatatcttcttcataccttttgtaattgagcccaacactagagccaatacgttgccctgaaaagtaccttcaataagattttgatggtgatttaccaaaaaccatgttattcctactaagtcaaagagcctaacataaagcggatgctccaacaagaataagattcttaatctttttatcaacaccaacaagtcaattcccgaacatatgagacatactttgtggaggatgaaccaaaagaaatgtgaaccgatctccaaagaaatatagaaaaatggtaattgaagaatagatggttgatggtttcatttttcatataaaaacaacatcttaaattaccatcccaattccttctagccaaattatccttagctaacacaattcctttaagtagataccacataaaaattcctttgagtagatcgaactatgaattgactattttgatgaaagtttcatctgaaactatcactttcttctgtcagatcaatatgcacaattgaagcacacaagctatgccatttgtctaagttctgaccaactaatgatcttctaaaagacacattaagtggaacagatctcataacattcgcaaatgtatcatttctccttctgactatagcatacaaagatgggtatctatccttaaaggaaaaatttcctaaccacttatcctcccataacctaacttgttcaccattattacttatccaggaactcatgtttagaaagttactcttaactttcatcagatctgacaaaaaatggaaatcatatgttttttctcaacttgagttattaatttactattaatgcattttcttttcaaaaggtcctccagacaccctgctcatttattaacttcaataaccatttacttagtaaacattggttttgaattcccaaattatgaataccaagacccccctgatcttttggctgacagataatgtcccatctagttagtctatatttctttttatggtcctcaccttgccagaacaaacatgatctacaataatctattttttgggatcttaaaaaaaatatgataaacatagttaagcttgataaaacaaaatttatcaaaaccaatctcccctaacagataaaagtttccccctccaactacttaagtttttttctcaatgtcactatgtaattaattatgcagctatatacgtatgcaaatatgtaattatggggtgtgtgtctgaccaatccgagccgttctagggacaattttttctaccttccacgtcagcaagcgatcgattgatctgggacatttttttttaacgcttagatgcagtcgtacccgttatttgcatgggatttaagcatttatctataactaatataaatatttggatttttcctgtcgtcacaatccgatttcgtccatcaccgtccgtgccatggcgctcgcgcaagtgaaacggatatcccacatcatcccaatccaacccaaaaacaaaatctcaatctcaatccaaacccaaatcgaaatcatcacaaaatcatcaaaagatgatgagaggagatggaggggcgagcgggagcaacaacaccatcatcacataaaaaccccaaaatcaatcgtagcaatgacatcatcatcacatatacaaacaacaaatacacaaccaacaacaatggcggatcgggccgaggggacgtcggcggcgtcaggcagatcccctcggccggatccgccagtgggtgccaccaacgtcgtcgtcgccgccgccgccgcctgatccgccggatccgtggtgggtgggagaagaaacgggaaaggcggcgctcactctcgttgttgagaagagacgtgataggggagagggaggtggagtgccggagagggagagcgtcgccggttgagaggagcgcgaggagaaggatagaaggaagccgagaagaccgagaggaaacgtgccgttgtctcggcttcgacgcatgcagcagaaagggtcgacgcgtgcagcagaaaagcaaagtagtagtagtataatctcagttcaatgtatgcccgtgggacccacgtaaaagttttcaaaattgagcagtatctgccgttctcaatgcaaaggaataggcaatcaaacgaaatcttctgttgtttggtccctgttctcttttttttccgaccttctttccgttaaattcaatttttttctctaataggacatgactaaatacaacgctgctgtaaattagaattaaaaaaatgtgttctgtttttctatttttaaggtaaatataaagattttgccttttgccttgcgagagaaatctatatagttttatgtgtgtggatactaggaacaactagaaatatatagcgaaaggtttcaatgaaagaaaaaaaaggcagagtaggaaaaggcgtggaaggacatggactcctggccgtagaataggtctttgtgaataaacctggactcctggcctgctccggactgacctggactttgtagaatgcgttctctcacgcactttgtccctaccatcggtgatcgctttccccgcggaaaagaaaaacacatctgcacagtgcgggattggattcttgatcgactcggatcgggattgaatggatcgtgttagctccctgccgccactggcatgcctcctgtcgttctgcgcagcggcgaccgccaccttatcgacgccctccctggtggccagcttgtttgccaggagcacctccgcgacaccgcccaccacgtccttgagtgttgtggccttattaatcttctccctgtcatcattgggtggtgcctcatattcgcctcgacggcctgagcaccgcagcaaccacacagccggggatgaccctggacaggaagaatagccccgtggcgctcatctcggcaccctgcactgccgccacattggcggggtctataggcttaaatcccggggaaggtcgccgatggttgtagtagtgacatatcaacactgagatacatagcaaatgcaaattcgttgagctacaccctccaaatttatcaccatagatggctcatcagtaatgctctagatcaatacgacaatatggaattcacacgatttgcacaactcatatgtataaaatttggagatatttgcgagatatgtacaaattcaatatttttgtgcacatgtgttataagtacaaacaatcttacccatcaatatttgtttgatatttacccggtgcaacgcacgggcatatttgctagtatggaaaaaaaattcaaaaacaattgttacgttgatgaggatggcacaattatgtatagggactacctagtatctttcgacatattttttttttcttaggtctcacacgaattttcagtcataggataaaaaacaaaataacggacaggatgtttcgacacattttctaaatgatatcactcggcttttatttcttacgtggcagtggcagtggcaggtctgcaatgcaccgatgcatccacggaagattgttgggctagggaacacttgagtattctattcaggctatttgcaacacaaattatctaagcgacaatgtttagcatatcctcattaaatagaagactggatcttatttacaattcaaaagttacactgtaaatttaaaaattacactgtaagatacaaagaaattacactataagtttgaaaaattacaatgtaatttttaagaattacattataggctataaaaaaacactgtaaaaattcataagtactcgtatactgacacgatagttaattcattgagaataaatataaaaacatggcaaacaaaaaatagtatggctctacgaattaacagactagctaagcatctaacagccacaaaaatttgtgaggcgtaagaaaaaatcacgcgacaaaggaataacaaaaatcgttcatatatagtgatgacccattaatgtaaatatctgagccgggtattcatgacccgacccggtttctaacgacaactacatgcccaccgcacggaggaggtttcaaggagatcgaaacggatttagtacaattaactaaccccttccaaattttgctcatatattctactccgactgggactcgcaaattaagatcattgcgccgtcggactcgggcatcggctgcctacaaattcggccgggaggttgggagttgggatctcaggaggcaaagcgatcgatcggtacaacaatagcaattagagaaaaaaaaatttagaaagccccagccatggacgacgacggctcggcgatgcggcgcctccgcgacctgctcgcgccgccgggggagagcgagctggcgcgcatgtaccggaggtgcgccgccatcgaggagctccacaggcgcaagcggagaggtccacgaaggcgctcaacgactggtacgagctcaaggccgtcctccacgcccaagggctgcggtggagtgctgcgcctgccgcctccggggaggagggcacgccggcgggatcaatggcccaacgacggcgacggcagttaaagattgggagtagcacagcggcacattcaataatactacctccgtttcacaatgtaagatgtatattggcaaatgctagaaagtcttgtaaaacgaagggagtagtaaataaataaagatataggggagacaaattatggtaactaggtgatatctgcgcgttgctgtgggactttataaagtcataagtaaaattatgttatgtgcgtaaaattgcagaacaatgattaagaatgatgactggagatccattcttcctgttactgaggaaattcttaacttagataaattggagggcatgcttagtatttgctatatataatatacttctatattaactatattaaatacaaatgaccacgtgtagtaatgtaaatcaaatggaggtagcaggatgtaaatgaaaaggaggtaaatcaatagtagagtaggagtagatattaattttaatatttgttcctggtaaacgaatggggatgcatatggtaaaaaagaaggaattgatatgggtaaaactggtgtaacaaaatgcgagatagccaaactggaaaactaatgcaattacaattatgtatggagcatgcttacacattgaaatacatgtacgaactgaaatggtggtcctatttttgagaaaaaaaatcagaccaatttgccaaaaggaaagaggaagatgatggctaatatagcttgtgctagctagcttgttggagtgattaaagaagatgatggcgtagagatgcttatgattccagcgagcaaactgcagcaacagaaatggaacaccactggtcctatatattgatgcatagggattatgtaaatttataggcagcatgagaaaagggggagttagagcatgcggcggcggtgtcttctccgacgagcatgtaaatttatttgtttggggatgggaatggtggggaagaggagagcggataggcactcagattttctccagggggtcaggggtagagtggtaattcaatatcttctaaatcattttttcctttttatttatatatttctttaatttaatatgggggatccacctaactgccaaccatagtaggggtaaacggtgccttcgtttaaaaaaaaaaagggtaaattcgcaaaccctagaaagtgagagcaaaatgataattaaagttgaaagttggggtataaacatatttgtccaaaaagaaaatgatgacatccgttttcagaatcaattgctgttgccaccaccatggacggttgctctgtcgtgcaatgctcggtgagaggatggcagctaatggggactggatgggctgttctagccgggtaatttgggccaggcttgactggcaactgagctatggagtgtggaatttggaacgttcagatcgaatggcgtggaatgtcagatcgaatggctcaccattttagatgacatggcctcacgattttacagctttacagtgttattgctctgagcgggtatcaactagtatctaggaagaagttcccacaaaaaaatatatatctaggaacaaggatagactttttctcttttttttttcggagcttggagaaagtccgagatgtcttttctctctaaatctttttttactagttttatatacagatttcaagaaaaaatacttaaaaatatctttccaatataatcatagtagtataattgtaatgcaattatactgtgattacactaataactaatttgtaatgcacgataacaacaaatcaagtatcccaaaatcaatcaaaaggggttgcataaaaaatcgatcaaaattagtggaccagccgtgcttttcttcaggttgtatgaaaagaacgcccactgtattaacagctggaaaccggactgactagtagcagcactacggcaatcaaggtcgaaactacgagtatatccgtattccgtaatgcaccactacagcaccgcgacaacatgtcgagtcagagggcctgtttggtacagctccaactcctaaatataactctaggagttgagtctggagtgaagttgtggagctgcctaaacccagctccacaactctagtacattttgtgagagagctccacccaactccactcccagttttggtggagctgaaactgtttggctgagctccagctccaggaggggtggagctggagctagagctgtgccaaacaggcccagagtatccgtaatgcaccacccacagcaatagatccgagtcagagtatcatcccatccgagacatatcgcaccacagcaagagtcagagtatcatccacaacagtacccagagacatcgcaccacagcaacagtacccaaaaaagtgcgtcttgctgataaaaaagatgatcctgaactccgtcttgctgaaaaaaaaaactgtaaaacatgaattcacgttatcagaataaacatttcaacaataaacatacatatgattcctttttgatgatataggtactctctccaaatagatgttctacctctgatgctgctatttgctcttgctcactcaaccgtagcttgtcacttcgtcttgctgaaagaaaactgcaaaacatgaattcacattatcagataaacatttcaacaataaaaacatgcatatgattctattttggatgacatagatactcacttcaaatagatattctacctctaatgttgctatttgctcttgctcacttaaccgtagcccgtcagtgctcagacgtggtaagtgccactgcaaaagggaagcgacaaagctgcttgttaattgtgtgttctcatgcaaagattaaaaggttctcttacaaattaaattaaaacaaaaactaatgaattagtccaacttacacatctcgttgtagtacttgtcaacgagaatagccatcttttggagctccctcaccagcgtgaactcctcgtggtcctggtacttgagggacgcctgcatgtcgagcctgcgctgaaccagcgccgcggcctgctgccggtcagcgtctcgaagcgccccgttggtctcaacaatggactgctcaagtcctgcttggtgagctcggcactctgcaagctgggtatccatatcgtctcgcttccgcaagactcccttgacagcctgccattaaatgaaaagagaacaaatagaaaacaatatgttatgaccagtaatcttggaagatcgcagcaaagtataagtaagacttcataatatacaaagccacaagagcaagtaatttaacatgttaacgccttataaaatcactaagtcaagatcatttggttgagctctaactagattagaaagactgctatgcggatgttagggttagggtttgggcgctgcccgggcgaccgtggtacggcggcggtctcgcacattgtgcaatggatttggatggggattgtctccgatccactcttgagtctacaaggtatacgcctgctgttggcaacggtgttggatggttcgattctgtcgtttctcttgattctgccctaaaagtctagatggaattctatcgtcaggccaagaaactatgttccctgtttagtaagttgcgttcaaatgatggaatttccatcagggttccctgtatcatattcggtggcctacatcgtttggaaaatcagggagataataggaagtctgatctgtattggaattcctgggcagatttcgtgggaaccggactcaggttttcatcggtgtaaaacggagggcttggtgtggccaaaggtacgattcaggaagtctcccaagtttggatcatcaatctgcaatctaggtttcgagctctacgtttcgccaaggtacctcatggcggctgccgatggtgggggtgataaagggatcattgttgagatggtttcccacccgaagccaatcggaagcggtgagggtgccttggagatcttagggcgggagttaagggtggagggtatggcggaggaaggaggatctatccaaagaccgaacaagacatcgacatacaagaagagatcgaaggagagcccgaatatcaatccatcgcagggaccgacaacctttacagagggagtggttgatgatgaagaggaggatgctctatgtgtgaatctggaggaggtggtgaagatagcaggtcgttacgatcttagcgagattctactcgttaaggattccaaaccaagtagctctctttgatgatatgcgtagggcttgaagattgaggtcggacattagctataaatcgctgcgggatagcatgttcatcgtaactttcatggcagagggatattatgaatttgtcttgcaagggggccgtggatacatagaggggatgctct

SEQ ID NO: 12452 - DNA, 1738 bp, Oryza sativa
tgatcaattgccggatcaagcagggaagctatccgtgacagaggaggaagttcagaagaatgcagtggttgcagcaaggaggcaacaagatcaatatgtggcagatacttgtgatggtaccgggaaacctccggcttatgagatgattcctgctatcaaggatctatacaagcaaccatcctttggggatgtatcttctgaggagattagtgaagggaatcaaaaaagatcttcggctcagatagagccctagaagctgggaagagttcaacaagctttgctagaatatcaacaaacagagttctagcttggtgtaggtggattcaaggaagtcgcctagagccctgaagagatttcataagacataggtaggaatgggatcggaagctatggaggcaaccggcccaggggccgctggtcaattgacaggacctaagaaggggtcccgtcaggagcaatgagttgtctagcttggaactatcacggtatcgggaacgccatgacagttagtgatctttgtgccttagtgaaagaggcaggttcccaaattgtattcttaagtgaaactagacaaaaggaagaaagagttcgtcgtttgcgtaatagattggggttgagaggttttgtgggggttagtagtgatggcctcggtgggggccttgcattgttttggcatgaatctgttaagatggaaattataggtatgaatgaaagatatatcgatgtgcatgggcgtttgtctttggatgatcctatttggagggtgaccttgtttatggggaacctagagtggaaaatagacaccacatgcggtcattgttaagttctctgaaacaagtgtccaatctcccatggatggtggtgggtgattttaatgaagctctttggcaatttgagcacttttctctgaaaccaaggaatgaatctcagatgcaatccttccaagatgtgctacaaactcgtgatctgcatgatttgggtttttcaagggtgccatacacctgtgataacagaagagaggggagaaacaatgtaagggtacgccctaacagggctttagctgatgaaggatggaggaaaatttttagtaatgctcaagtcctacatctgacatcatccagatcggaccattgcccaatcttggtcaatttatgtcctgaatctattcgccaagagcgcactaagtgcgtgcattatgaaatatactaggagagagaactggctatatcggaaattattaaggactcatgggaaagtgctggagataagagtaccctgggaggcattaagtctgctttgagcaaagtaatgacttctctttgtacctggagcaaaaggaaattcaagaatgtgtcatggaaaatagaaaagatcaggaagaaactcgccttgttgcaggaaagaaatgcagataatatagagatccgtcagacaatggaccaaatgaacacttctgtatcgagaagagatgatgtggttacaacggtctcgcatctcatggctgaaggaaggtgatagaaataccccttttttccacagcaaggctgtttggagagcaaagaaaaataaaattatgaagctccgggatagggagggtactattcatactacgacaaaggagttagaacggatgtcaatagagtatttcaaggagatgtttacagctgaccccaacactgaccactcaaaggttacaaacctaattacagagaaggtgacggtggcaatgaatgaagat

SEQ ID NO: 12453 - DNA, 5839 bp, Oryza sativa
cttggtactaacagcaaactatatgaagatagcaatgggaatttcttaggtttgatagagttctatcaaatggagagcattgcgatagagattggcttgtctattgtaaggaactcagtagagtattttgtttcagttgtaaattatttacaaaaggacatagaaagggtcaattagcgaatgaggggtacaatgataccaatgggaatttcttaggtttgatagagatgttggctgaatttgacccagttatccaagagcatgttcgtcgtattacaagtgaagaaactctacttcattatcttgatccaaagattcagaatgagttgatacacttgcttgcttctgctattaagtctgaaattgtaagtaaaataaagagagcaaagtatttctctgtcattcttgattgtactcctgatgcaagccaccaagaacaaatgtctttaataataagatatgtggattcatcttcatataatatctccatagaagaatcctttctaggatttttagatgtaaatgatacaactggacaaggactttttgatgtgctagagaatgaaataaaatgtcttgatcttgatatagatgatgtgagaggccaaggttatgataatgggtcaaatatgaaaggaaaacatcaaggggtgcaaaagagacttttggatgtaaatcctagagctttctagtctgcttgtggttgccacagccttgatttaacactttgtgatatggccaagacttgtggtagagctaaagacttctttggaatcatccaacgcatttatacaacttttgctaattccactaagaaatggcagattctgaaagataacataacaggattgactctcaagtcagtgtcagctacacgatgggagagctgtgttgaaagtgttaaagttatcagatttcaatgcgctgacattcgagaggctctacttcaggtattttacattgaaatattaataacgatacatttcctctggttgtcctcaaaatttaacttatatttttattttaatttcaggtatctgatgttgataatgatgtaaaaactagcagtgaggctaaaggtttggcaaataatgaacttagagaatatgaatttatagtggcaattgtcatttggtatgaggtactgtatgctattaatttagtaagcaaacatttgcaagcaaaggatatgcttattgatgttgctattgagaaagtgcaagggcttatttctttcttcaaagggtatagagaaactggtttcttacaagcattggaggcagccaaaggaattgcacttgagttggatatcagcacaacatttcgtaaaaagcgagaaattaaaagaaagagacaatttgatgagaacccagatgacacaaatgttgccacacagtccgcggaggaatcatttagaatcaactattttatacctattgttgatcaagctatttcttcgcttacaaggagatttgaacgatatcagcattaccaaaagaattttggtttcttatttactgctgactcattgcgatgattggataatacgagcttgaaatattcctgcgacaatcttgaagcaacgcttaaaagagatgaaaaatctgatattgatgccaatgaactatatacagagttgaggtttctgcaagatttcattccaaaagaaaatatgggtcctcttgaaattcttaagtttctaaagcggcatgattgttttccaaatgcgtctatagcatatagaattttattgaccattcctgtgactgttgcctcagcagagcggagcttttctaagttgaagctattgaagtcatacttgcgttctacaatgacacaagaaagacttaatagtttggctatgatagcacttgagagtggattgctggagaagattaactatgagcatattattgaagattttatttcaaaaaacactaagagaataatgttattcaagtaaagattatgcaaaacaagagttcaaaaggtactattcttggaatatcgcatttactctgccgtacatacattattttagctatatttggtacttgattttggtttcacttagagctttgtacatggcctacaaatttgacggcacggccctagggcgacccggggggagggcgcgacgacgcctgctctggagggcgcaccacgaccgatctgagagtgtgcctcacgccgacggacgccaccgtggccgggcgctgctgcgagggctccgccatggcagccgccgcggccgccgggccaacagccgccgaccagtcccgtggccgggcgcgagggggggacggagacgctgaagccggcgccccgctgaccgggctagagtcagagtcgacggagtcctcgctggagactgacgactcccgcaggtcgcggcccccggaaaaccccgaaaggacggcggcgcggaaatccatctcggaggaggaggaggaagaaacttgcgacatggctgagggtggaggcttagggaccgccgccgccgccggccggcggggtcgggtgaccgccgacgcggggggggaggactcaggactttaccgttctaccaaccagagtggaagtaaccctccatttgtgaatggggagatggggattggattttatataattactaaacgtaaaaagtaaaaaactaatgctaacccaatcgaagcatcctccctcacgcacgtcggcggcagcggcgcgccaccgtacggcagtcgcgagccacggcggcggcggcggcgggcagtgtcgcaatcgcaactcgatcgcaagcagggtgaactgggagagggaaacagagattggggaaagtaccaaccacaggagcgtcaggcggaactcgccgtacgtctggtctcctgccgcgaacaccgcctccctctcgccgccgtcgaggtgaagcagcgggtgcatcgataccacctccctcatcggcgagagctccgccatggcgcgccctctccctcgctggaaaactgagcgcttgactggagaggggaagaggaggaaggcaaaggcgagaagcaaagtccagtctggattttttttattgtaccgttggtttaacgtgggtcgtcgaatggatgagatccaacggtgaaaactccttctagtgcatagcgtgtagtagtagtgtatggcatctatctatctatctattctattctatttttaaaacaactttgaaaggagacaccacgttcactgttggggctagaaattcccacattaatcagagaaaaagaaaaggagagtccaagtaaaaatacaattcaaaaatagctgaaattcggaattaaaaataagcaatattgaaagaagtgtccgtataagaacccaatatgagattaatcaaaattcgaaataaaaataaaataaaatccgaaaatagaaaataaaaagagagtccaagtagaaatataatttaaaaataactgaaatttggaattaaaagtaaggaatattgagaagagtccatataagaacccaatacgatattagttaatattcaaaataaaaaaataaaaaatccaaaattagcaaaaagaaagaaagagttcgagtaggaatacaatttaaaatcaactaaaattcggaattaaaaataagcaatattgaaataagaatccatataagaacacaatacgagattaattaaaattcagaataaaataaaataatatctaaaattagaaaaactaaaagagagttcgagtaggaatacaattttaaaacaactgaaattcaaaatataaaaaataaaaatattaaaagaacactatacggtattaattaaaatttgaaaaaaaaaatctgacattagaaaaagaaaaaatatttcaattaggaatacaatttataaataacaaaaattgatgataaaaaataaaaactattgaaaaaaaagaccatctaaaacacatgacgagataaattaagtaacaggcctataaaagagtaaaatggtggctgtcatggttatggatactacatacctaatagtagttgactaaatctcggtaagacccaccacatatcatgtcctatacggaaacaaccttcggatataggaggagttccgataagaaaagacaaccagagttctacatggaaacgacaaggactactcggattgtatccatattggtttacctagttctacttggacaaggggacacttatgggtataaatacaagccccccttaggaggagaggggcgaatccacagacacccaccagggagaaccaacacaatcaacatacacccaccatgggacacgatcaacacgatcaccacgatcgagacccaccacaatcaacaaccaccacaatatacggaacaacagaagccaatacaagcctacatacgccaagacaagacgccagatatcgacttcagggataggcatagctattcccctacggtgtctccggataccgtcaggagagacgaaagcgctatctctgatctcgccggacacggattcgaggaagaaggctaccctgttgtcgactacgagtcagcccttcagaccgccatgtcgacaacagttagataggctaccccacatattgtactggtgtgattatggtgaataaagagcaacaccggctccggccaacaggatgtagggttattacctgacacttcaggggcccgaacctgtataaaaatccctgtctccgtctcttttacctcagtctcgctatatcctagtaccaacgatccccatactatgcaaataacagaattgcgacatcaaacgtcgacagtggcagttgatacgacatataaaaactgttaataacacacaaaatagaatcctaatgatgattaaaaggagggacgacaagcaggccgtgaagcaaacggacaaggcgattgccgggacttctagaaagtaaaaaaaaaacccattgataatcatattcgatttttaaaatttcaatgacaataaaaaggagaagcagcgtgcggagtatataggagtacagttgtagagccgccgacggttggcgggacttctagaaaataaaaataaataaattccaacaatagttatgtttgatttttagaatcccaatgacaataaagaataggcggcggatggccgtagaggagtacagtggcatcgtttgatgggacttataaaagttataaaaataaaacctaacaagacaataaactctaaaaaatataaggttcaatttttaaaggttcagaacttctaaaaagtaaaaaaaaatgataatcatgttggagtttaaaatctcaatgacaataaaaaggagaggcagcggacaagccataaaggggtacaatggcaaagccactgacggtttggtgggacttatagaaagtaaaaaaatgaacccgaacgataattatgttcgatttataaaatcccaataataataaagggaaaaatacagtggacgggccgtacatgagagtataatggcagcgtttgacgggacttctagaaattataaagaagaaacccaacgagataataaaaacaaaaaactataagatctaatttttaaaagttttaagaagaatgaatagaaatagtggtagaccgagcaatcaaataatgaagaatatgatagaagtaaggagtagtagctgttgtgacttttaaactatataattagaaatacggggatatctatttaataaatcttaagtaaaatcatactgaaaaatatatgattttgtttgggtggtagccacataattgcacgggccacccagctagttcttataaattcacccttagaagagggtgtaatttgtaactgccaataagattacgggctgcagga

SEQ ID NO: 12454 - DNA, 1124 bp, Oryza sativa
cttcatagtgcaccagagtatacgtactactttactagagtcttgaacaatctcttccttttgagtactgtgaacttgagattggaagtacacgttttcatttttatcgatatgtactgttacaggtgactgaagctttggcacaagcaggtcttgaatcatcaaatcttattgtaggcattgattttacaaagagcaatgaatggacaggttaacagaccacttcttgttttgaattctgtttctttatatttgctttgtgctgtgctggtagcctattacttgcgaattagtagtgttattatatacatcttgatttacctattattaggacaaacatccttttctaccttagttgcgtatgatgcaaatgagaaatggcatgtcaacttctcttaattctttgttataaatgagctctcactagggctgctgtctggaaggaggttggactttcttgaaaaaagtttattgagggagttagctactcctaataagctggttatttttctgtatctgaagtgcctgtgatgcaaatggcatgtcaacttctcttaattctttgttataaacccctaataagctggttatttttctgtatctgaagtttatgtgaactacctgttatcttttgacataaggagtgaacctgattccgtaacttcacaacaaatgcaatgtgcaatcttttgccaaacaaaaccatttaaagtaaagaaatgtgaaatggggcaattatgcatgtagcaaggatgcctctcatgttgcttgcatatcctacagtcatgctatgtcacaaatcatagcactctcatttaacctgctgagcttttctccattaggtaaactttccttcaatcgccgatgtctgcatgatattggaaacactccaaatccatatgagcaagcaatatctattattggaaggacactttcagcttttgatgaagataatttgattccttgctttggatttggtgacggtaagttcattgttcccattttccattttgatcacttggtgtgtctcagtagcatatttaaagaacaatgctgatctaatgcctcctttgtggctttgtctactggcagcatcaactcatgatcaggaggtattcagcttt

SEQ ID NO: 12455 - DNA, 649 bp, Oryza sativa
atttccaggaattagtgaacaagcagatatgcagtgtgttaaagctgttagcactgttgagctgatctcataaatatttaactttttctgctctcattttccatgaaactagcttgaaaaaaaaaacacatactactctggaatcactcacttatcagaagtattcatattagtttgcattgcaaataaactgcaaagagatgaacatttagacgcagcttttgttaaaatataagagctagaggggaaggaagcagagatcgagagtatacagcagaaaggaacacatgtatatccgcacgaatcttgatgcaatccgcaccgcacgtgggccacgcggattggaccgagaccctactactgtcataggcacggccgcataggcgccacccagtgattgggacgaattctagtaggtgtagcccttgacgtacaagctctcggacgtggcggcgtcgccggcggcgccgccgtacttgccgagcgtggcctcggaagttggccttgcaccgggcgaggaaggcagcctgagcggcggcgacgttctccttcttgccgccccacttcttgatggtgctctgctgcagggcacggccgaaggagaaggtgagcgtccatggcttgagcacctccagcttgttcatggcgt

SEQ ID NO: 12456 - DNA, 10701 bp, Oryza sativa
gttgtactcgtgagtaaaattttatactaatatcacactcagcccacgctctccagtacaacgtgtggccaggtggaggggacagctgattgatcgttgtctcctgcaatcgtaattaaattaagttaccctcgtgtcctacaaaaggtcaaggatcttctgtaggagtggctgttactccaaagttgagacatgttttcgaccattgcgtaaaaccatgttcgatcgattggcaccttttcaaacgctgggaaatcttggctccaagcttgtttcattgagtacttcaatttgaccaagatgttaataacattttttagctgaattgtctaaagtttggctagtaaaattgaacatgcaattcacctagaatgacgcaattttatcaaacgtcttacgtcaacgacacacggagtctatacacagtaatgaataaatatttgttacaagtatgacaataaataggtgcctaattaactcgatcgaacctgtctaaccttcagaacattaaggttctatatggacaagtaaaatatattcataagaactcgttgctcaaagttttctaggagaatttttaaaatcaaaacaagccatgtaaataaagtttttttagcaaagttgggcaagccacaatttgtgtggccaacaatttgttagacacacttctggtaagtggaaagaaaacgagactatgataagtggatccaatttcttaaaaatggaacctctcctatcataaaatttgttcagacttttttaaagagaatttctcggtctccatatgcatctttggacaacaaatgtgttttagttgatctattaacgtatttcgatatttaggatgtaatattgtcaacaaaaaaatcatgattcacatgatataatacttcagtcgtttcgaggctttactaattataagcattgcatggtagaaatgattttttttatgtaagtgaatgaaaacaataccttgcggttgcaacacatgactgcttacctcatctccacagaagatcccaactggaacacctggcactggctatttctttttgtaacaatataaagtcaaccggattttggatttttgaagacaagacttaagcatggagcaaagcaacccaagatcttgcttctatggacataaacatatgctcctgccagtaagtttctcctgaacttgtctgcctgttttctggaaaacaaagacggtcatgggttagtttaagacttgaatattctcaaactgctggtacactgttattcttctggaagaaaatacaccaaaccttttattccttttattttccaattcttttttcttctcaccgggatctaaaaaggtctggcctttgctttttttaaaaaaaaaatctacaagatgtggcttttagtactctagtaaataacctagcagcctctgaattggaatgtagccatgttggcgtcgtgtgactgctggacccaaccatcaggcttcagttgtggggcaggacagaaacgaaaatgagtagctttaagcattcagatttgtcctgccctgaaggaatttcagaattcttctcccattaagggcacaaaggatttgttcttttcccaaacaacgcaagcaaaagtggcaaatgaaaacttcaataatattgctggtcaaatcccactctaactaagaaatagcaggcattctgttgttccctcaaaaaagatatatattgttcatcaaacagagagattaagatatggttccagaagggaataactcagtaatcatcaaggagaaaagaaaaacagagcagcaggcatttcctagaagcaaacacaagttgcacggtgcatcttaagtttgctggtttagcaccatcgagcaatataatagtattgtgtcaaattgtagtcttggtccccctaaaacaatcaattcaactctatgctacaacagtaaaggcatccatcattcgatagacacaaggagcagcaaattttcgcatgaaatggacagcgcatttgtcaaaaaggcagtgctcaatttgtagacctcacctagctaaatagcatacatgtaacatcataaacaatgctgaacatggtccaaagagagagcacaaacctatggaaacatccaacttaagacatgtcttcttggctgtacatacattgaaccctatgaagaggctttatcccttgacctactcttttcatagcacaaaccacgtaatctactactacctttatgtgatatgaatggactggagcaaaaacctcaaggtgctcaacccaagtcatcaattttctaattgagaacttcaaagattcccttatcacattatagttttattgactagttaatatttcagtcctcatcgtaggcacaccgatcattcctgtactctaaatcttcctttccccttcttgatgctctttctgtgagaataaatccatgtaaaaagtcctttggacttttaatggctattatttcaatgggctaaggcagagtccaacaaaggaagatcatgctcaagatgctctggatcaagcagatggcgacattagctttgtgtgcctagtgggggataaggaaaagctggaaattagcagcactaacagcatcttagaaggctgggggtgctcataaccacaatctatggatattattagaaggcatcttgtgattgtggcgacttgtgtaattacaaataattaatcaaaggcatgcatcaaaggcagattttggtcagtaactagatacttttttctatttaataaagtaaaacaattttgtaatgaaagggaagcgccatatactgtatcacaagaatcccaaaattcgagttgcttggtcaaaggaaatattgatcaggtttggcttacttgatggccgaggaaacttgaaacaatctggaacaggatctttcaagaaggttacagatgccaagaggataatggtgagacttctactaaaatccttaatttttaatctgccactagaatgatagaatccttcaattaatccgcattactagttagtggactctggtcatggaagatacctcacgtttgcaagctttcattgtctctaacagtgtaagaaggaaccccattgatcacaacgtagcatgtaatttagttgacatttgtcattaacaaataataaaaaagaagacacaaagaaaagctccttaaagtaaaggtaacaggagatcctgaagcctgaaggtacacagtaggtgagcataagtgctagtagagatttctgctactgtcgatgtaccagtgtttaactgaacatatgtgcactaaaataagcaaagaataagtaaaggaggtcacctttaatttggtcctactacatccttcataagtgataattaaattttgatcctttctttggtatagtactttgatttagtataagtgcagaacaaataaatcaataacagccacagatatgttcagcaactgtcaatagaatctaatattttttccaaatgcaatattactaaaaaatttattaaccttgagacatcttctatttgcacctttttcccttatgtcagtactaatggtgttctgctttgcttgaagatgttcagcttctacagagagtaacaacgatgtcagatgaatagaactttgtactttgtaggataagaatgacataagactcatctaatacacccatgaatccaaaagcgaatcttacatgacaaaaaaaatctaatttaaaaatctaagaaaaatggactttcagagactttctatagtttctagtaggttcaacttaggaatttaacagatagagaagttctcttgacacattttcgattctttagtcactgatttctttgatttacgatggcagcaacagcatagtatatgtcccgctcctgaattcctgatgtagattttgcatcatggtgatcaaattaacatattgtcaccgatatcaagtgaatatttgacataaataagaacatggcgtttaaatgaatcatttatgaactatgacatttcttagtccaaaatcaggccaaattgattgcaactatgaattgtaactaaaaaacggtcgactcttcatatgtctatcagacaattacttccccttgtttaacatcacatagcactagatcaactgatagattgcccttttcgtagctgactgaaccaactaaatccatggttgattagtggttctcatccagttgaagtacaagtttttggtggagcacaagttgacaataaccaagaaaagctactaacattggatttttcatgcgcacacgccacagcccattttcaggttgatgcccccagccactatcatcttctcaaaagaacaacagctacgatgctggaaactttgtccaaaagaaagcatgaaaggaaattaaagcatgctttctttgacagtttgaccctgataagttcatggtcccctttgactacaaagagctacacaaaacaatcaaagtcacgtccaaaagcaacacgcaacgatgcctgatgccgtgctatctaaacaaacacaatctgcacgggctatgaattcatacatgcaaccaccgaagaacaactacctgaagtgctcggtccaaggccaattttgactgtacttgacagaaaccaaatttatacacaacaaacaagcaagcaaaaatgttgtcactcaccaaccttagttcttcctgtttgtcatttattctcctatgactcccatctaaaatgcagcactaccatagcaacattccattctcagaataggatcacacacaaggtgacagaacacctggtttttttagagagtacatagacaaaatgtcgtgcaagagcagcagtatgtgcacataattccacgagatttgttccttccgatacacatttttacttctttctagcccaaaaaaaagtaatgggaaaaacgaagataaattttattcaggcaagcaccgcttgggattaaacttttactactaataaattctcgcgatctaaaaacatatcattcttctattcaatgaaattggcggcctcgtcgattcgtcaaaaaaaaacatctcatccgattgaaataataaggggtggattagtttctgggatgatgatcggagagaactgaaaatttttttttggaacaattacacgaacacagcatgatcgaactatgcacgtacgaggagcgaggattggggccatacctaagacggatgcgcctcgccgagcccgcgccttcagcgcggcgggaggagcgatcccgatccagccatcggatcgcgaactccccggcggcggaggcggaggcggaggttttcccggcggcaaaacagagggcggcgcggaggggcactgtgcggcggacaggtgggtcccacacgatgagcgtgaaccgatggttgtgttgtgttttgggccttgttctatggtggcattggaataagttcactttgggtccctctatttgtcgctcagtccgattttcatcctgaaccacgaaaacgggtatgacccgtcccccaacttacgaaaaccggacaggtccctcggcagtatagagggcggttttggccgacgcgacgcctatgtgactaatttgactcagtcttcatctgacgtggcattgacatggcaattcgatgtagaaaaatattaatccacatgggacccacatgttagtttaacgcacaaattaataaaaatgatggggcccacgtaggccccacatgtcattctcacccttctcttcttcctcctccctccctctccacggcgtcacaaggaggtccggcagtggtggccgacgacgcgacaacgacgacacgggagaaggctgggtgtcggcggcgggagcgctggggggaggggctccgcgtggggggcgccgcccgcccctagaagctactcctcgtcttcgtccgcggcgccggcgcagaccccgcgcggagttcagagccgtgcacgtgggcggaggggtgcagcagtagttcggcgccacgcggtggcgccagagatgtcgccactcgccggcgggaggcagcggcgggcggatctccatggcagaagcggcatcgcccatcaacagccggctcgccgcgggccgtcggcggcggcgccgccatggctaaattctcgtcggcgaaatgctgcatgaaatctcggcggccaccagaagcaacctggtgattttggttagctctgttaattaattaccggctaaataaacacatacttttccacttttttccttaaccatcgttcacgagcacggtgacagcccggccacctcagcctaccaccaacggcctcggcggaggagcgcacctcgcctccgcacgccggctgccgggctcttcgcaccggcgcggactccagcgtcatcagagcagctcactgaatgggcgcggagctgcgcgaagggggagcaggcaggcggtgaggtcgtggcgatggtggagggcctctccgccccgctcgtcgcccgctccgccggccggtcgctccggccgccgcccgccacggaggaagacggagaggagagcaacaatgacgatggggagcagtgggggatagagagaaggagagagacgatagagagagggggatagagataaggggtagtgaagatgacaggcggggtccacgtgggccccaccaattttctattattgtgggtgtgaaactgacatgtgggtcccataggatttattattttttgattgaattgccacgtaatcaccacgtcaatgccacgtcagataaagaccgagtcaaattagccacgtaggcgccacctcagctaaaaccggggtcaaatactgccgagagaccttatttaaacggtttcgtaagttggaggacctgtcgtacccggttttgcgatcaagggacgaaaatcggactgggcgacaaatagagggacccaaagtgaacttattccggtggcatttgtgatagcccaggtttgggcttatgtggcccatttgttctttcacggattaaaccacatctaattttccaaaaaaagaaaaggaaaaaatataatcaccgtcaaatttgaagattgttgaaaaaaatcacgttgtttttaaatgcaatagataacatcccggcctttactcaaaggagctacaactttaaaaaaaatagctatatttatggcgccatatttttcactaaaaattagtcaacatgtatttacattgtaaatctctaaattacatatgtaattttagtgtgtttatagtgtaaatatcaaaattacatatgtaaatatcaaaattacatatgtaattagtatgtaattaccgtgtaaatatgatgtaactaacatgtatgctaatcaccgatactcaaatttgtttatatttactcctactagtaacatgcccgtgctaatgctacgctactattaaataggtcgttcctgtttacgctaatcaccgacagcctacgcacgtactactgctacacgaatctcaatggcatcaatggtctagaatccgactgagatgaggaacaaaatatggcgcaacatgtttagcaaatccgtaaaaaaaatcacgtggatgacttcctaattcctacccaccgaacttcgattacgttatatgtttcgtaaaaacaaattagcgttgtagtactatttgaatttatttaattttttatctcgaggcatgtacttcatttgtagtcacacgtaaagcgtgcaggcgtcctctcccgccgccgcatatgccggcgccgcgtgttacgcgtgacggcgcggccgccggcgcacggtaaaaccggtgatcaaaccagtggaatcgtggacgcgcgcgccagctgcacgcacgcacgccagcgagctagcgctcgccgccgaaatgcacgcgccctcgaacaccaacggcgccgtcgtcttcctcgccgccgccgtctcattcctcctcctgctgctgctcggctcgatccggcatgctcgagcgcagcaagaaaccgggtagctttcactctccatcgatcgatcgcttttatattacatgttgcagcagctaagtactagctaattggtgattgaatttgaatactgctcgatcgattgatcgttgcgggcagacgacgagatggagttcagctaccgtcgcggcgacgacgacgggccggagcggtgggggcacatcaggcgggattgggccgcctgctccttcggcttcggccgccgccaatcccccatccgcctctccgcggccgccgccatcgccgccggcggccgcggcggctacgaccgccgccgcctccctcgtcaaccgcggccacgacatcatggtgaggttcgacggcgacgccggcggggtggtggtcgacggcgagacgtacgcgctgcggcagatgcactggcactccccgagcgagcacgccgtcgacggccgccggtacgacctggagctgcacatgctgcaccagagcgagacacgcgacggccgctacgccgtcgtcgcccagctgttcgacatcggccaccgccgcgacgccaccctggacatggtgatcaccctctgttccacatcttctactatctacacgtaggcagggttggaaatttcggacgtcggtcatttcggtcccctccgatacgatattacttcgacggaaatttttcaattttgtcatgaattttggtcatatttgttcaaactcaactaaattttgttcaaaatttcggaccaaaatttccaaaatttcaggatttcggtgacctccgacacgatcggcctaaccgataaagtgaaccctgcacgtaggtcccgttcttttctccaacaagagttgaatgaacattaagattttcgtgacacgcttttcaaactgctaatcgacgcgttttgtgcaaaaattttctatacgacagttgctctaaaatatcatattaatctattttccaagtttgtaaactcaatcaattatacgttaataccacctcgttttgcgtaaaaaacttaatcttcatcttcaggagaaaagaacaccgccgtagaggaagactacgaaaaagtatacagttgtaacggaatagcaaatatataccaatctggtacctttaataccaaatatgatacaccgtataggtatgatgacatcagcatgatacgtaagtagcggatctgagcatgattttactaagtatcatgttgatgttagcatgatactataggtatcagaatctatatcatgttgacgttagctatttcgctataatagtatatcgttctatagtatttctactacacgtaacattgtaacatgtgatcgatgtctgcaatgtactacctccatattttaatgtatgacgccattgacttttttgtctaacgtttgacaatttgtcttatttaaaaaaaattatgtaattatcatttattttaatgtgacttgatttatcattaaatgttctttaagcatgatataaatatttttatatttgcacaaaaaaatttgaataaaacaaatggtcaaacattggtcgaaaagtcaacggcgtcgtatattaaaatacggagggagtagctggagccatacatcaagagggtggccaaaaggaggaaggggcacgaggtggagatcgacgacgacgtggatccgaggtggccggtgaagggaagcggcgtttactacaggtacacgggccgttccggcctgtcacgttttgtaactaaagctctatttttttttaatatattaacgtgtaatatttttttacgtgttaaaaaaaatctacaggtacacgggctccttcaccacgccgccctgcaccgaggggatcacttggactgtgtccacgaaggcaagccacacacatcacagatcagatcattaatttctttcgtgagttagtcgtctgatggcgcaagcaattgcgagcgtatatgcaggtgcggcgcgtgtcgcggcagcagatggagctcctctgcgagaagtcgtccacgatgtaagtaaagcgagtgcagtgcagtgcattgacgtgtgccacgatcgaacgacaattttgcgcttggctttgtcgtgagtaaaaacgtttgttggtttgcttaattgcagggtgacactggaaggcaaagtaacacgaactcatcgaagacggcttgtcaaattttcatgtttatagcataatagtaatgcatgacagatgtgtgacaaatttcaccttgatcaaaattaacagaatcaaaaaacatgctaaaagcaagtcatcagatgacacactacgggataaacaagctgcgacatagtactaggattttgaaacatgaatcggttaacctagctaactagctggaaaatccatggatcgagattgattgattgatttgattattagtattgcctagtcgaggcgacggaggatgccatcgttgccgacgccgcgcttgctctctccgtagtcctccggcctgaggacggacaagtctatctcgtgggcatggtcgcgggcgaacgccgcctcctcctccggcgtcggcaagcgcatgttgaacctggcgtagctctcggccctcgtcgccgccacccacgcggcgagctccctctcctcgcgcagctcctcctcctccctcttctcccgctccctcatctcgccaagcatcctgaacacgctcgccacggccccgatccagtccgacgggtcctcctctgccgccgccgtctccggctccttcctcttcgccgccatgg

SEQ ID NO: 12457 - DNA, 18936 bp, Oryza sativa
  unsure (1)..(18936): unsure at all n locations
atactccatacactcctccctcatcctcctccttttcttctcttcttactacagtacaccacacaaatttttttaaaaaaaccaaaagttagaaaaaaattatgtatagaaatactatatataaaaaatttaaattcaaattcaaatttgaatcgggtatgtaaacttttgacttataaattttaggtgtataaactttagatgcataaaaatactatatatagaaaatatttgaattcaaattcaaatttgaataagatataattcaaattcaaatttgaatcgggtatgtaaacttttgacttataaactttggttctataaactttaggtgtataaactttagatgtatagaaatactatatataaaaaaattgaattcaaattcaaatttgaatcggatatataaacttttgacttataaacttttggtctctaaactttagatgtgtaaacttgaggtgtataaactttatgtgtataaatttactaaaatagtaaagtaatgcggtgcaaaaaaagaaaccaggtagagagagagagggagagggggattgatcgctacccccggtcccgggcgatcgatcgccgattaggattttcgagtccaagttctagtacgtggagtagttacgtggcaggagatggaaacaggtctcatgagaggagaattcttgagcacagagacatttacccccagattacaccacagaagccatcgttacgccattctcccttggctcagttggtcagggtaactgcaaaacagtaggcaaattctcagaaaataatcaaggcacgcaaactctgtttcattccctccaaattcacataagaatgcgcattgacatacccagcttcttgtacatctcttcctctttaagcaccaccttccgcaactcatgcgctgcgtattgcatacggcgaaaatgaaactgcaccgatttcttcagggtctccatcctggccagcgccaccctcatttcctctccaccagccgccataccttccatggcatcctgaagttggttctcaaaccttaggcgaaggtaatgagcactgtgctcttcatcgagttcatttagatccatccttttgtaggccagggcttttaggctctacacaaatcagggcaattagtcaatttatcattccgcataaatgaatagatatctaatagaggacacaagagaggatgcatctcaaacattattaatatacagacagaacaaagcaaagagtagttcaaagagccctataacttaagttctgggtaactattccctcttagctcagatcatactgagaaatgaaggtttatcttggtccatcacagtccatacaataagtttaaattgaacatgggtgcaattgcagagcatggattaacataccagaaagaagatactacctccatcagtttaaatggaacatggatgcaactgcagagcatggattaacatactagaaagaagatactacctccatcccataatatacgggatctgcattgccaaaatcccttatatcctggggaggtagtattacagtggaggataacattattggacgatctttggaggcagtacagttcttcctagcaaacaacactgaccacttgagtatttcaattcagcatttatttgcttttttcccaagaataaaggggcaataagcctgtagcattttcacccaataagtttgatgcacagttttgcccgaattgtggcacaagttctagctaatcgccttgcccctagattaaatgagttggtgtcaatgaatcaaattatcttcattcataagagattgattcatgaaaatttcctttatgttcaaaacataatcctactcctctcaagaaaaaaggactcattcactcttctttaaactggatatttcaaaagcttttgaaaatgtattgctggccttatttgctggaggttctacaggttttgatataaaatggaggaactgggagtccaacactccaaccacctagccatgttcacttctagagttttgcctacagtaccaggagatgatatcgtgcatgcaaggggtctgcagaaggtttttgaggtggcaaaagaaatttatttactctctcggtctctcctcttaccaaaacatagcccgtttcagatgatcgctttacacagatgatgatgttcacttcactaaacacaacctaaaggatctagaagtaattggtagcattctatggctgttgctgcagcaaaagacccatgcagctgagaactcgctgaggcgacactggcctcataaccagatttgcagcctttgcaatgaagcttttgacgagatacatgccatttggccaaagaacatctacatatgaaatctggaacaaggtttgtcggatgagattctaaacataccttcacaagcaatttgttagtataggatgaacaggaggagcacaattgcacaactacacatcgattagtttagaacaacacatggaggaggaggaggagcacatagattagtttagaacaacacgaggaggaggagaagggcatgagaggaacttaccatggtgacgaagaggaaggggaacccggcgtacgcctggtcggcgagagcggcgaacttggggtcctcgtcggcgacgtacaccacggtggggacgtcgatcagctccctcaagggagagaggggctcgggggagggaggcgctccgagctccacggggtccgccatggcggatggcggcggctcgatccgcgcttcgccggagagcggcgcggcgatcggcgaggcgaggaagagctcggggtcgcgagacgcggagatggggatgggaggcgagagaacaaaaaaaaatgcagcgtaatctgaatgggttcttcctcgcagatgcttgaagcactcctccttcctgataaaccataatctgagatttgaggcttgcttccatatttatttgagatcacaaattctatgaccaaattctactccctagaatataaatcttcttctttctcaagagagtagatttgggctgttcgagagctccaaaggttgaagaagagctacaggggaccaggagggagatgagtgtgggtcccaccgttggtaccacctcataataaagtagcggaaacgatttctgaccgaacgatctagagagaaacagcatctgagccgttcatcggatttatctgagattctccggagcgtgtgggaccggaggacaaaaggtgggtcacgagagctcagcctgccaactgttgcgtgtcagcctgcgaactcttcgtctccatctccggctcccgcaaccgctcattccgatcagaaaatttaacaaattaattaaaatccttttgaacccttaaatttttgtttctaactagagtatgcagatgatttttttaaaaaaaaaagcttaatttgtcgaattttaagcaatccagttggcttttccttaagtacccgacgctgtagaggaagctgaatgcgaagaggtgcaactggacccaaggggaagaaagtccgggcgaagagtcatgggcctcatggctcagtccaagcaaagggaaaggatttcgtatatctttatggctgaggttggtaaacaaatttaggactaagttaaaagcaaacgtctatacaaatttagaatatagctaagcaccacaggtccatgaagtaattatgtcaagtttgcaaatgtacacacttttggccttagctcatcacaaccaacaacctaatgggtaagcacacagatgaataatggctacattgtttttgatatgctaatcatctgcttctacatatgaaccatgggccataacctacattattgatgatctactgcacaggataaggccaccgtcgccaattctttccttttgcctccatcgctccaagagaagatcgtggctcctccgcaaatgcatgtagtcatcgatgtgaaatgacgatctttgagtgttatcggggcagctgcttcggcgagacgcagcctcctcgaaccttgtcagaagtgtatccttggagccagctgcgctatcatgatctccaggactccaactcccgcggctgctcatagtgcgactgctggtgctgcatgcggtacttgctccctgaaatggtcagttaatcaggcaccacaatgcgatggtatgttgataacaattactaacaaagatgttatatgtagaaaacacataacagagagcatttttttctcaaaatattggcattctacttactgcagttaaaaatgtgttgttaaacaatttcgcagaatatcaataacgacatacaaataagtacaacaagcacaacttagcatagagagaacagagatggttatcgtcacctgtgtctttggtttgcatggagaggtttgaaggtcgttgcttgtttcccattgcagccagggaaggacaaccccgtctgcctcgacgggtgaagcaacttttggaagcgttattggagtttcgatcttggtgttttgtaccacatctcttctgcttgaacttgtatcacttctttctccatcaaaagatgaaaaatcagtatcttcaacatttgacaggaaatcttcgaagtattgctcagcctcttcagtaagacgtcttgacaccctggctctatcattgcttctctggaatatatatacataaagtctgaattcgcagattctcaataacaaaggaagaagtagcaatacagtgaagaaaacttactcttctatatcgtggttgcctttccgaattcatattcttcttaggagtaggtagcaattccttgactatttttgtgagttcatgcccacgttgttcttccgctgccaattgagctaacaattcctgtttccgcatctctgactgaaaaatacattggataaagcaataaagcatattaaatagaaatatgattccttaaaagagaacaagaaaaaaacactcatctactgaatattacctcttccaacttgctagtgtaactcctgcggagctcattaataacctgagttggttgtgcatcagcgcttgttgctttttctgaaggttcagattttgtcacgacctagagaaatgcaatcgaaggcaagatgcatgtaatcatactgtcatttacaatctatgtcaaaacatggcaaaggatttcaaaagtcaactattttagagtcaaaataatgaactagaaaaaatagcttacaactgtgcattgtgcacaggatattaacattttaagtgctataacttttttctaaaaggtttagttccgaacataggcaccaagagaaaattatcacagaccaaggaaactaatcaaaggaatatacggtgaatgtcattaggaacttttgctgctcataagttaccttttcaagctgagtcctgatttcatcaacagcttgccggacttctttacgcatcacgtcatacagtgcattttcatcctcattattactcaggcggtcctatcaaatgccataagcatataaaagggatatctgatatattctagttctaaaaatttaaaagaatatagtgagatcaaccttttcaagggtataaactgcccgaatccccttctgatttctgctatgaaaagagtcccgaaattcatcatcagttattgaagaatggctctgcaaaaatcaaggttaagatgagctcacaatgacacatggaagagccagaacttttatgcacgaaccaatggatggcactaaggcacaagatagcgcaaaaattttaatggtgtacagcactcaactctttcttgtgattttaatcaaattacttaaaattagaattagatgtggcttgacaactcgtgctcaggccaagcaactgacggcactaaagcacagggtaaggcaaaaggtttaatgatatacagcagtcaactctttcttgtgatttaatgaaaattacttcaaattggatgaggcttgatgattcatgctaaagtcactgtggttctctgctctagcaatggagttatggaggcataggtttagggtctgggctcaccaaattacggtttggggcatataaggcagcaagggaggtgatggcccagggatgcaagtgagtaatgcagtcactcccagtcccagatatcattaagcaccaagcaacaggttgcactgtggcacaaacagctacattatgcactatggtttgcatcacatggaacatgtcacaattatattgctattttcacatgcaaggggaaccacccaaataactattccattttctgcatccttagaaagcagaatttcttaagtcatcacaatagcagcaggcaaaagaataatatgtgatgtactcactgagctgctgtctcgtgaatgtaagaaatctttttgacttgtagacttcctcaacgattgatttactttagccgtcttatggaatgatgagttctgcaggctattattgctggatttggtatttattcccctagaaccataccggtgagaaatgtccatatcattctgcagtcataaacataaagcacagatttaaacagaagtagaattgcacatactagacaactagtagcaatgaagtgaaggcatataagttacacgatagcaaacaaaaggaaatacgaaatctaggatgccaaaccttaaaaacaaaggtactagtgggattcacagaccactgcaaagcaaaaataaggaaatagttcacctaattttctgatgaagattaaagataatgtggtaccataaatattaaatggtacattggctaacattatatataagtgaacaattacaatcatctatttatgcatccaagcactcccatactgttgggtaaaatcatgatgtgttgaagctatagatagcattacatttatgatagttattattgaataaacaaataatcaaatatgatagctattgaatgcaagctgatgaggtaaaactacctatggtcatcaagatcaatgttccagttgaaaagcagaaaagcaggtccatttgtgcttttgaggacaagaatactaccccatcacagacaatgcgatataagatcctcttgtcgattacggcagtctactatggtgtgtgtagcaagaaacaagtgatctaacacatttttatacagtcaagcaaatatcgcatagataacaaacatcatccaggaccaacaaactgaacggatacgtgtcatacaaaaacatatgaaagcattgtgtatatttttgttgtattacctagttgcttgattttattattcttataatctcaactcaacacatccataaattgaactaattcacgtttcatgaacaagcatgaataataccatataaacttagcaaccagtagaggtacatgaattacaggcatgaagcatgtatcaaatttccaaacagattttaaacatagcacaatgaacaattaaacaagtctaatatcgttaaatagaatcgtagcgagattttgcattcattgctaatacaaatttatttctaaaatgcccgataggactaactaaaaaatttatgacaatatatgacagcaaatccaaagcatatcacacgcaatccgctaatcccaatgaaattaactcggcataatgcaatcaactcctatacaaaaccgaacaccactattattattattacaactaaaaattgcgagttagattgtgaaatgctggtcacacttacatccgaatcacaccatcggtgccgatccatcgaagcgcgccggtcgacggatgcataccgctgccgccccgcggcagcagccccgccattggcgacagcagtggctccgcctcgcctctcggccggcggccgcgacaccgacctcccgcgctgccgcgacgactccgtctccctggcgtaccgcgcggtggagctccgccgaccgccgcccttctccgctggcgccgggaacctgagccgcccacgcgactcctccccgcgcacgaccaccaccgcctcctcgtcgtcgtcgtcgtcctcggactccgccctggcccggaagaactcgtcggcgaggtcatcgaggctgatctccggcggcaaccccgctccgccccggccgccgcccctgaccttgttgacgaacctcgaggagggcgtggccgcgtcctccggggagggcgatggcggcgggaacctactcaggctcctcgaccgccggagcagcccgccgcttcccccggcggccgcggcccgcccgcgcgtggtggcggagccggcgtcctccgccgccgccgcgaaggcgtccctcctcctccccgccgaccggtacgcccccaccgccgccgccgccatcgccgccggcgaccggagcagagagcagctagggttgcactaatcccctcacctctccaccggataagagacggaaatggcgatggcaactaaaaccttcttcgagtggaccgaacaaaattaattaaaaccaaattaattaattcgttttgaattagtatactaccattagtagtagtaacagttaaattcgttcgactttaaacccgggcccacctgtaggtgaggcggatggaggcgggtaagagtcaggcgggtgtcgtgggttgaaacggtgggcggattggggaaattttgaatttaaaaaaaagtgcgccaggttttgaggggaatttacgagattcgacgcctgacacgttgagctgacacgattttgaatttgtagtacaatttggcaacgggtccaaggctgtgtttagttcagcgcaaagtttagattttggttgaaattaaagataatgtgtctaaaaagttgtgtgtgtatgacaggttgatgtgatggaaaaggactgaagtttggatccaaactttagatctaaacacagcccaagagcatttactagaattacagtgacggagtttgaaattggagctgctgctaataatgtggaggagtattatatcgaaatcatgaatgatcattctgaattttgtttgcgtctttgacaggttcggttggtacaggacaatacgcgtgcaggtacaggaggtggccaaacgcggccacgtgacaggggaactactgtgtctcgtgtctcgtctcgtctcgccgctcgcccgtgacgccacaggccaaaggaggagagccgtcacgatcgcgaggcgtacgtgcgcgtggcggtctccgtcgccgactcgccggcgttgggcctcctcgtcggtgtcatcgtgtactccgccgcggcgccgacaaggtgggcaggcagaacggtcgtattgcttcggtgggaaacggatgggctgcaaaaaactagcgggaaagtttgaaatttgaagggtagaaaaaggagctccacccaatgatgtggggggatggggttgcggtgcgaagaattcagatgagtttgcgcatggccgcggtatttttctggttcgggctctaggcaatagttgtagaaaatgcatagccacttgatctcctaagtgggtgggttcactaggatcccgcacttgggaatccaaacgtgtttgacagctataatgaagaagccggcgacgtcgaccacaggagacgagagagagagaagccatcggcggcggttgcaggtggcgagaggggaagaagtcgggtggcagctgtggcaacaacacttgggcaacgacgacatgccctcgcacatttgaggaggtgatgagcgcatggtggccctcctcgacggtggatctgcgtgcacgcaaggcgggctcttgcgcgtgacatcggatccactcctcgccgtcctcgtcctcttcaataaccatgcaccaccgagcctcccttcatccctcgcttctccctcactgtcataccccccccctccgccgcctcattgtgcgccttcctccgccgttggtgccgccgccgaccaccttgagtggtcgaccacaggaactggatacgaaggaggaagacgacaggtagtcaaggagtcgaatctccccgcacggtcacgtctcaatcttgaccttcaccgtgccattagatagacctccgtaggagctggccattggtgctagcgtgggatcgaccttcgtgggagctaaccgctagacatggcgctagccgtgatgaaagagctagagccgaagctagcaaggggagggcacgcggacgtgaggagggcgaacgacttcgaccatcggcagagaggagagggaagcgaagaaagagatgaaggtgggacccacagtgggcccaccattttggccagttgaggtgctcatttggccagctatataggttggcagtccaagtagcaaggctgttagagggagtttttttgctatgcattggctaaaattttgttgggagagtcatttgccaatgttgttggggatgaggggcttattcgaaatatgggataggaaaagcataggaacatgaaaaaaaaacaataatatgataggattgtaggtgtgaaatagaggattagaaaatatagaaaaacgggtaaagctatcattcggatagtgcaaaggaaaacatagaaactttgattcattactagactagaagtagtaacgtgataaacgtattatgtaatttacaatacccgtggttccgccaggacgtgagctggctgccgacgccaacctcgtcttctctttcctagagaagagcgagagagagaaggaagggagagaagaggggaaacatagagtgatgacgtggccaccttgacatgtgaggtccacgtgggccccacgctaaaggacctagtttgtactagttttgtaagttgggagatgcgttatatccgattttacggttcaaagacgattctgtaactcaatgacaagttgagagaccttcggtgtgccttttccatttgtttttctgctatttcaaccaatgcgttccatcaaacaatttagttggaccaaggcccaagaggccttccaacttacgtggagtaaattcccttaactttaggtggagtctgtctgaggtccctaatccacaataccaaaaatctctacccattaactatcacaaatcgtgaaaaaaaaaattccgagcagtatcaacttaattttcctctggtttcactgacggggcatacggtgggccccacatgtgaggagaaaaaaatgggtctgcatctcttcttttctcttttcttccttctcttttctgaaaaaaaatagaaataaaatttttcgcacgacacataaaaatttcccaaaccttccctttcaaatgggccctaatcacccccattacttcccaaacacgtctttgctgtgatcagacgtctcatccaaccccatcatattggcattaacaaactggacctggtttttcttttgatgaatggccatgtcactcaggagcaggagcagcagttggtggcccgatcaagccgacggatgaggacaaccacggctatggtgagttgtgattcaaattcatttgcacttaataaaggccagcttctgctatccgggggtgcgggggcggagccccagcggtatggatcgtcatcccttttagggttccaccatatatatacatcttgtaagccgccatgcggcgatgtaacctcacctcagatatagtgaagatattttgctagctggcgcccgtggttttcttctctcctgttttgggagggttttccacgttaaatctcgtgtcttctgtgattgatatattgttttttatcgtttgttcgcctatcgtttcctaacagtctactgtctactgaacccaacagtcaggctctcaaaaaaaaaacagtcaagctcacacacactcagggtgtgtgtttatagatccagatgtaaagttttaacatgtcatattgggtattatatagggtgtcacataagatgtttgggcactaatagaaaaactaattatataatccgtcagtaaacagcgaaacaaatttaatatatttaattagttataatatgtataattagttatttttagcctatatttaatattttatacagatattcaaatattcattgtgataccatgtaaaatttttatgtggcaagtaaccagggcctcacactcacaatggaccgcctcctttactgcggctttgtccggtgcgcggccaaaaaaccctgacgagtcgtccaccgaagaagaaaagtccaaagtccaaaacaataatcacgtcgccaccggaaatgaccaaactggcccccgtattgtggtcgatgacatgcgggccccacggagagcatctccggtgagatggacaggctagcagcagcagcggtggtggtacgaggcgctgcctttcgatgtggggcccacgtggcgggtgaatattcggggctttcaggtttcgcacacatctttttctttttcatttttttggcggcctggtggatataccgagctgtccttctcttgattcagaatttcgctggtatagccctgggtagatgtgagttttttcaaacagctccttctcaaaaggtcagcgcctaacatttgattttgaagttcatatctcactgccttggtttgaagttcatatctccagtttttctcagcaaaggttatgtggatcgtcataattttagcagcacactttgttaacttcataaattatgtatcgagacaaacaccaggatttatttcattatcaagaaaaataaaatatatataagttaaggcttcgacttcttttaatataattatgttatcatagtacagtcgtgtcaagcaatattttataaattagctaacagctggatatcataactttacgagtcatatatgtcttcaaaaatatgtgaacgatgtcatacgtgtttcttttaaaatgcttcgtcatgcctagtaagaatgtttatattatgtttatatgctttaagcctttcaacatatctttaaaaaagacctttcaacaaacgggtagaagtatttgttgggcaactaagacaatgattacattgatgatgaactataagtcatgttatatgccaaaaatcattataaacaaaaccatacaatgtcccgtcatatgagatttacaagtcacacaaacatttacgatcccacgatataatgcgaaggcatacaaatgcacaaaacaccacgatttcaaaacccacacaaccgtcacatatgtgaagtattcggtaacttagattaaatgatggcctatgttggatgacgaactatatgatgttatcaactagaaatcatcataaataaaaccacattatgtccaaccatatgagattcacacgccacaacaaatcccacaatacaatacaaaagcatatggatacacaaaacaccacggttttcaaaacccttgcaaccgtcacccgtgtctaagaccctgtttggttccatgggctaatgtttagccctcaccttttagcctcaaattagccctcaaggatccaaacaggtgggctaattttgagctaatgtgaattagcccccctcaaaacattagcctttccaaggggtgctaatggggctaattttgtgtggggaccatcaaaaaacagctctctctctctccttctctctcctctctttctactctctctatacctttaagccttgaattagcccatggatcaaaacataccaccctagactaatgtttagcctaccaattcatgactaaacattagctttcaaaattagccctgtgctaatcttccaaacagggcctaattactcctaccctggtaaaccacgtccccaactcccaaggacccatccgtgcacagtccacaaaataaaaaacattccgaggactaaactacaaaaacgcaaagcaaacaaaatcgaaaaaatcccccccataaaaccgattttattccccttattacacatctcatccgcctcattaacgttctcatttccactctcctcctcctccacctcccccctcgcctcgatccccgcggccaccgcgcctctcctcccgctgccgccggcgggcgccgcggccctcgcccccgccggaatccgccggctcgcggcgagcattccgagctccgggtcgcccgaaacctcgccggatccggcggtgctcgacgcggctcccgcgagagcagctgcctgtttcgccgccgggacgccgcgggcgcggatctgagggtgtttggtgggaatttggtgggggggttgagttgatttggccttgggttggggttgggttgggttaggctggttggcgggggaagctgagggggataggaggaggttggggctttgtggctgcgcctggtacatgagcgccgcgagcatcctacgcggctgcgtcttcgtcggggagcttccggcggcgcgatgatcgagcagttcgtaaattttgtcatccgtccgccgcggtaattgcactgtaaatatttttttcccactgaaatgatgcctcgtgctgtagactatcatgtttcgctgtattagctcggttctgtgatttagacggtcatgcttcctaagccgtggttgagtattaatcttaccacttcaagcattgaaaagctcagtacttgaaatatccaaaagtaggagtttgaggctgttatttattaatccctgctgttgaaattactgtactagcttgtcgaacaattagcggagtgttgtagtcgcaagtgccgcaaagggggcttatgcatttagttagcacatcaacattcattccacagtactctttttcctaaagataactttacttgttttctttaagatgcactaatgtctaataatggagttggaactcggaaccccacaaaatgttgatagtcaactgatgctttttatctttatggtatgaggcagttaattggctatgcatttgcagtgcagagtacaatccagatcagtatctgtgggaaccggagtttactcttgcgggaagaaagtacaaacgaatagatttggaggcaagtaaggggagctttttaaggccttctttctctttcatttgttgaagaaaaaatcacccttttactatatattagccttattctgttacttgtatatggcagcttacgaacggaagagaccagaccttaaaatgcagccactatgttcctgctgtcatcccagacaatactgcccttccttgtgtgatctactgccatggaaataggtatttatcatagttggattatgcttataggttctcaatttcttatattaatatgatcaatcttttggtgggaccaacattctgatcatagtttacactctaattcttggagaccggtcatttatctgttagttacagtctctgagttattgagatgaatcattaattttgttttcttcttgtgcttatcgtattccttacaagctctttctcttaactcaatgcagtggatgcagagcggatgcaaatgaagcagctgtcatacttctcccttcaaatatcaccctctttacacttgactttgcagggtcagggctatcaggtggagagtatgtcagccttggttggcatgaggtacatagtcatcataattttttgaaaacacactcttattgttttgcaattgcactaatctgataaaaatacaatcactctcagaaacaggatctcaaatgcgcggtgtcctttttgcgaaacaataaggaagtttcttgcataggcctttgggggcgatcaatgggtgctgttacaaggtatttggttaaagcgtttgtgtttcccagtttatgaccaattatccaatactttatttctcttaatgatacattattttttaagtctttggatacactagaatctttataatatataattcctgttgattatttgaattgttacttagaagtacccctgtccataaaatattttaaatatttaggttctatttatgtattgaattttggtaagttcttcataacttctgtccaaacttttgacagcctactgtatggagcagaagacccctcaattgccggtctggttttggacagtgctttctctaacctatatgacttaatgatggagcttgtagatgtttacaaaatccgagttcctaagttcacggtatgcttgtcatttttgcagaatagtcttgttcactgttactatgaactgaataaaggaaccattcgctttctggagtttgtatgatataggcacatgctttgatgaactttagcttatgcggtaatccgcaatcggtggtttatggtgcttggttataccgcttgtcaccttgttactgtgcttcagctgactgctgtgtgctgtgtgcatgacaaagaacatgtatctataattagaaaataatgtgtttacatccagaaatagtagtctttagggagctttgtgcggttcaaatgttttacaactctggttgcgcaactgtgcatgacactagctaactggtaggtaatgtataaaaggtaagaaaagttttccaaacttcagttcatgctctataatataataaaattctagtattttctggttatatatcaagtataggaataatctaaagttctagttagcgatgctagtttcatgttaattgtctgctaagttaagtgcctaactgcccactgactgttgcaatacttgcatcatataatgtttgctattatttatattgttcaggttaagatggctgtgcagtacatgcgccgtgtaattcaaagaagagctaagtttgatataatggatcttgatgttgttcaggtgtgctttctaaattaccatttgtcagtttcaatggaaatcaaagctaacattggtgtttgcctaatcacctcttctgtctccttattttacaacagtttgcccccaagacatttattcctgcattatttggacatgcatcaaatgacatgtttattcagccccatcacacggaccgtattcatcaggcatatgcggtaagtctaactcttgcttgctttacaaaggctgaacagttaatggatgcatgctaaatacatttataactcattttcttggtgtatttgtctacagggggacaaaaacttaatcaaatttgatggcgatcacaattcccccaggcctcaattttattatgattctgtttcaatattcttctataatgttctacacccacctcagtttccttcagtatgctcaaataagttagataagtactacaaccttggtgcttttaaggttggagctggaacaaatgaggtgattatcctttttttaatgcctatattatcagaaattttgaggaaattaccaaccaatttgcttgtatttttcagagcttactgtatgaaatcatcaatggtctaagggctgctggtcctgatgcaggcagttcatcggcagctgcagctaacttcacaaatggtgtgagtcagttcccttagtaggttattaaattgatatcatgaattatcattgtgatccctaagtcaattcctttttcattttgttagctacaaaatcagtggttgaattgctgacagagagggtcaatcagttgtctattaaaacagataatgacttggtaagttcatcagtggttggtttgcctcaagtacttgagatcttagctgagtatctccatctgaatgcaggattttcttttggatgaaaatcataacctcactgagatggacactcacactgctgagtctcatttagaggtaaaataaatgaggattttgaagcataaaatagtttttttttgcattgtaatttaacactgtgttctgtaaacatctttacatcaacatatggtatagttcccttaatgtggattaccatatgtttgttgttcctacaaaacaccaaaagcatattttgttgctctgctacatttgattgttccctgagtacagaatattacatagaactgttttgctatctcactgatacaaagtattacttccttttgtaggataaatctcacaggcaaaatgaggagtgctgctcatacacaagttcaaaccgagagagctggggaagatgttcttccttgggggcagcgagtgatggatcatccctaggcgagcgccctgaaattcctagtcataagcataaggtatgtcttctttcttttctcatttttgatgtccatctattgcatgaccatactgtccttttttcatagggtacttaccttagatatttttgttaacacatcttttaaatagatcctcaagtgaatgcatatgtcattttgtttgttacctactgaacctctcaaactagtgacattgctttgtccctgacaacaacggaaattttctattagatctcaatctcatcatttgttctgagaacctggtagagcatagaccgctacgaggcccttagagcaacacccactagagaacggataccgaagggaaatccgctcgctataccaaaggagaggaagaatcgactctatggaagaggctcaaacaggagaggcaagagatgggggagagcctaacccagcgattcaggctgtgcctccaaggccaggctcaacacaagagaaccaagtcatcttaacactgtgaatacacatcttaacacggaaatatccgctaggaacacggatgacacgaaggacaggaaatcacccctgattctgactcttggcgccaactgtacacncntnaaagaancacatcacttactgctcaactaagcctatcangcaatccttgtaattgccattttgtaccttatcattttccacgtttgattatgtaaatctgaaggcatgtactataattctagcgtgtgaccacccctggtctttggggtagtagttctagtagcctggtgcattgtttctaagatctgggtaggcttttgagttgaaactgtattgacaattgacatgagaacgtggttcgctgtggtgttggaacagtggaccgctctcattactgtgcccacagtgtaaaagtgtgaaatgagcatgtcagttgcatgaccatttgaagtagagaagtttcatctgagttctgagtcccttgaaaatgttcaattt

SEQ ID NO: 12458 - DNA, 995 bp, Oryza sativa
tatgggatggcgttacctcactcttgaagctgtaagagttagaagcattgccaatatcttttctagagtccatggcctgtaaagagctcttgttagaaactatcctcaggcttggcttcagaaattcttgcaactcatactttgacctgagatattacaaaactaactttgttcaatgtttactccgctatggaagtcatcaacttaagctatttaaatttaattgtatgagacagccttatacagataaaattacttattttaaagggaaacactactggcttgccccagtaattaaattttataaaccatcaaaaaaaagtatgagtgataaaattacttcaagtgattaggaaaaaaaaaagcttcgcacatttcaaattgaatgactagctagatatatgttgttgaaaactaaacctagcaactcatgggtacaatcaacaaaaatggctgatgtgtatttcataaatgcacctgatgaaatctgctctctcttcctggctagaatcgggatgtggcttgtgatagcctcctggaagaaatgcctcatagattgcattggcgtaagagtttccaccgacttctagcatggagttaatctcatcatcagtccactcatctagagtgactgatagaacctgtgtcaagtggatattgatttcaaccagaaaattcatttaagcttgtattgcctctagcaatattgaaaaatgttacacatttcctcgtatcattttgcagtttaaactaaccagcccatggttgttctaaatcttactaaaatatggatatcattgttatcatatcatggattcatcaagaaggtcaaataactttttttttctagttgcagcgagtgaaacctttgaaatatgcgtccccagacttctgtgaattccagaacattttaggcatatgaaaactcctatattagctgatctgtataggaaaaaacacatagttaatttaaaaggagtaaacaaaccatgttg

SEQ ID NO: 12459 - DNA, 699 bp, Oryza sativa
  unsure (1)..(699): unsure at all n locations
atatcctattatttctagaactaccatatatactctaatatctccccacggtccgagcgtgagcagtgtgaacgcttagactagagaaaaaaccgacgagagtactcaatacatatcatagccctttgtgccatagtcgacgtagccaaaacgaaggttgtgagggagccgtggtcgatgaagccgtgcgtagagtagccatgatcgatgtagccgaaatcggaaagctgatgtcggaggtagccgagccgcacggcgtgcatggggcaccatagagtagtcgtgagcgaggacgaactaaagatgatgacggtgacgagaatgcggtggtcgttaaggaagatgacaccgaagagtcgatgttgccgaaccgtggaggacgagacgttccgccgggtttgccagacccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12460 - DNA, 655 bp, Oryza sativa
tgtaaagagagatataatagctttggaattcaaatataccttgattgtatatatgaaatatatacttctccaaacctagatccagtatcgactaggggaatcgcactatggggagtttggccggcagtccgctagctcatgcgggggaccggccggtgtttggaatggggtacggtagtccgtggggaactacccagcgaagggtcaggactacaacatagcggggatgaccgtcggactatcgtgtggagggccaacacaggttgaagatagcccaggcagatggctgacgtgcgcgaggatgacgatggcataggctagctgatgaagtatggtcttgtggtggccggctagaagttgtagcagggtggcccgtgcaggctgcccaggtgaatggccacgacggcggcaaagcaggcaattaattgccagttggcagtcgtcagatctagaatcctccgaccggatctgaccactctactatgcaagcggtggtgttggggacaatatgaaggttgtcggtttggttaagttgggcactgagtctctctttgtagtatagtcctacctttcctccttggactcctctccttctttgtgttgagctcttactcgggatgaggtggcttggtctacagggcattgccttggccga

SEQ ID NO: 12461 - DNA, 1607 bp, Oryza sativa
ccatttttgttttctcagtacagcctgatccttgtggttatatgctgctggcacatagggcagcgcaccaaattcttcccgcattcataacaggtctgcgaatcattttatcaggcatgctgccatttataacaagaaattatgtagaaatagagaacaataaggggaaattttctgcacctgatgtccacatccaaatgcaagatcctttgatttatccatacagatagcgcacacctgaacccacacacaaaaaaaaaagctgcatttagtttgtaatccagtaagattctcagggtttagcacgaaattggatggtacataaaaacttaacactagaggtgtaggaactttccatgatctgcggattaacagtatgcccaaatgacataagaatgtgaaatgcaatagcaatattcagcataatgtagttatcagatcaagatcaaatgggccatttgaaggcacgatattttttttttcataaagggcatccgtgaaataagtaataagccaaatgaacgcaggcagggtggtcagaacagatagagcaatgcaatgcaacttcccctgtttcaattagcctcccgaaatgccacagtacgaacaaaataaaagggagactatttgttggtggtgtacgataatgacaccaatgtagtcttgcagtatatagcttaaactttattttaccaatgctacagtgttgcagtatatatcttaaactttatctattcaacatggtgtgaatataaacaaaaatacttacaagtcttccttctaaagaactttccgaggtataagtgtcaggtgcagtggtagccacaggctgtctctgtttgaagctttcagattgctgaaagccacttgtttgtgggccgaagctactagatcgtgaataaacaccagaatgttggtcaaagctagtagacctcgaataagcattcctcataggtggcggcagaggaattcttggctgtattctttggcgacggctgaaacgaaagaaaacgtgaagaaaatgttcaaatggatacaattgctgcaagcacaaactctagtacatttgacccagtgcagtcctgggaaaacatggattaccctagaagttggagatcaagtgttgccttgtattgtgttgggatttccatcaaggcggatagtgcaaattctgcctccttcctgtcagctgctatgctctttgacatgatgtccgtgaaattcacaaactgcatgaaagcaaacatttttacatgtctctattattgtgaaaaccacacaaaaataagccaatgactggaaattaaatgtagaacagtcacctggaaattgtcaaatgagcgagcaggtatattgtcatcaaactgatgcatcatgtcccatggtccatcacccaccccaacaagaacaatagacaaggggaactggctggaaatttatttcgaaaaaaatgttaacacgtgtgattcgggacatttgatttgggcagaatataccgatattaaattagggactcgatcaagtacctagcttttactatagcatcaatcgtatcacgctctgcgggcttaactgcccagactgtgtatcaacacttcgggctgcag

SEQ ID NO: 12462 - DNA, 731 bp, Oryza sativa
gttgggtgcatatactttgtacctctgagggtagaaaatcatggtacttattggtatttttctagaatggaagtcttctcttcttgttatcttattgttttttttttttttgggggggggggttataaatttttttttttttttttttttaatttggaaccaaccttacaaatttaatagtcgtattagtctcatcaggtcttttcttgaacatggtaggtgtatgattggatgacagagcgcagagatagattttcactctcatctagtgatatggcaatccagttggatctgattgcaaaagtacgtggtgtttcacatgctgaagaatacttcgaggagcttcctgatccattgaaagacaagcggacatatggttctcttctcaatgtttatgcccaagctatgatgaaagagaaaacagaagcacatttgagcagatgagaaaaaagggatttgcaactgatacattaccttttaatgtgttgatgaatttttatgtggatgctgaagaggctgagaaagtgtccatacttattgatgagatgatggaaagaaacgttgcttttgatgtctgcacttacaacatttggataaagagttgtgcggctatgcaagatgctgatgcaatggaacaagtctttaaccagatgattcgcgatgagactgttgttgcaaactggactacttacacaactcttgctagaatgcatataaagatggggaactct

SEQ ID NO: 12463 - DNA, 16729 bp, Oryza sativa
  unsure (1)..(16729): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnccccagctgccgcagctggtccacgaccacgccgccgccaccgggacgaaccatggcgtgatgttctcgtcgggaccatggctgcctgtacccgctgctcccggggatcccgttctgcctcgactccggctgcggcgccgccgcctgcgacgacgacaagcccgccggtttcgcgcacttgggctccgccgaggtgatcaattagccttcaatcgatctcaatttggtcatggtatgccgttctttaattacttgttgcttacaatcttggatctcgatcgatcgatcaggcggacacatcggcggctgcggccagagtggatagcgagattgctgcagctgccaccgcaaccacttgccatgggcctaattcatggtgagtacgatgatcgatcacctcgtcctagctaacaccttgaattgaggttgtagcctcctgttgattagggtttgatgaggtaataataggccagattgactgatgggcaggtggaaggggacggagaaggggaagatgaaggtgaggaggaagatgagggagccgaggttctgcttccagaccaggagcgatgtggatgtgctggacgacggctacaagtggaggaagtatggccagaaggttgtcaagaacagcctccacccaaggtatatatatacacgaaacataatacataaattgagagatatgcaacccctagaggttcttccacagctgctaatataattaacagaagtctaccatagctgcctccatagctaatatgctcgaaacaagatcagcgggatcagaatcgatccattgcctatctttttttcccggttacatggaagatgcataccagtgcacaccgttaaatatgtacaccaccacactcacacactcgcgaatgcggcccctaacacaagatcgaagagagggagaacagcgacaattcctattttaagtattaatttgcctatcttgaatcacatatatattatatagtttatctggggtgaggtttaactagttttgtggcaatatggttgtgcaactatagttgaattacatgcttcacaatagctataatattaaatggagaattgcttctttgttaatctttatagatcaaataaaagagctttcacaaatctaataacttgattacatgagtgcgaattcaccctttaaaagaagaaagagtgaatgcagatttttgtagattagttgacgactaattaaggatcagtttgcacctagcctactcttgctatgatgttacatgtgtgtatgtgtgtgtacactgcagattcctacaggaattatgcaagagaaatgtccaaatgcactagaggaaccataaaggaatatttttttaatagatgaaaagggggaaaacaattttaataacttaagtggatatccacccatctgtttcatgttaactaaatgaatataaaaattttcgaaaaaaaattgacatgatagattgatatatgtaatatgtcactccaccaacatgcaagtttaaattcaacttctacaagttataataaaaatgacatatttaacttttattattagacgtatattcatggcttgatttgttatttttggtataacttgtagaaattgaatttaaactttcatgttcgtagagtgatatattttatattaatctattttatcaatttttttcataattatttatttaacatgcaataaacggatggacatccacctgagtgattagaatccatctcaaaaaaagaggggggagggagagagagagagagagagagtgggaatgcatataaattttgaaaacgaggatcttgagctcaactcctttggttcttttttttttccaaataattccaaacatgatgtttgagttcatgtttagaacacttgaaaaatgaagaaaaggaaagatttcataggaatctgtccaaccattcctacaatctaatgatggggaggattcggtacttttcccacatattggcgaaactagaattcggcaatataaagggatagcgcacgagacctaacagtgaatggatgcggagacaagaatttggataggttcaggccctctcgataaaaggtaccctactcctattttaggattttacccgctatgtgtaggattaatctgatgatctggtgtgaatccctgtgttcatgccccttggagaaggcagggctctctgcccgccttatataggttggggggccaaggttacaaagaagaaacctagccagacacggcatcagtttcctaatctattacataatatatggatgtggcccacctcctatctctagtagaatatggaggccgtgtgggtacccggtaggccggtacccatattctccacacatattttccgcaaaatttcttcattcaaaacacaacatgataatagagggttcgtggatagatgatggtacggtgctggaatattgcttagggatatatatgctggcattgcatctacacagaaattttttagaggaaaaagaaccggtctgtagttatagaaattgtccaccttaatttgtgacacatcgatcatcttatgctttgaatagtatcgataaaacatcaaatagatatatgtttaattgttcagaagtaaacggtcgatttaatttgccatgcatatatctttggagtattatatgttttacacaacagttttggactgaattgcatgcatgtaagctgatctgattaacaaacacgcgcccatttctggcacatttgatttggactagaagatggaaggcatccttataatgacaaagaaccagaaaatattccaaaatttaactacccatttaatttattgggacttattttacagtaattagtcgtgccaagtgaatctagctaacatttgtatactatatatggcatccattaattcttgttgacaagaagcctgaactttatgcatcatgttgcatttgttgaccgaagataagtaacgagtagtttatggtattgaaaatatgggaacactacaaaatacggtctcttcaggaaaaaaaattcctaagtgtaatacgtcgatatatcatagatatcagtgaaatcagagacggatccaaaacaagatttaaggggggactcatttccttattacttcttcaatcctcctatttttcattttctccctatttttctcctttcatcttcccttttatcaacgatgatccagtggggcagaagggacttaagtccccccactacccacaatggatccacccctgtcagtgatcgaaactccatgtggccattctcaaagttcatatttgcatatgtcatgtgtgtttcatatatacactataagcatcagcatgagctggtgaactttgctgaaagagtataccatgcaataataatgcaccatgcatgccacagtatgatgcatatatttctactaaagaaaaaaaaacgagatatctagagcatcgaatccctatgctaattattagtatccctgaacacctgagtttaaccctatgttttggcacgggtacctaccgaaccagagactgccacctgattcagaaaagccgattttgaaaagaaaaaaaaaataaagccgctactattctcttttctgcttggtctaagttctgatcatgcgtcatctttatggcactagtaaaacctatcatgatttttgatctgcagcgctaggacaggcgcttgcacatccacctgtgtgcatatggatgcaccgggacaaatggtgcacacattttcagattgcaatatttttcttcagagatacttagtacccgtaagaaggggaagcccctgttagcagcttgtgcatgatttcttcctgtagtatatctctgcaatcctatggttttaggtatagtttgagtgataaaattgatatgcaagcaagcacataagtccaacgaaaacagcgtatattcagtgaaaactcatagtaattgaatagcagagctcctgcgtcacgttcaaacataaaaatgaaaactaacagtctaaaataccactccctccgtttattaataacggatacattcatatcatgttcaaagtttgaacaataataatttctatattattatgtttatacatcaaaagtcatattattagatttattaccgctaccattcaaaaaagaccacattttagcccatctcgtttgtcctacaaagacttcattttggagcaataaatgcatcggagtttgctaaagtacgggataaatacattgtagttttctaaggtgaaggatattctagcattttttattgtattggtatgtgcctaaggaattggcattttttcgggtcattttgaaaaacatttgtcctagggggataacactggaacgagatctagcccgattcgaggacaccctcgaagggaaagcaagcactttcgaaagcaggggttatggactaaacatagagtttttttgggatggggaaatagtatcatattttcataatagttgaacaaagtcatcgatgatatttattttcgggaaaatatttattttcgcagacacctaggtgcagacgggcaagacctccgcacgaaaaaatcctttttatagtagtgatcctagcaaaaaaaaaagaggggggggggggggtcaaagtatgcatgtcttggtcaaaactgtgagttacaccattcatgtctgtaattcgatggttaaggtggggcaaggcgcgggatgtgggtgttcgggttaaacagagccactatagcattattttttgctaggatgaccgaaggatttggcccccacacattagtaatggtgtaactaaaatgtcatcgtttaggagagaatgcgctactcctgcatggtagtaggaacttttatgatgttaaggcaagagaaagtagagaggaaaaaaaaaattgtttgttgattaccagacggcctgattaatagaaaactttatactatttacacatttcatatatgctatctatagaactaaagtatttcttatactactgtatgagttattaatttgtatatcgtctaagatataacatgaaaaaattatatagacaatagttcatgcccttagaagttataactctccatgtttcctagctatgaattgctctaggcgaaaacaatatttcctagtaaataaattgcaaggattttgattttatctatagcagttcacagtacttattaagagatatatggggagttctgttgtgagaattggtgccggtgtgcttgacttctagtctagtttcttttggatttacatgccctaagggtcttattagccccattttctcaatgtacaaatgatgcatgcatcctctctttcaggaaatggtggagctcttattagcctcattttctgaaagagaggatgcatgcagtatttgtccttccatatatttgagtattgagcccaaatttgagctcattattagctattataccccgtatgaaacttaattagtattcagatgtatgcatgatcagttacgagtcggtgatcatgacatgcggaaattgcgtacacattaaatgtttttcttatttgtgtaacacaatttttttctaataatatattagcaaaaaaagggttcatgtcaattaaaattgtctccccccttttttttttgtttataattaaccttgcccatttcatcgtacaatattcatgatgaactcttgctgagtacgtgacagcactagtagtgctcatcagtttgagcatgcaggcatgtcaccaggccagtagtgccatttcagatcagctagcagcatccgctgctgacgctcttcttcatttgtttgtgattgcagtttctctgtagcatgcatacaatgaatcgctctctctctcagcttgctgaccagtccgtacttaatctgtgttggtgtgcgcgtgtgtactgtttgtgtgcaaattgtgcatgcaaatgcaggagctactacaggtgcacccacaacaactgccgcgtgaagaagcgggtggagcggctgtcggaggattgccgcatggtgatcaccacctacgagggccgccacacccacaccccctgcagcgacgacgccaccaccggcgccgccggcgaccacaccgccagctgcgccttcacctccttctgacgaacgcatgcttatgtacatggatcggtgatggattattgttctctgatctgatggtggcaattgggaaatcgaagaagcagggatcgatgtaaaatgaaaatgtactaggaaagcttttagaactcttatggatgctatttaatttcctggtcaatcagctagccgatcgatcaacacgttgcatgatattcagtctaattatgaatgaaaatgtagtaggaagcttaattagaactctcaagtctcactcacctgcatgttatttcctagtatcaatcagctgatcaagttgcataatattcagtcgatcttaatatgaatgtggagacatgcatgctcctacatatacctgacgaagtaccaagcacagtgaacactactgctagtctagtctggcaatttggatcatgcctgcctgcttaaaagcccttggacatggctgctgcgaactgcgatgcatgcaagggcaccgaaagcgagaggcatatgcatatgcacaccttgcctgtctgtcggccatacatgcacagtcgcaaagtggtactgtatggtacgagcaacaccctgacgaatcagggaaggcacaaagctagcggtcgtccttccactcgtactcgtactcgcccatcatgcttgctgccatagccgctaatgattgtggaactgcacctccacagcgcttaaaacgaacgtgagctctcggacaaactcgccttcttcacatgttgtctcctctctgtctgatgacagtgtgtggtgactgtctgactgacactgcatccgtctctgctggaagaaacacacgttttcagacaggctaatgataggcgcacctaccgcgcgttttcagttgaacacttgcaatatgcaagacgattaattatgttgtagcaagtttatttaatttccagattttttttcttttttggccatttggccatttgtgctgcccatcttaaagaggacatgcatcgcaaatgcccagacaagcattttgttgcttccagaaaatatatgcagtaagaaatactcgtcacttttggttgtcaattactcaatttgcaaaggctttacttaaagcgttgcagggcagcacgagatatcgtgctaaaccactaagcatttttcatcaggtggcaaatataagatatcttaaaggtgctagattagccggcttctcagcgatttagtaggccagtgcccaatacgatctcaccacgtcatttgactactgctttcagcgggtttgcacaagacgatgggcttgcgagccattcggcccaaccgactggtcaacgggcccttattcgtcatcgtggtctgctgatatggtcttgtaatagtaagggcctgtttggtacaactccaactcctaaatataactccaggagttgagtctggagtggagttgtggagctgcctaaactcagctccacaactctagtacattttgtgagagagctccacccaactccactcccagttttggtggagctgaaagtgtttggctgagctccagctccaggaggggtggagctggagctggagttgtgccaaagagggcctaacactgatgaataaattcaagcatcaggtatttgggccttagggcccaactagctgagtgccactcgtgaggcctagtccatcatggcctggcccatctaagccacctagtaagaggctaagctaggccgggcccactaatccggatgcgtcaaccaaaccggactccgactcgagcacagcctcgccgatctggctcgaccaagccgcggaattccggaagcgactcgctctcgtcggctcgtcgcacgcgcgagcccactttgccggccaccgggatggcgccgccgcggccctcgccggcggcgaggctgctgagggagtacggtgagtgctctcctctcgctctcggcctcgcgaagcctctccaaatcagggctctgctgcggtggtgggagggtttttgggatctgatgcgtcgggggcactactctcgcttgcagggtgggacctgttgctcggatcgattgccgcgttctacgccgtcatggtgccctacaccaaggtggaagagagcttcaacgtgcaggttccggttccggctccctctccgttgagcatccgagtggctggattacattgtagtcgtgctttgtgtgcaattacagtagggattttctgttgtttgctcaagtagtagtgtgtgtccttattctctgttgctgttcagttactagacacgggattcaggatgattgctgataatttgctaatgttcattttggttgcaactggttgctagatgatattggtgtgcacatgtgaattgtaggatagtatgacttaacaacaatcagcttatgtgaattcatttacattttctgcagacacgcagaatccatgctgaatattgatgaatcgggtatctttgccgtagacatccaagatgcaccctttctatatttggtagttcatacatcatatatattatatcatgagcgttgaaaagctgaagttgctcaagttccagtgtcacctatgcaatgttaaagaagtagaggaaaatttgcaggataattatgagtttcaactttcaacccttcatgtctaaaaactaatgctttatgtttgataacttcccttaggctctgcgtgataatcaatttgaatgaaatttgctttgggaaattgtttcattctctactgctcatttatctttcctttgcctggtattgaatcttttacttgctaattcttgcctttttccgtttagtttggtaaattttttttacctattccacagtgtatgtttgcacttttactgtaatgccattacaatgtttaggctaacactttgctcatgtatgttctaggccatgcatgacattctctaccacaactatcatattgagaaggtaatcatttctgctagtctatcaatacaacatgcttgatgcttatttaatttctttcttcaatttgctgcagtatgatcatttagaatttcctggtgttgtccctcggtcatttataggtaatactatgttcacttgaagccttgatctgtgcactatgctacaatttttccgctaatgaccattgcttggctcaagcataatgaaatggcaagtagatggtcaaggtcagatggcattaccagtttaccacaatatactcctactagatatgcctgtagtgtctatatatggtatgactggccttgcagattttgtaatctggacatgacgcagatcattaacaccgtttactacatatattcttcaggagcattggttgtatctgttatctcatcgcctgcagtcttcgtaatgcatttatgtcatgttccaaaggtttatggtcttctagcaggtgctgtcaataacttagcacatgtcttcttgcatgttgtatctgtttttgttgccatattgatgttcttctattttgcccttttagttcggatagtgttgggtagtattatcctgatgactttgagacttctccgagttcaggtattccttttcacttcttgttctgtttaaaagggtttattgcaagtatgcactgtttctcagttctcctaggtactaccaatattctgaaaacgctgtttccctgaaaaggggtaaacctcaatccttttacctgtataaccttctcctggccttgaagtgcagcaactcatagaatggccaccattttttttaaaaaaaaggaaccttgcttatcaaatttggtttttgttttgatgcgtctgtagaaaaatttttttttttatatagggggccccccaaaaaaaaggggcgcctccccttaaaaagaatggcatggtcgtcttgcctgtggcatacatgctgcagtatgctagccttgtttgaatcttctttttatggcttggtttgggccatatacctaacgatacctttcactttgtgccatttatattccattcaaatatggatagaagagaacttaatttttgtttttcatatctcatgcacaaacttctaagtgctgtatatcatcaagatatccctttgggttatgtgtttatgtcaaactgttctatgcccatcttgagtaacatttgttttctataatttgcactgaatcgtcccgtgagcacgagtctgttattctgtccttggacaccataacgtttttctcagttcatttctgatatacaggtaaaaaggaagtttggtcatcatgctgaagcattctatctgatactaactgctacccagtttcacttattgttctactcaaccaggccccttccgaatgtcttagctttagcttttggtgaggacattgtttaaatcaaacacaagtctgttcgagtgttactgatttttgtgacactattggcagtagcattaatcatatgtggggtttgtgtaataatcgtgcaactcattgtttctttctgtctcgcagttaacttgacatactatttctggttcaagggaaaccatcgacgcacattacaggccctggtatgctaattttttaacacttttaccttactttcacaccattttgtttgcatgctgctgttttcacatttttgtatacactgcagaaagcaagaatttatttcaattcgagttccatatactgttgaattcaaaatttgacatcctgcactgcacacaataactcgacagaatctgagttccggacatgacatcgtaggctgcagagtttgaccatgaaactgagaggttctttcttgactattcgttcagttcaatttctttggatttactaaattgagaaaggattctcagttattaatttgcagaccaataaagattacaaattggttttatagcattgaaagatcctcagttccgctttttccttctgaagtaattctccatattgcttgcagattgtcgcagcagttatttttaggtgtgacatgattttgcttcttggtacaataggacttgcacttttgctggtgagtttcacctacaaaacctaaatttctcttggcagttgcacagtcatttcatactcttttatgtagtgaatctttgaggaagcaagggtccaaagtttatattactcatttttgtaggctatgcacaaatagctcttatctcgtacactaggtacaaataccaattgtcaatactctctattacttcccaactttgtgtttgttcaaattcaatgcaaagtatctttgtcatagaatcataagggttcatggttcaacccgatttccggttttggctctcatcatttgtgtctctgtagtgaattagtaaacttgcttgaaggaccatgagggactgtggttaattatctctataagttatttttattgaggcatggctaataatctctaagtgagtaacttggtatgtcaccaggctattaaaatgatacactcacttatactatcatatatcaagttgttatatctatttggactttgtatgtattcttctgcttactttatctgggaaagttggggctgaggtgcaatttgactatgctgtgacagagcaggtctatttctctattggaagccatccaatgctgagggagcactgccattatatgcattggtatgaagctttctactctcttgaactttctccaatagtctaacagaagtctgtgcaaatctgcaagaaacatttcttactatgaatatgttcttagccttcactgtactggttgactctatactgtggcggagaatactgcggccagaatttaaggtttgtgggttaattcagttctgaaccggagttcagagtggggtgaatcctttttctatttgtgtgcatgtgccaaactgcagtttccttttttttttaataatatttcaagttaaaccttcaagtgcacaatgaaacaccgtttttttcctctttagccagaattttattcttttttcctagcaaatatatgcatgtgttctctctttcactaagtcacttcacggagacattttcatatgcactcctttctctttagccagaattttattctttttactaccaaatatatatgcatcagttctctctttcactaagtcacttcacagagacatttcatatgagaatatgcaaagcacatatctttcgattaagattgggaagattgaagtttcattttcatatgcactgaacatgatgttaatctctattagtcacatgaatacaaaaaaggatgcaacatatatacacttcttggtcaagacttatcctcttcttctttttagattcatgtggtgaaatctatgtattatctcctgaaacttatgcgaagctcccagccctgttatccatgactaccataaactttagacacattccatccattggtacttcacctcagcacttccacgctccatgctggtagcatatcctctttgcatggtgagataagaaacttccatacaagaaattgtgctacttacgtggctaaaaagtgcatgtgccttttgcttgaacaagtatataacttattccatgccttcttatcatgtatttaatatgcatgaaacatgatgcttagctagtaatagttgattggcttcccatctctacatgtactttatatcaaaactgttacttcatactatttgattgagtcaactaattatatttttatgatgtatcttttctgatggtggtactatcaatgcattattggttattgttttttttatttgattttttattggaagtaagaaatgtatctcatgaagccttttcagtgacaggtcggtgctcttcttgacagaaggatagtgccatacatacttccagtcttctcatttgttgtgctttattcaaagcttccacataaggtatctctacatctcttgatactagttccatccttatatttggccattcttgtacatgatgactgatgttgtgtttcaggagcttcgcttcattatggcttcgattcccatgcttaatgtgtctgcttcactagcagcaagcagaatgtgagcataaccaatcttctgtcatatctagttcctactccctctatttcacaatgtaagtcattctagcatttcccatattcatattaatgttaatgaatctagacatatatacctatctagattcattaacaccaatataaatgtgggaaatgctagaatgacttacattgtgaaacagaggaagtactattttatcaatttactgatccaagctaggaatgctagcttcattatcagaactccttttatttcatacccttcgtattgaatggcgtttcctctctttctttgctttgcgatttcgacccgtgaatatatgtttgtctatcttcagatataataacagaaagaaaactgggtggaagttactttatgttctcatgattggtggctttctttccaggtacaataatttaaccatggttatattgtaaaatattaatatggtatcctttttcaagtagcacaatatatgctactgttggaaactcacatataattatatagtctaggatactctggtgtaactttcatggcatcctacaataattatcctggtggatatgctctaaaggctctacatgaagcaggtgagacctacataagttatgtggaatacgtgaaattatgatagttttcttctgttaacaaaactgcaagggcttggctgaaccgcaagcagcacattacaaattgaacagctagtagtgtctcatctagtggtgtctactgttttagcgattatggggtatgttgacaataatatctttattgatggcacatactattggttgcttctcttttaccagattctgtaatgaaggacaaaattgttcacattgatgccttcactgcaatgagtggagtttcacgtttctgtgaaagtgaatatccttggaggtatcctctgtagtgttttatctttgttagtatcttttatcatgccatttatgagcatctcaaaatctgttcactggcagatattctaaggaggaaaaaatttccatcgaggaatatcaggaaagaaatttcacatatctgctgaagtaagtttacttacttcctccgtttcacaatgtaagactttctagcattgcccatattcatttagatgttaatgaatctagacatatgtatgtatttagattcattaacatccatatgtacgtgggcaatactagaaagtcttacattgagaaaccggaggagtatttgcttcaataccttatgcacttatttttggtactatctggatatttaaagaatgaagcggacttttgcaagcaccactgagaagtggggcctacatatatggggagttcacctaatgttggaaaagtccttgtattacctccatgtttgtttgagtagaagcaaattaccgaacaactcttgttaccatgcatgaataaatataatcaaaggcacaactggtactcatttcacgctgtaatgcttttcttatttcttattgttgtaccaaacagtgaacaccgccatatcagtggctacaagtgcttgtttgccgtggatggattctccagagcgaaaattcaacctcgaatcccactactctcactggtacgctatcattctttacagagtagctatctaccttatcggcatgcagattacatactccagccaaatgccagcattgccatcctatttctggttctgtcaaacattaaactcacggtggtgattgaatactggctctggtcgctaacctcagcatttactgcaggtgaaagagccaaaagtgtttgcacatgggaatacgagagaccctgatattctttcgctgaattggcccggttgcccttgaggtgaggatactgatcggatctctaccacaggaccactaactgccaattgtgaagatgcccagcctgtgtaaatcactggatcaatcgagccccttcccaaaccccagctcggaagatactacaccttgccacctttgggctattcaaggctcacactttagcgcaaaaaactcgcgtttttatgttgaaaccatgtgcttcggtttctgacctagttgctcgtatctggtggccaaaaggaggggaaaaaaaactgaggaataggagagaccataacaatcttgtgctctagcaagttgctccatttcatacacaagtaccatgtatcctatcttacattacgtcaacccacttgctgtatagcgtgactcttggccgatgacatctccgtcgcaccattttccacgcattggccccaggcacggagcaaagcccgttggctgtaaaatcatgcgagatctctgctgaagaaagaaaaaaaatgatttgttgcaatgatggatctgtcatggggatgatgggtctcgagttcttattaccggcattagaattataggagtctcattaaacttttcattaaaatatattgtcatatggagtattcattagaagaaagggtataggcttatctactttattaagtcccttctagtccttcctagatccgcccatgattcgctgaaccagtgattcaatgtgtagccgtcgacaagcttgcttggaattaagttcacaatttcgatcgaatttaccgtctcattgtggctcgcattttcaagttttcaaccgcaagcccttgcaaacggccggcgagctaggcggtggccggcggagcgagacgtctcggcggtggtgtcgccgtcgtcgtcagttcgtcgcttgggacgacggaatggaagtcgtcgtctagattgattaggacgggggagatgtcatgggctggccgctcatgggacaaccgaaagtaaagcatcagcaccagtaccagtacactactctactcgccagttgccagggtcaaggaaccgggaccccaccggcttcgattcctcaatcctcaagcctgttatcattattcattctcatcatctcatggacggtcgcctcgccattagttacgacgagcacatagtccctctcctcccgtttttatttctcgagctaattcaggggagagagagagagagagagagagagagagagagagcagcctcagcctccatccaatcgctactggccggggtgaacccaactcccgaatttggtacttgcaattctctactaataataacaaatggtggcatccgactcactggcgagagcgagatgagatcgagtccctaaccaccacccaaaaaagaaaaaaaaaaacgcgcacacacacacacgaggaaacatgggttaactgaactcctccccctccccccggatgctttacgctttacggggggatttatgtacgattgattatacttgttttagttccggctcgggtcacatgacgtggaaccaacacagaaaaaacgcaaccaacccaacccaagcgggcggcgggggcagcaacagcgcccgcgagaaggcacgtcgcgtacggggcgcgcgggcgcatttgatgcagaggtggtggtgcgtgtgcgccttgggagggagtcatgtgaggtgcgggggatgtaca

SEQ ID NO: 12464 - DNA, 8194 bp, Oryza sativa
tatccatccaatccaagtatctaattaccatcttatgaatcagcaccgtctcatcgtggggcccaccggcttccagggagcaaaacttttcttcctcttcttctgtttccttatttttgcatctttgtaaacttgccaacacaaagagatttttggggtgcgtcatgtgtatatatgcattcggtggcctcattgcgtactaattaagaaaatggtcaccggttcccgttttcgttttcagttggcctcatttgtgtgaggcgatagatcagagagccagtcggcgacgttgaacgtgttgatggtaacacgcacgcacgcaccccttttgacccccatcaagaacatcacaagaacaggtgcttccatgtcaaggtaccgcgctttgactgatggccacctaactgggagccaatagcaacaactaaataaagcaggtacaatagcaactataaatcagctataaatatattttaaagagataaaagaagagagagaagagctgcgggctgtagatatatagccagctgtagcacggactccaatacgtaatgtatgtatgacatgttggaccaactattaatagtgtagtaagcaactattatatgaattgatattatattaattataaatgatttggagttagtagttggctatactattaaacttgctcttactggcggtcattgcaattagcaaagtgtgaattgaattaacatctgaaacttcgattgcaacttgtagctttcccgggtcgtttgtgaataactcggagcataggaacagtggagcttgaatgcaagaccggggataataccatatgatgcatacatatcaaaacaagctctttggaagagtaatcactaaaataaattcctttgtcatttcaaaccttactaatactttgctaatggcaagatttagcgttgccaagaattttggcaagaaaaaaaaacagtttatttcagtgactaatcttcgtataatatattcgtagcaacatgttaggtttcaatgtttcatctaagtttccatgaagcttctcccccttcctatctctctcagtatggaaaacgatttgttatccaaaaagtataatatatatttttactacaagggcaactctcgaaaaatgacttagattcccgcggtcggtctttcccgcggtcggtcttgctagcccttctcctctagtgtcctcagctcctcgccagcgtcctgagagggaggggacttgatttttaaagaacggcttgttttaacttgacgctaagttttccccatagtaattggttattgtgtatgcatgggaaatgagtttgctctaatcctcctttgccgataatattgggtttactatcctcgttagtcactataaaaaaaaccatctttacatatatcctctatttatttttacaaatagtctgaaatccttaaaattggagaccgggccggccgctccaagccacaacacccttatccctttgcctccctctctccgccctcctcactcccctctccccctgagctaataatcaaagtcatatgctcccttctcctcctaggcaccactgccgacgtgcacccctgtcatcgcctcgatgtatgtgtccccattgtcacctctttcctcatgcacagctacgctaccaccaccacagccactgcatcagccaacaaagaggccagggccaccaaatctgatgacactggctctcctggtagtgggttcggttgggcgatgttggacgacgatgagccaaagtcgggcgcaggcggggaggatcgacgaggaggaggagcaagactgtggtaggactcaggaccgtcaaatatagtggtagaggttcttactagcgagtgttgtggcggcagtagtcctcggttacttggcgacgacgactatggcccagggaggtcaaaaatggcatatcggggacgtggatggctgcttcatgggcatctagcgtgagcttgttgaggagtgcgggttgctgacccgagtggcgcggccccggtgggttgatgacggtcgttggtcctgggcgtggtgacaaacgcaactcagtgacggcgatgacgatgacgaccgtaactacatgttcttaggggatttgtttctctttttcccccaaaaaaaatgagaaaatctattctataccactgagtttgttcgagttcaacgatttgctatcgatattatctctttctataatatactggcaactttatcaattgttctacgatataccattaggctgagccttctttttaaaaataaccaaaatgacctaatagacatacaaggttaacaattaatttatctcattagaaatttcataaaaatatgaaaacttttatgtggcctccttacataacatggaaattcgtatagaagtttcaagttttttacatttcttttttataaaaaaaatataatttatttgttatatgccatataaaatattttttattattatttttaatacaagtcatctttcataaactacataagatatttttgtgctattatctcttttataagaagatttttctctcatatacgacataaaaatatttttttacgaaaattaaatataccagaaaagactcgaaacttgtatacaaacttccatgttgtgtacgaaggccacataaaaattttcatatttttatgaaacttctattgagataaatcaattgttaattttctatctctaagagtactttgggtatttttaaaaataaggcctagcccaatgacatattatagaacaattgataaagtcgtcaatatattatatattatagaaagaaacaatgtcgatggcatatcattaaactcaaacaaactcggtggtatagaatggattctctcaagaaaaatcatctctgcatgctattggcttaaccttgttgcttgtgaaaattgattttcataggtagttggcttaggctgcgttcgaacctgaaggttcccaacctctctatctcattttccatgcgcacgcttttcaaactaataaaccgtgtgttttttacaaaaagtttctatacgaaaattgattaaaaaatcaaattaatctatttttggaaaaaaaattagctaatacttaattaatcacgcgctaatggactgctccgtttttcgtgcggagggatggtttcccaacccattctatcgaacgtagccttaatctatccacctatgaaaatttgattttcatagatagttgaaccccacctatgaagatcgttgatttttacatgcctttgatcataggtggtgcgctcggccatctaaaaaacttattctgaccgcctgggatgtgtgatttcgttgcagcgtgtagcaccaatataggtatgttgctaatataacttactgaacctaatttattatattttatgatttagaaaaatactcctgacctattcctagtagtattggctcataaaataaatttaactttgtaaatttcaatccccgttacaatatacaagaatctcaatagtacaataacttcaccgtgtttcctttctagacgtaaattcaacatatctcgttttaatacgaaaaagttgagcaatttgatggtgacaatgttagatgcctgctggagcataaatctggactagatcgatagctagatagccgaaccacgaaaattgaagaatgtggtcatgatgtgagcatacattaacaaggccaaccaaccaacacctatacctcttggaacaactcaactcctagtagttattaatttccagacaacggcaaatcaagccagcaaccagcgagttttgaccagataccactctgtacgtcgccgttctgtgcacaccagaaacaataacaataataatctattaattttgcgctgtactctctgcaggttaataatacttatcgttttttataagggcacggtctctaaagaacaactttaaccattattttttattataatatgtataaaagtgttaacaaatacatgattttattaaagtactttttaaaactaatctatacatgtaatcaccatatttgaaagacaaatattttagaaatgatttataatcaaagattcgagtttaacctcactcttgtttaaaacgataactattatgagtccggaggaagtatacgtagtaccgcgggtaaaataaatgtaaattgtacacttagatcttcttccattccgagataaatgcgagctggattaattccctctgcaacaacaacagcaaatttccttgctaattctgaagagagtgacactgcacgggaagctcagctcttccgggcttcaggcacacgcaggaaacggattggtctccctgtcaacgaaagctccgagttcccaacttatacgcaaggaaatgagaaccctgctttccacagcttgaaagttctcatcaggctttgcaggctcaaacaaactcaggggatatttagtaggaagcaacctgtggttggcaccttctcctgctatttttgccacacttttacacttatcaagaacaatttgcagaagtaaaaattgaataaaatgtaccatccccattatttcctacttattgctttgattatcaacattctccaatacaaatgtttatgaagctactattagaaatataaccatataaaaatatttttcatgacagatctacctatatcatttattcatttttctcaagctaaatcctaatatctctgtattcacgagcataaaaattaccattgaattcgcagacgctcgcgtcgccctcccctgggatggcacgggaggcgatgaacccggccgcctctttcctcccactcctccccctccgcctcgccgccgaccgagcggccgccggcaaagccggccggccgcaaggacggcggcggcggggcctctctcaccgacctcgcttcgcttcgggcgagcaaggaagcgtccacgacggggcggcggtgaccgccagatccaggccgctccggccagatctggcggggtggcggctagcggcagggagggcggcggcaaaggcaggggcgtgcggcgccgggcggtggtggttgaaagcggcggggatggcgatggcggtagggatggcgtcagccgagggcgcgaaggtggcagcggtggtccttgtgcggcgacggcggcggtgtcccccagatccgctcctctcggccggatctggagggtggccagtggtggtggtcggcgacggcggtcgaatcgcgacggctggcgacggcagtgggcgacggcggcggcggtggtggtcgcggcagttggcggcggcggcggcatcggctgacgatgccggcggaggacttggcggcagcgtggcggagggcgacagcgaaacggccgctggcagtgtcggcggcgattcgtgaagccggtggctggcgtcggtggcagcggcgactgcggctgacttgcggcggccgtgactgtggaggcggtggtgacgttggcagatgagggttgctggcgccggcaagtggaggcggggaaagagtcggctgcgaggtgaggatggcgacggcgaggtggctgggcgtcgatagcagcggctgctgtggtggtggctgcgactgcggtcaccggaggtatggcggcctcggatggctagctgagggcgtgggagacggccgtatttggccggtgcggcatcgtttggtggaggggtcagagaccggcttggcgcagagaggcgcaaccgatggcagcgaaggccggctcggcgcgagaggcgcgattggcggagatggaggctggcttggcgcgagaggcgcagctgatggagggaggctggattggcgcgagaggcgcgtccggtggaggaggcgacctaggtgtgaggaggagctgccggtgggtgtagcgcggtcttaggcgcacgaaggctggccggccggggacgccggtgcaggggtcccacatgttggcagagtttgtgtggtggtggagcatcggtgcatcagccgtggatttgcaggtggtgagtggcgggtgaaaactcagttcggccttggccggactgacaacgatggttcattctccctcctgagtgcgttgtcgtgctgtctcagccctcaaggatgattgtcgggcgaaagcccagtcttggctcctttgagtctcgacggacggcggcggcggtttttccttcacttctcttcttgaagacgtcgttttggcatcccctaggaggcgatctcgtctgtgtccctttgttggtctagtggcggtcggtcacgcttagcggcggccggtccggtgctagccttctcctgggcttgtgtgttggcgatgtcggagtgtgggtgatggtatagtttttttcctttttcctggttacgaccctccagggttgtaatcttgtaattttttttcttctctatcaataaaacttcgcatcgtctcgtgcgattggttaaaaaaatatctctgtgttcattaactattcaaatttttaggttgactgcacgtatttaggacacaatctatttcagaaccgatgtaattactgtggacgaagtgagcttaaaaaaaatcagtagaaatggacagtaacagtttaattatgagctgggtaggaccgtaggagagagagagggcgaggaaagcaaagtgcgagtttggtggtattttcctcgcatcgcatggcatgcgttcgttcggacggggtgacgaggtgagttggcaccactgcctcgtcctccccctgttttgatacctccatttcttatcccctccaaaagagaaaaacaaataatacaatcctatctatcaccaaggaaaggagcatgctttgctaggtcaacaagagtatactacatatatgcaccaaatattctctctctctatctctctttcctgtctgtcaccgtctcttctttggttcttctatctgaaattctgaatgaatatcttgccttagctgagctaacctaaatcatacccacaaagatgggtacaatgaacagtcacatgggtgatgaatgatgaatcccctggtttatctgccgggtcttgcgaggttgtctacgggcttaattaaccccgccttcgagataaggtggggaattcattaggaaagtaaaaatggtacgaaaaaggtctatttgtgtttttgactttaaaaagatgtgactcagccctgaggcttaatctagcatttttagaaaaaatgaaaatgttgaattctagtattgtttctgagattttgttcaggtgcatctggattgatttgtggctgaaatggggtatcctgatgccattttgtttgcaactaattttgtttggtataacatgcaaagtttagcagcaggctgacctgtgccaactaactagtagcacaagtgtgttaactgagagatgacctttttttagtggggacgcagcaagataatgccagcatgaggcgacctccatgctttaccgtttcctacttttcttgagttgttataagaattttttttggctaatttctgatgcaacctttgtctcgattgtgtcatcactggatttaagtatcgcctggctgttccgatgtgaaaaaatgcgtcagctgagctactattcttggagcttagctagcacttgtcgatgctcttaagcgatgacgatgtggttattattgacctagtgtgatatggccatatctttgctccttttgcatttaattggagataatggatgggataagatgagataaatgggcgaaagattctaaaagaatatatgtaagtgaatgaattctaaggcattgtttaatttggaatggatatttcttttttaatccctgaatttgtgtggcaaagttcaatctcttgtgacctaaaatgtggcataattaaattagggagcaatataagcatgttgggtggcatattggcatagttttaggttatttaaaacataccagaatgaggagataaaatgcatgtttttattatgtgccgtttcattgctaaatgagaattgcccaaaaacctgaatggaatttcttttgcatagattggaatcccgtgcaattaattttacaaacaaatcaaacatgcggtgtgagacatgtgcaggttgggatttggagtgctattgttatctttatcataccatagctgcttccaccaaaccaatgtagtagtacgctaagccgttaaaaaagaattcctatatattcaagg

SEQ ID NO: 12465 - DNA, 2275 bp, Oryza sativa
cttttgtgtttactatttagtccctggaataatgttgggtctcatattctatattatattctagagcaccctcaatttctatcttattcccgtctcctgaaaaaaaatatacatctatttatcatataactatgaaaattgtcacaataaaagtgacttcgtaaaaagtaaatgcaggtgctcacatatgtatatagggttattgttacattaattttttttgttaattgcattcccatgtattactggaatcgaaacaaataggctatttggcgcttttgcatacttcctaccggcacacatccaaccgttcatcattatgtttttatgtggcgctatgaatcactttacgtctattaataccacatttaaatatacatgaatacattttcccgcgctttatattacatggttttataaatcggtacataccgcacctattccatcaatagatgaatgatttagaaggcatgacaaatatgatacatttcttcgataataaaaatcaatctaaacaattattatacattgtattgtgcttgttaggaacgtcgttttaacacatcaaaacaatcttttatgcatcaacctcaacattcaaccacccctctattgagcttgtgttgggtgctctacacaaacattgttgttttttttttcgtaaggggcgaaatgcaaaggtcgtaaggaaaaagattcttccaatggcaccagaaatggagggctttaaagttaatcaaattgactaattagtgctagatatgtcctgcacttctccttagtcatacccaagcaacaataatgaaatgggattgaaaccacccataatgaaaggctgaaagaaactagaggagaaaagaagtgctggcctttgctgttgtatagcccccctctccttttcctaccttgcccagttcctagttgcttctctctccctcattaataaaaagaaatttacaagcttctaaactatattttcttttggattcctccccaatggctttcacccaaagactcacccggcctttgtaaaatctcctcccttccgtctgcattccttcctccattatttctccatccctttcccctctcctccttaacctctaccttctctctaaaagactggatacagaacaaaaaaaagggaaaaaaccgaaagaaaggaaagaaagaagaacacctccccagcaagtcttggtctttgagttcatgggctgtggaattgttcccaggaatcccctctggctctgaaaagattcacaccgagcaacagttctttgatttttttccccctttgttttgctgaagaattgcttgtacagaactgcttctttcctgtttccgcttggttttccggtgtttattttgttggaattttcttgggccctttcttcttcgcttgtggaggcgagggagaagagaggcatgggaaagcaaggaccttgccgtcattgcggagtcaccagtgagctctttttttctttctttcataaagttagatttttccttctgcagttctttgtttccttgttttagttctgattccccctagctagtttattttttaggtgatgttttctcccaattatgcatctgggaagagtcttagataaaatcgcaaaaatcttcagaatccgtcgggctgggattcctaatcctttttccctgtggttccctctgtttgttctctgatgattattagctgaaattcattgaaccatcagaagctgtcaggagaactttgtggatatggttgaggtctcggtgtcctttgggtgtaaaattctggacaccaggaacagattatttgattcagatagacacatctagacttgtttgaccatggcagatgtatgctgttagataatttgacagataatgcaataagatgcagttaacagtctattgttcaagataaaaagaaccacctgttttgccaatcagacattcagagtttcatagaagctgcaactgcagaaatgcttgctgttaggacagtactaaagtgaagatctttgctgtgctgtctagtttgcacaggctgggtcttctctttgcttaaatctcagcagcattataagttctggagttcttagctcttcctagaacagctgcttaattgaaatgatcatctgcatttagtatgcctcaccttttagattagcaaatgaacaactacatggttgtgctaaatattaaaaataacgtctgaaagatgcaatttgagtatgtatgtgactaatcagtaatcactcactgtcactgacaaattatt

SEQ ID NO: 12466 - DNA, 16489 bp, Oryza sativa
ctacatggttgtgctaaatattaaaaataacgtctgaaagatgcaatttgagtatgtatgtgactaatcagtaatcactcactgtcactgacaaattattcttctaagttcccttccctgatgccatcctatcctgtagcttcacaagcatgattcttctaaatttgtgataagaattccttatggacactctactaataaactctatacttgtataccacacatattactgcaaatcaattttgtactgttacttatgggaaatgatggaacaggtactcctctctggagaaatgggccaccagataagccagtgctctgcaatgcatgtggctcaagatggagaactaagggttcgctgacgaattacacaccaatgcatgctcgggatgatattgatgctgaggaacctagagctagcaagctgaaacctccaacattgaagctgaaggaacagaagcaactgaagaaaaatccaagccacatcacaatggagaatggaccattttctgatcaaaacttccgtaagatgggagatcctgacctaagtaatcgatctggttctggatcagcactatcatactcagagagttgtgccccctatggcactgctgatgcaagtgaaatgactggtgagtgatctccaattccctggtgtgtttctgttaaaacattttttgttctttccattcttgatgtgtaccatatagtatatgatttggttcagttcaaacaaataatgtttaaggaattgaacttgagctttgagattgatgtcagaagtacattgcttaacatttgtctccaatgtaatgctcatgcagtgctaccctcttataatgcatatgtgattttttcttttcgttggacacaataaagctatcggaaccttttttttggcaacccctcttcagtgttggtttattctttagtccagcattatcaattcataataacttatgctgattgttatatcattaagaaatttgtccatgcattgtgttcagatagcatcaagcctataatatggtgaaaatcatgctttagtaaagaccagtaatccagtacatatgaaacatcattaataatatatgtgtttctatactacatgttagtatgatgaagcacaataaaggccctcagaaaagggatattactccaccaaccataagcattagtttccattctcgaggttccgtatgtaactaaagaattgttttttagctgttctcttacaactttgtttgatatattaataattttattatctgatatcttgccaattcagcttcagcacaatcacatgcttgggaatcacttgtgccatcaaagagaaggagttgtgtcactcggcctaagccttcacaaatggaaaaacttgcaaaggatcttaattccataatgcatgaagagcagctactttacctttcaggatcctcagaggaggatctaatttaccatagtgcaactcctgtggattcctttgagatgggatatggaagtatgcttctcagaccaaattcaaaatcactggaggaagaatcagaagcaagctctattcctgctgataataagtcatatattactagtgaatcttactcagggtcggtctcatttgtatatagtgaaagcaaggcaacaagcaaccaaaatgttataactgaacagccaaagaagtttctggtgcaaacatcagataatgctagaaggtattttacatccttattagcacggaagtttatattgagtattagtttatattgagaattgttgtggaccaatctaaggaagtttttgtttgggatgtctattttggagggctaatctccatactgaaaatcaggatactctggagaatgcaaactcacctttagtttccctacatatggaggtatccagcttatgtatctttttcttgctcagttcaattatcggtatatgtatttttagaacatgtctaacctgaatatatgatcttcaaaaccttggttgcacattttgatagttgtttccctttgtacagggaaaagacagtgaagaaacaagagtaaagaccagtgcttcaaatcgccttacaaagtccaccatgaatcctctgaaaaggcctcatgacacccacttccaaagcttcgtaggtcagcagcttctgacctgcatatactgttacttatatttggaaaaaaaacaaatcctatatattcatttcctatttcgtccttagcttaatgtaagtgaaatggagaaaccttctaactttattatttttatctattctttctttttgtgcatacagaactaagaggaaccatgaggagtcctaaaagagtttctaaatatggtgatgctatgggtctaaagtgccaagcgtcgtttatgccgaaaccaggcaatggcaaagatttagcctgcagtgacagagcacttaacttattcatgttacccccggataaactatccatgctggttccttctcagtatgccaacactgattctgatcaagacctgttgctggatgttcctcttaatgctcggcacccagaggccgagcttctttgccagccatctcaactgagctcagtagcccacagctccacctcaaaggctgggaatgccggaggagaggggcgccttaagcagccctagttccagttccagttaacaagcaacttaggaacaggaagtacctgtagtttactttagtttccctggatcatggttccctttatttaccggccactgatggggcgttctgcggtttgttcatgctcttatcgtcgtcgccctggtttactaggcaatgtgcgtctgccaagttggcaaaaattgtgtgttcagctaacacttctagctgtgcttttggagtgacttgtgcttgtttgtagcatatggcttttggagaaggtatataactcaacatggctgtatggaaaacaggtaatctccttatgggtaaaatgaaaaaggaaagaaagatggaagttattaggagttcatgtatgtgttgcaatcagtgttggggtttgctcacttttttttacaattgagcaccatggtgtcttgatggcaggtcatcttgaacaagaaatttgagattggtgatatcattgatgaatggtatgtacagttgtacataaacttggttcaaaataccaacatcgcgtgtgatttcggtgacgctctcgtcaacaatctcccaaaatttgaagttactgcttggcttgttgtggttcctcggtcatgtttggtttccttgctcggtatgactttaggcaaattggacaagactttccttgcttttgagtctctcctagcaatcttttccttgctcatcgtagctaggcaaaaagtctaacatctaagctcactgatgttcgctactccaccaatttttcatctgctactctgcctttcaacgcactttcaaatagagccaagacgatgtggtaggacgcaaggaccacgaaatgacaactacctttgacaagggttgttttagatgtgcatgaataatttctttaaaaagaaaagctgaaactatatatttagtaagtacaaaatgttcggtaattcggtgatggttagcaaatcccaacaaaatgttgcttagtttgttggtaagagagggagtatgacaaattgacaattatctagaaaaagaggaattttacggtcattgggaggtattaagaggtaccaatatcttttaatgcaaatttagtatcttatagtactatagagatgtaccaaatttagtaacccccgttacctcctcatgactgtaaaatcactctatacataaaggagggagtatgacataattctccatttttggcatatgttcgtcttgatgataaaattttagcatgagttcgttcaagtttgctccatagttcattccggatccagcatctcatttatgtaaatcttttttttttccctttgtgcttggctcccaaaatttggcaatattttgttacagttgctccctagcccagttttggctcctgcgtcctaatcagaaatcactctcatcctatccaaaccaataatcaggacgtgtaattataattgacgtgtaattataatcttcctgtaaccattttttttgtttgagtggaacgagctttctttttcagataggaaactgtaattataattgaccgatagtctaacactagtagtctatggagaccaaatgggccgtagtcagcccatataataatggatcgcggcccaccaatacaaatccgcgcgggaagatgcggaggcagcgaggggtaggccccgactcccgcggattcgcgcgcacgaatctcaacgcacccgctccactcccaccccctccttttatcccctcccgagcagagagcccctccttgccgcacctccacccgcgcgctccccgctgccgccgccaccaccaccaccggcgacgccagccatgctgctccacatcctcggctcctccaccctggccccggcgaggccctcccctctcaggcagagcggcgctgggacgggggccgcgacggtgaggtgcgcgtcctcctcctcgaacccgtcgccatcgtcgtcgtcgtcggcggccgcggcggcggggaagcaggtggcgaaggtgcacagctacggtgcgctggactacgagcggagagccgcgctgcggtggagcagcctgtaccggcgcatcgcggtggggcacggcggccggccggtggggcgcacgctgggggcctgggatgagggcgagcgccgtctcgacaagtgggagctctgccgcatcgcgagggagctgcgcaagttccgccgcttcaacctcgcgctccaggtatgcacatctactactaatttaccccctttttttttcttaactaagttttttttttttttgggggggggggggggttagttaataagagatccgacaatgttgggaattttcattgtactttaggtcgagttatagcaggatgatgtttgtaatatcattccatacacatagcttagctaaagacgtaaaatggggaattttctatctgatgggcacaacgttgcataggactataggagtacatagatagttgccatttggtagttgcagcactgcttagtctgaagtttaatgtagaagtaatgctagtaaatgccgtgtgaaaaatgcaagttaggaaacaaggctagtagttaaggttgggtcaaagttggaattcgtccgtgttttaagatcttctagggtagtattttgagtagatttaccactgatcatcaccaattatgaattcagtgatgaaagcatatcttgcagatatgtaaatatagaattgttgagttttgtgcttactctaataatgcatcaattcaatataatccctggatagtaactctaataattcatcagttcaatacaatccctggatagtaactctactaatgcataagttcaatacaatccctggacagtaataactccactaatgcatcagttcaatataatccctggatagtcatgaaaaggtagttgggtgcatatactttgtacctctgagggtagaaaatcatggtacttattggtatttttctagaatggaagtcttctcttcttgttatcttattgtttttggtatttttttatgaccaaccttacaaatttaatagtcgtattagtctcatcaggtcttttcttgaacatggtaggtgtatgattggatgacagagcgcagagatagattttcactctcatctagtgatatggcaatccagttggatctgattgcaaaagtacgtggtgtttcacatgctgaagaatacttcgaggagcttcctgatccattgaaagacaagcggacatatggttctcttctcaatgtttatgcccaagctatgatgaaagagaaaacagaaagcacatttgagcagatgagaaaaaagggatttgcaactgatacattaccttttaatgtgttgatgaatttttatgtggatgctgaagaggctgagaaagtgtccatacttattgatgagatgatggaaagaaacgttgcttttgatgtctgcacttacaacatttggataaagagttgtgcggctatgcaagatgctgatgcaatggaacaagtctttaaccagatgattcgcgatgagactgttgttgcaaactggactacttacacaactcttgctagtatgcatattaagttggggaactctgagaaggcggaagaatccctgaaagaagctgaaaagagaacgacaggacgggagaaaaaatgttttcattatctcatgacactctatagccacctcggcaagaaggaagaagtctaccgcgtttggaattggtacaaagcaactttccccacaattcataacctgggttaccaggaggtactatctgcccttgttaggctaggagatattgagggagctgaacttctttacgaggaatgggcatccaagagttccagttttgatcctaagactatgaacattttattagcgtggtatgccagagaaggctttgttaccaaggctgagcaaactctgaacagatttgttgagaaaggtggaaatccaaaaccaaacacctgggaaatccttggcacagcatacctgaaggacggtcaatcatctgaagcactgtcatgtttggagaaagccactgcagttgcaagtccaagcaaatggagaccaagacccaccaatgttgagagcctccttgcgaatttcaaggagaaaaacgatgcagaaagcgcagacaggttgatgaatgtacttagaagtagacggtgcgaggagaatgaagagtacaagtcattgatcaatacctatgcctttcaagacacatgattgtgaaagaacatcaacaatctcatgagcattacatcctgaatgaatgcattacttgcttgtagtgctttttagatgctatagttgtgtctgttccagacagggtagatgcatttggcaattgattccttagacaaaatcgcatggcgtacatagatataccttcttttcagttcaacttggctcagttaagaaagttgtaaattcgcctaatggccgccaagtacaaggctcattttattttctagtacatatacaatgagtaaatgcgttgttgttattgaggatttaacagaaatttactttttcttgctctagggctgtatttttcccccctatatttaatgaaaaggcacaagttcccccgctatatttaatgaaaaggcacaatctcgtgccgttttcccttaaaaaaagatttaagtttaacagacatttcttgttcttttgatagaagatttccttactgaagaaacgcgtttgtttttacaaaccataaaattgtagtaccacattgtgaatatcagaaagtaattcaaggcaacactttataaagaaaaaagaaaaaaagaaagtccattttacatccctcaattatagacagtctgattcgcatgttgcatctcggccaaaaggcccaacccggcccagcaaagggcccaattctcgtatggaaacattgaaggccggcccaccgctggcgccgagggccccgggatgcagcgagcgcccctcgccgattcttccccggacgccggacgtctcgtcgtctcctccatccgtccgcctgagcgccgccgatcaccgccgtgtctacgtctgaagacggcgatcctgatcctgaagagacgaccctcccacgagaggttcgtcgtcgtctcctcacctcgtctcaaactattacttactcccctcatctgccacgaagccgccaagaagtcgccctccatgatctccctcccaaccacctgcctgatcagttcatctgactgattgcagattgctcatgacagtgcgaattagggcatgtgggggtcactcactagagggactgcacgaggggtggtggtggttgcagttgcagtcacttcgcttgattcagatcaagatgcagtattagcactaaactaatggccagattccttcacgagctcactgctaaagctataggtgaaaaattaacagcgaggtaaatatgaacgatctagtgctcactttattcaggctttattaatggaataatggcccatttatttcttttctgaacggaactcagttcaggcagcaaattgtggttctgagtaatcaaattatgtcctggtcttatgcactattattcagattaggacgttagaagttagaatgtgatcgagaccttctactggttctctcattagttggcgagaaagttaacaggaacacgaaaaatgtttggtttaatcctaacgattactaaaacgaagcaggctctagactccagagtgcatagcagcgcataattactgattaatttacttcgaggcagaagataccaagcatctagcgacatgagaatattctcttctactacgaccatagagtagagaaaaatgctaagaacaaactattaatgatttttgcacatcaggatgagtttataggtgtcgaatctgaaaaaaagaagtttatagcttaagggcgtattgtggtgcacacttgtcgtttgaccttttaaccaagcatacgtgatcagcatttccgtctgaagaacgtcgtcaatatgtgactagcacgtccttggctgatcaatcctgagtatgattatctttcttcgagtaattaacacgaaacgatgaaaaactgtactctttcactggctggaatcaaatatgcagaagtaagaagaacattactccttcctctcgcagccagatcttagctcgcttgccgtgcatttttcgagctcttccaacgtcacacctcttatcattttgacacttgtgacagaatgtgccaagtagaacagcctaggatgcaactattgacagtaaagaatggattctggtctctttacttcaccaaagatactacctagagtacctaactgatcaacagccagccatatactgctaccaaccaagtcaaaaaaatacaacgaatatttccaaatgcaatgtacggaggtgtgagatgaattgaaccattggattgagatcccaatgctgggaaaaaatgctcgatttaatcacaattcacaaaactacttggatggtagtgccgttgcgagtagtagaaatttgtgcgcgctgcagtcgcattccctccattttatatgacgaacacttcagccatccaccaggttcaggtccactcccctctccaccagctgcaagaactcgccacgcgagtccagtgatcctctccgatcgatcatggcggaggaggaggacctggcggacatgccgcgggtggtgggcgtcctcgccgcgctcctggagcgcgtgaccgagcggaacgacgcggcggcggcggagctggagctggcggtggcgggagctccggcggcgtcggcgttccgggcgacgacgaagcccgacatcacggtgcgcgcgtacatggcgcgcatcgcgcggttcgcggggtgcagcccggcgtgctacgtggtcgcctacatctacctggaccgcctcctccgccgccgccggcgcgcgtgcgcgttctccgtggactcgtacagcgtgcaccgcctcctcatcaccgccgtgctcgccgccgtcaagttcatggacgacatgtgagttcgcctcgcactcggccactcgtggtcacgcaataattgatgcgatagccgtatgatcgaatcgagtttctgggttctttgcggtgttgctgttcttggctacagtagtccagtcggtgcccggaccagaacatggcagaaacagaatgctctgtttttctttatgaattttgatccaacatgctaggtagatcactctgaatttcccaattcattcagaaatacgccaattggcctattctttgaacaattactttttttttgtgtagatagcttggttttcggcctaattacgtttgttaggcttaataaggacgattcagtctagctgctgatcttcttggaccaaacattattgtgcaattcttatcctgcttcatttgtgcctgttcaaatcactgtcaaccaagtatttgttgggagttaagagttaataccatcatgccaaccccaaatttggactgttgtgtgagcaatagtacgcaatcttggtgaattatggataaagaaccttctgatgagataatatcgtcatcaaaatttggaattcagtaccacgtaggaaccttttttttttcaggaatacaccaaacaccaccatgtaggaactaggaagcatcagcacagtggattctttaaacatcagaaaccaataaacccttccctaagtcctaacaagcacagcccaattgaaaaaagttaaaaaaaaaacttcatcgaactgttcatgagaagaacacgctgcagtgcagaaatttgatatattatctcacggcctcacactgaacgcaccaaagtgttatctgttctgtggggatatgtgtgtgtgggcagcgaaattatgcttgtccaacaaagaaaccatggtggttccactgttccttccatccaaaccacacatacactggggacccaaagacataaagataggattttcatttcttttctccacccttttccctctcaccaccttttttctctttttggaatttaattcattgccaagttgtgatgtctagctagctagcctaggatggggcagtgtcaacttgccctcttgctgatgctcattagccccaactccctcctgccaggagcatctcatctaaccccaaatcttcttgtttctgaaataattacccagttgatattaaccgtaccacttaattgcccagttgataataatctagaaaataactcgattggtgtgcctttttggcccatggtatatcatctggtttgagtttgacgttagctgcacatatgttcggtagcctactaccactaacagtaaaagctttagcttgtttctgcaaacaagatgtctgatctgaagaagatgcgtgcactgcagatgctacaacaacgcctacttcgccaaggtcggcggcgtcagcctcccggagatgaactacctcgaggtcgacttcctcttcggcgtcggcttcgacctgaacgtgtcgccggagacgttcggccactactgcgccgtgctccagtccgagatgctctgcctggagctggagccgccgccttctccttcccctgctccggcggcaaggctgcattgcttcctgtccgaggacgacacaagcagcagcggcagcactcagcatcagttagctgcgtgaacagtcggtgatcagatgcagggattgcttccaagcaagcaggtgagaagctgcattgcaatgtacaggcacgattgcttggaagcatcaagcaaagcatttgctcctagcacatagtactgtcactactgtgatgtcttgtttgctgtaatgctacttagatgattagatcttactactacgtaagtagtagcttgttaggtgaggtggtacatatgtaatcgctgtactctcacagcgccatcgttttctccctgctgtacgtagataccggtgttaattgtgcttccttttttttatttctcttttcttttcctctgctgtagcaaattaggtttggtgtgattcattcaccataatgcagaggggaagaaaacgatgtgagatgatcaattgggtcttggcagcggtagcgcttctgattgatccgggcaaaccgcagcagatcacgcacagatcgccgcgcattgccgtgcacgggtgattgtaccactagcatcctaggtggtgccatgcttgctcaccaactgagtactgatcaccaattaatctgggagtagaaccagtatgattacgtaacaggaaacctcctgcttaatagatcccaactattccgtcggtttgtctccgtctctcactctgctggtttgagaaacagagctggagtaacactagcaagtcggtagagcgatgtgattgtgtgaaacggagagaccggtaggcgatagagagggagaaacgacgacggagagagagactgggtgatcgcaatggattatttgaccgcctgaccggtcaaaaccaccacgagcgtgggggtgtgggcgtgtggctgcgtgcctgcgtctcgctgtacaaaggccaacgccagcggcctgcgccaccaccacttggccaatgcatgccgcagggctccgctcccggtgatacaaaggctgtgttgtgtttagtccagcacaaagtttggattttagtttaaattagagatgatgtgactaaaaagttgtgtgtgtatgacaggttaatgtgatggaaaaggactaaaatttggatccaaactttggatctaaacacagccacaggccctgtttaattccaaagtttttttttccaaacttccaacttttcatcacatcaaacctttcatacacacacaacttttctatcacatcgtatcaatttcaaccaaactttcaaatttcagtgtgaactaaacacaaccacggttgtattgttggattctagggttcagaggagagagatggccatgatatgtagtggcattgtcggatttaaggctttcctcactgtataattcatttagtgagtagtaagataagacaaatcagagaatcgctcatggatttttcggctagctccataaggtggtgggctaaacgatctgggttcgaagtctcaccccttctaattacttgatattaggtacttctctaatattcgagttttaagataagacaaatcaagttacagttatttctagctctcataatgtgttgacagaaaattacgatccatatgtagaacagtggtcaggcaaaaattttaaccaaaaacatcacatcaaatgtttggtcacatgtatggggcattaaatatgagaaaaaaaaacaattgcacagtttgcatgtaaattacgagacgaatcttttgagcctaattatgctatgatttaacaatataatgctacattaaacatttgctaatcatagattaattaggcttaataaatttgtctcgcggtttacagaaggaatctgtaatttattttgttattagtctacgtttaatacttcaaatgtgtgtccgtatacttcaaaaactttacacccaaaagaactaaatacactctcagttgaaaagagaaaagagtttaatgttttataattgcttcttgccaagtggagttattacatcctttactatccgtctccacaatgataaaataggtagtaaaaccccttactatctgcttttctcgtactctataaacttttggtaagtctccaccggtattagtacttcttgtcaaatatgacaaactagtccgactagatataatatagtcctacgaatttagataggggtttatccatattctttcatattactaaaccatttagatacgtagtattagattgcgatcaacccagtattaaattgttatattttggctggagagagtactagtagctaattcaaggagagagagtgtgtgcactttggacccatatttatgatctattgtgtctgctagctactccagccgttccatcataatttcacttttggctcttcccatttatttcaaaaataagttcatttttagtaattgattcatcagattttgggtgtgttgttcacgccgaaattggaagtttggttaaaattgaaatgatgtgacggaaaagttaaaaatttgtgtgtatagaaaagttttgatatgatggaaaagttgaaagtttgaagaaaaggtttggaactaaactcggcctttgtgtaagtaaggaataatagcattaagagtagataaaattagggaataatttcatgaggatttgataaaaatagaggtataaagtctgcatcgccctcaaccacctactagacgagaaccagtggttcgatgccagaatgagttcaccgccgctgtatttccatgaaaggagagagatgggggaacagagaaagagatgaaagaagaagacggaggcaatttggtctgaaacaaatgcgtccggagaataagtagcactagtatattttgaaatgagctatgaaattgtaatactattatggttctaaataatttaatagttgatggcactttttaaaactgtcttacaatcgtacggatccaattaatcttagtggcttatgggaactccctttttctcacaaataagttactcctagcattccaacgcaaaaattaaaggagagaataaaagaacaaaatgcattttattaatagcaaattagtattgatggataggcgcgttaaagtgttatggctacggataaggtatatcttctatcctacggcttatataatatacggatacggcatatcttcgtatgtgcgatagacttctgcatataatatgaaaatcgacaagacattatggaaataaacctcataggcaaataacgtgacagagttctacttgaagaaagttaggattatactatatcgtgtagggtccgggatctccaagttatacttggagactaaggagattcacggtataagtagacacctcctgaggggtccaaggcatcgaatcatagcactagccaacccacgaccaaagcagcaatacagagaacttgaagtctactcgctaggaatttcgtcgaagccatctcgacaaggatctcgtcggtaactttgggatcagttgttctctcttataatctatggatttccatatcaatctcatataaactggattatgactattaacttacgagtggtccaaaacagtataatccatgtcttcttatttgcttgatgtcgaatcgtgtagattttcgtaccaacgtaccccaatacccatactattcggtttacaggtatctctcatcgacaaagaggtatcgaagaaataaatattttcgatttatgaatcgagatagataagaacatccccagcagctcatctatatttggtcctgcaaatgtccatatggagtatcatccaaaaaaagaatatcccattatcctatattttaggaatatctttccaactaactttacatttgtattttaagggatatatttccaactaacttaattttaacggtgttatttatcacgataatattttgaaacgagtaaattttaacggatatatttttaattgatagttttttaattgatatatttgaattgagggaaacatttttttatatattcgtagcatcatcaataaaataaaatgtacataaaaacacagcaaaaaatattcctatttcctatttccttttactctattcctatttcctatttcctcttctctactactactactcttttccttttactctattcctatttcctatttcctcttctctactactactactcttctctactcgcgacggcgggcgagttggcgagggacggtggcgggcgtgcggccgagggttggcgggcgggcaaggggcgacgatcgacgtctgggcgagggcgcaaatggacagggaggaggcagtcaatggtcgcggaggcgggctggcgggcgagggccctggatgggcggggaggaggcagtcagcggcgggcaggcgcaggggcagaggaggtaggcggcggccgcgcgcagggcaacaacgaaaggcggcgacaacacgtagggcgacggtggaaggcggcgacaacacgcaaggcgacggcggcaggcggcggccgcacggctccttccagatctggtactcctctccctctccacgcctacaccctcctctccacactccacgacgagcagcacaggcggccgacaggctcgtaagcggcggcgacagcttgcggcttgcggcgactcggcgtcagtagcttgcggccggcgacgacgacgatggaggagaggtcgcgatgggagtccgaatgtgggcgggagatgtgggcgttgagatatggcgtgaggagagagaatcgctatatttggccgaaatctactcgctttggcgcatcgtccatatttggcggactcaatgccgtatctgttggaggtccattttcatctcgcatatgccatatatcggatggaggaccggatgaaggatctcctggggatgctctaagaaggtagtactctatctgtctagaaaataaaaacaataagaaacattctagtgtacgaatctagatatatctttgtttagatttattgtattagaatgtgctacattcaattctatattcgttgatttattttaagaaaaagtttaaatttcagaagttgatttattccatgaccgagggagtacatacggcaaacggctgcttcgaggtcgaacagattattaacagtcggagagagtggaattggcaattcccaaatcgaaacgccgctgcgcgccgcgccctacccggtacccccgcccgccgctcgcgtggcccagtccgactccgatccaccatcccggtaaccataccgccgcgctgctcggcacccccaaaccggcgctcgtgcccacgcgggggtggctcacc

SEQ ID NO: 12467 - DNA, 20917 bp, Oryza sativa
tagaggcttctggtggcggtgggggcagtgcggggggcgttggatggggatcccggaggtggtggtgccgccgagggcggccggcccgcgaaggtacaaggggctcgtgccgtggcgcttccagccgggcttcgtcaggccgcctccggtcaagccccctgccgccgccgccgccgttgccggaagaggggtcgcgggcacgcccggcggcaagggtcgcgggttgggggcgtcgggggaaggcgtcgggtccagtggaggccggggagatcctcaatcgaggagatgcacccgcagcgcgagcgcgaagggctctggtgatgcgcggagcgtgaagaagggcggtccccgtgttgccgaagacgacggcggttcgggcaaatccggcgtcgcggcggagggctccggatttgagggtttgaggaatggcaggggcggtggcgttggaacggcagctgccgaagattgtggtttggagaagtccaaccccgatggcatcgtcggagatgctgatgtgcatcttgagagcggcagcgatgcaagagatggggaatgcgtttctgagggtttgaagaagccttgtgtaaataatagcaatggttcttctgccgcggattgcgcgccgaaggtgaaaaagggaaatgacagtggcaatggaggtgccgatgagtgtaatgctgcagccaaaagtagcaacttagcatgtcctggcaacaatggcgacgaaacgaatcgtaaggggcggaaggtagtacttccatggaggttccaggttgggttcaagcggtcgttctcgaaagctttctgctccgatagtgaatcttcagggccctctggtactcaattctacagagcccaagactcttcgacaccgtgcactccagcaacaagaagttctgtccggtgttatgcgagtgctcattctggtgttagagtctcggccatgcgtgatttctcagtgaaaggtgagaaggaaacatcaactccatataagaagagcaaaactggcatggatggtcctagtcaagggatgccaaagaatggagttgtcctcgctagggaaaacattatgggatctctgcagaattttcgcttaatttacagggaccttttggatgaagaagaagagaagtcgacagaagcagtgattagacctgatctacaagcttacagaattttcagggagcggttcatcacagactgcgatgagaagaaatatattggcaatgtgcctggaatcaaagttggtgatatcttccacttgagggtagagctttgtgttgttggtcttcatcgcccacaccgggtgggtgtagatcatatcaaacaggaggatgggacttgcatagctgttagcattgtatcatatgcacaatcttccgatattaagaataatttggatgtcttggtgtattctggagcaatgacagctatagccaatcagaagatagagggtaccaacttagcactcaagaagagtatggacactaacacaccagtccgtgttatccatggtttcgtcactcacctcaatggaaactgccagcgaaagaagatccctacttatatatatgggggtttatatatagtcgagaaatactggagggagaaagagggtaatgatcgttatgtttatatgttccgactgagaagaatggcaggtcagaaacacattgacatccaagacattctgaattcaggacaagctgaatcatatggtggtattatcataaaagatatatcccgaggattggagaagatccctgtatctgttgttaattcaatatctgatgagtacccaatgccctatcgctacattgcacacctgcagtacccccgtaactaccagccagcacctccagcaggctgtggttgtgttggtggatgctcagattctaaaaggtgtgcatgtgcagtgaaaaatggtggggagattcctttcaatgataaaggccgcatcttagaagcaaaacctcttgtttatgagtgtggaccttcatgcaagtgccctcctacatgtcataacagagttggtcaacatggccttaggtttcgtttgcaagtcttcaaaaccaaattgatgggctggggagtaagaactcttgacttcataccatctggaagctttgtatgtgaatacattggagaagtgttggaggatgaagaggcacagaaaaggtcgaccgatgaatacttattcgctattggtcataattattatgatgaagccctttgggagggcctatcaagatccataccctcacttcagaagggtcctgataaagatgaggaagctggctttgctgttgatgcttcaaagatgggcaactttgcaaaattcatcaaccatagttgcacccctaacctttatgcacaaaatgtcctatatgatcatgacgacaagagtgtacctcacattatgttctttgcctgtgaggacattccaccccgccaagaactttcataccactacaactatacaatagatcaggttcatgatgccaatggtaacatcaagaagaaaaaatgtctctgtggctctatagagtgtgatggttggttgtattaggcttgagagtgtactatttccagaggcataattgaacttctttcattgggcatgaaatcttcttctagcttatactgtgattacaaatgaaatcgaaataattattaggttaatgttttcttctttctttgcagttccaccattggcaaagtgccaagtcattttttttatttgcactaatcatttaataacttactaaataattttacattgtgctgatcaaatgtcttccataattgtttccaacaatggttaaatgtgttgttcttttaagggaaagtttaagcatgttgtttcatgtagctcaatatatgccagaatatgttatcttgatacgattccgagtctgacacaatttgttactttaaattttgcagttgtggttagtagattacctttttttggtttagtttcttgtctcaagttattttttatggttcttgtaacatttgtttaggtccttttggactactaagctattaggatattgtacaaacatttcaaagaaatactgaaaccagcaaaagttagaaacttcgagatgatttggaataacaactattcgctcctatttatcatagttagtgcttcagttttgaccagtaacgaaaaatacagcaccatattttgaggatgagatatggttctatcatctcatggattatttcacatatttgaaggacttagaaaatacagtgttcacctagttgctaaacactagtgggacggccacctactgactagctactaggctgattaggcggcgactagacggattaggcgaattaggcgttttttctatttgtttcacagaaaaatactgattctagacattcggtactcattaaatataggcatttaggaaaatagcataaatcatagttaagttcagaaatcatcaagtcaatacaacgcactgacactgcacacaaagcattgggtttaaagcattgggtttagtacaaatctataggaatagcgaacacatcagtatacacatcataattcataaatcagaactttatatttcatatttagtgtgtgtgtctctctctctctctctctctctatatatatatatatatatatatatatatatatatatatatataggtatatatatagcatagaaggctaggggagtagcagtacagcaccaacaccaacacatgagcatacctctcaaaaactcaatcacatacatacagatctgatacagatctaaggtgctggagttaggagaggaataaaaatttacctggagctggaagaatagaggaggtgaggtggtggaagggagtctagtcccctgatggcctgatctagggttggcactggctgtttgagtggttccatgtttgactgcttcaatcgatgtgtttgccaccttccattgacggcaaggatgaaggatgagagggagagcaggagcagcagaggagggggaagaacgtgaagcagcaaaggaggagagtgaagaacgtggcggcgcggtggcaaattggtgggtacggtggcagagctctcgcttgtggcggcgtgaaaaggggagtaggcatgggcagcgctctctctctaggctctcaaataaggtaacctaaatcctcatctatactgagtcggccccgtgtggcgcttccaaattttattgcgcccaaattttgatttctatcgcctagtcgccacctagacgcactgtcccattgtccaattgcgcccagggactgtcccgtccaggcggcctaggaccgactagaaccgtctaggcggtaaatcgactaattcactgtctagggtgtaaactggacaaattgtcgctgactagcgattaatcaccatctaatgggctaggtggccgtttaggcaaacactaaatagaaatgagaattgggtagtctgaaacgttgatatattgtagtaggtgcaggagcctccatttgtgggccttgatttggagaagggtttcaaacggccggtctaaattgagaaaaccaacgtttgcagcggaagataaaaaacctggtacccatgatgccaagaacgtgctgccttgtagtactgaaacttcttatcatagatgagttcatgtgaagctcgaaatctgcattctgatgtctgtaacagggccacaattcctttgcctccaaagaatgtctattccatgaactcaattgttatttttttttgttcgattttgtattgagttaacctttttatttttctcgagaaacttgagtcgaactacctttttattgagacatggcagattgttcagtccagaattaaaacatcaccaacacgatccggaatatatatacgagcatgatcagctctgcacttgaccctatcttatttcagcatttcaggtacaaagtttgaacaaaaatggacatattatacaggaaccgaagataacttaagtacccatatatcttagtagtatttcagtaggtaacaaagctcaaccaaagatggacatattacacacagctactgtgtacaacggatgcaaggcaaaatgtccagcggtttcagagtttcagttgccgccaccgcgctgaggccggtggctgtcaccggcgtggaatcccccgcgagcgctccagccgccggcgccgccggctgatccactcccgcctccgaacgccccagcgccggctccccagccgccgtggccctgcccgccagcccagccgaaaccgccaccgtggccgacgcggtcgttggagccaccgagcccgtcaacgccttctacaccttcgccttcgacgtcgacgaagccaaacccgaacgcggagccgccggggctctgcgccgagctgtggccgtagccccagccgcctccgggccccgaggcccacccccacccgtacctccaggagccgtcggggccggagccctgcccggacccggcgtcgccggtccatccgggcggggccgcccgcccgcgcccccgccccggctggtgaccccgctgtccgtccatgcccccggttgtggccgagtgtcgcgagggtcagctgaatttatgcaagcctcggcttcgcatttctcacaattcacacctgtgtcagttttgtacttatgggcagtgaatgtccacggtttttagcgcggtaatttagatatttatcacttttagatataacgtttcataatttcactcatataatttcataatttatactcatatatatttatgatacatgaatttttatgtgcttatgtaggtttagtttccaacttttccatcacatcaaaacttttctacacatataaacttttaacttttttatttaaactttcaattttagcgtggaactaaacccaccctaaattattaaacgtcatatcaaaagtgataatagttaaatactccatctccagtttgacagctatgttctgaagtctgaactgagctgccagtgactagtagtgagcttggtcaattgcttcatcactaatcaaaccgaaacaagccaggacttttgtgtcacaagagatagatgagcagaagtgcgaaccagcagcagaaggtgaaaaccacgagcattcttgtaacttcgcagactggaaagacagtgtgcgaaacataaagaattcaaacaaacaaaaataaagctcagttttgacattcagaaggggcccaagttttacatttggaaacataagcacctggtggtagaaaccacactatggagttggcaagagtcggagagatacaaagctcttgggaatttcgttccaatttgatacaattgcataccatgccttgttcctgttttctggtattggaggagccgtggagcaggggtcctcagttatgtcttgttactgttttctggtattggagcagcataggtagcttgaggacagtggtctcagtctaagtatcagatgtaaacagtgttgtgttgatgaaatggttgcacgcttactgtgatgatcgccgatgtttagatcactgccaaaatgtaaacagtgtgtagatgctgcgaacctgtgaataagcatgtcctcagctagtctgatcagccaggcagaactttcgcaaacctgttgatagaagctgcatcttgaaatgagaacatgagcaaacaaaaagaattgcacactggagatgatgtaattaagttttgtaaacagaatacaaggcgggccctcagacatccaaggaaggatttaacagcataagctctcaagcctggcgaggcgaaagctcttaggcggcaactgcgaatgttatgagaaacaagccttgttttcatcatcactgggcaggcataacaagcactctactaagatgtaacaattaaatatgaaacatgaaactgcttgaacatcaatcacgtgaagtttactaggcaacaggcatcagacatccaaggaaggatctagcagcattagctctcaagcccggcaaggcgaaagctcttaggcggcaactgcgaatgttatgagaaacaagccttgatttcatcatcatttgcccgtcagcaaagcaaactaaaacatgacacacatgaacagaaaactaaaacataaccacacacatggatacttggatgacagtacaattatcattgctacaggagacagaacttaaccctaatcataaccaagaatactaatggcaagacccaatagcaaatgtaaatgtaatgaaaaccatatggctcagacatccaaggaaggagttagcagcattagctctcaagcccggcaaggcgaaagctcttaggcggcaactgcgaatgttatgagaaacaagccttaagtttatcatcatcgccataaaagattccgtattgacaaagtttcaatccaatttaaacatcaaatttgaatcaaatttaaatgtagtcacagaaaccggctctgtggaccgatggaacagcagtccccaggttcctatcaacttgtgagacgccagaatcagctttgtctcggcctgatcatagcatcacagctcaatgctcgtggctaacagtgacgtggcatcaggcctaaacaacccaaccgtgcgagattagcatcgctcgtgaaattggaacataaaccaaaccaagcagaacaaaacggaaaaaaaaacaatctggccaaagggttaaaaacaatctagccaaataggcaaacaaagcgcgagtaagcatggatcatagatggctcggctgagcggaaactcggcatacagatcccatctccaaaggccttggagagagacctgtgatttggtctgttgagcttgaatttcacctagtcgtcacagccaccacgaatccatgattatacaagatatgaaaacgaagatgtgcatacaagagataccaatatactttaccatacaagagagattattggggattaactgacggatacgaggggcttgggagaatgttccgttttggcggcgacggtgagctttcgattgggggagaggggatgcgtgtatataaaggaggcaggggggtcaagggtgctagggtttgcggcgtgccggagccggactattgggccgtagccgccatggatgggcccagttgcttcttctttggggttgggcttaaatgcccccagtctagtgggctcaaataattcggcctggtgaactatatccccgtctctctctttgtgcaatttttcagtacatttctctcaggcgcaaaacattcacaactccgcgtattttgctgcggtagcattgagattgaatgagggtgtattgtgggtttgtttggattgatgccaatttttgtcctgttaaaattttggtaactttaacattggcaaatgcatatttgttttggtaccaaattttaaaactataatagttcaaattcaatgctacaaattttggtagtaccaaaaccgtattggaactaccaaaatattggtagggcaaattttggcttcaaaccaaacaagccctatcagttcatgtgggtattctagtttttttgcaatgttattttatataattcagacttgggggtcaaccatctcgcagactttgaaccacagaatgacaatgacagaatacaacctttgtgaaattcaaattgcctctagagcttacaccattttttgtcaatactataatcacgcacgattgaatagaccttttgtaaaacgaaagaagaaacatcacatttttgttaggtacccttaatatattaattattatttttcgccgcaccggtggaagaacgccgacgccgatctatcttgaatattattgcaagtgagctccttccaagccggccacttctgatgaatttatcagatcagacattggtcgtccaacattttcggacatggatatgagtgttgttaatggcctcatgcctcccatcccctcaagagggtggcacgtgcaacccggttgactcccagggtgaacgcccccatcctcaggttgcaatcatgagatttacacatggccttgatgtgctggaaagaattgttcatgtacttgtggagctccatgttcaccttctcctcatcccacatgaacccttgaatgttctgcaaccgttcaaagcgcataagggagatgctgtattcatccaaagctaatgcgaaacaagatcgtaggaaccggcatttcaattacctgaacccactcaaaatagctaacgatcacaccaccggagttggcgtaaatgtcaggtaatatggtcactcccttcttggcaagaatctgtagtgcatacagcatcaatcagaactgccaaaattggcaacatttctgatgtttctcaaagacaaagttagggtacaatgttttgttctgtggttacctcgtcagcttctggatcagttggatgattagcagcttcaattataaatttggccttcacatcaggtgcattttcccttcagaagatcaattatatgtaaattggctatttttttcttggtgcatactactgttgaactagaataatcagataaaataggttcttcaacatgtaacaagattaccgtctaaaacaactgtgtaccatttaatgtcaaaagtacaaaaaagaaaaaacagataggtataatgggtgaaaatgcaactgcaaccaggtaaggacagagtttcaagagtcatccccgaccccgataaacaactcatattggcagaaaatttaaggatcgacatggacactagcttttacctgttgagcactccacctaaagcgcatgggatgagaacatcgcattcatgcactagtagctctgaagaatccatgacttccgcatcatgaaaatctttcaaagcaccaccctcatttctgtgcttcatcagagcaggtatgtctaacccattcttgtttctgattgagcctgtcacatctccaagtgcaatcaccttgccacccttctcatggatgattcgtgcagcccatgaaccaacattaccaaaaccctggaaaattccattgattattacaaacaaaatacatatgttgctggcatactgataaaatgataatgaacagactgatttgatagctgaattgcggttttaaaattttcaggaagaaagctagatttttttttttttttgctgttatgatgatgcatgttactcccttcgtaccaaaatataacaacttttagccctcaggatttgtcccaaaatataacaacttctccaccaacattctcttcccaaccaataacagcactccaccattcactttttccacctacctccactactcatccaattatgaccatccacctctcacttctacctactttcttaataaccgtgtccaagcctaaaacttcttatattctaggacggatggagtattgtccttcaaccatcctagaaataatccgcatagcaaaaatcaatcgattattaattatgactgacctggataacaaaggttgatccagaaatggactttccatgttcagccaaaagagcctcagtagcgtacatcacacctcttcctgtagcagcatctctacctaatgatccaccaagatcctacaacaaaaatatccaaaatacaatcactggatgtaaattgtttatttacacaaactagatttgtgttgttgtatagtatacttactattggcttcccagtgacaactgccggtgaatgaccatggaatttcgagtactcatccaaaatccaagccatggtctgtgtcaaaattacaggggatgttacatgatgaagggaagtagtagaaaaatactagagaaagcagaatatacctgtgaattagttcccatgtcaggagctggcacgtcagtatgagctccaataagatcatgaattttctgtgtaaatacacgtgtcaaacgctccagctcactcgtgcttaattcaccaggagcgcatccaatcccaccctttgctccaccatatggaattgctgcaacagcagtcttccatgtcattagttgagcaagtgcatttacttcatctggatcaacctgcaaagcagaatggtgaaaccatagcttattagttttagttttattttttctcgaacacgcaagagagctgggtgccatttaagaagataagaaagttataaaggagggggaacctcacccaaaattcattatcaattgtagttttaaaaatgagaaacagatgaatctcagactacaatgaataatttataagacaaagtatggtcagcagaaaatattatagttgactttctacattagcttgtgaaagtcttacggtaatacttacaaaaaattcctttgcaaattaacaactgctgacatcaattgcttactctaggaattgattgataggttagctgcttttctgttagctaactgataacaaacatcaattcatcatcaaaggaaatccatttatttattaagtacaaaggtaaacacgacaataaaagtctcagaagctcatagcgcttttaatgctttatatttattagtactccaggagactgttttttttttaacctaaaatttgaaaatccctcatcttcattttgaacctaaatggtgcacatatataactctggcattttcaacaggaaaataccataagctcgcagttttggaaaaacctaagggattattccctaggtttaattataacaagcacctatctgtatgaaatttaatggcttccagcaacaagaaccgaagtatgattggagcagtaaagaacaaaagaaattatcacagaagaaaacaaagctggttgagtggttgtctccaatactgaatactagcatctgtagcatgtctgggcatcaaactttctagtttctcaaaatgccagttaaataatagttcaagaaaaaacagaaattacagaaacaatttgacagaggaagaagattggcatgtgcccattgggattcttttgtcagtatggaaaagatacatttaggttgacagttcaacagaaagaaatataaatctgaatgtaaaagcacataagcgcatagtagtacaaaagcaacacatgctttgcaaaatatcaaggattttcagttcacgccatctgcatgacaaactgacagcccagtgcccagacgatccacaaaatatcataaagtagattacaaataaaggtatgaaactgaaagtaacatcacgcacatttcctaaaagaataactcaccgaactggaaaggccatatgcaaacaaggaaggaataacaagttaacaagtaccgtagatctaataactcaccaaaacgaaacaatgatcccattgacatgagacagtcactgtcaaaacattccgagtttataaccacttcactatttattcatgcttaatcatctccggtcaaatttccagataataaggaagatgatttacatccccggcattattactggacaaaatcaaaaacagattctcatcaaaccacaatcctcacctcagggtgatagcgaatgccacctttcattggcccgcgggcattgtcgtgctgcacgcggaacccaatgaaggacgccaaggttccatcgtctttggggatggtgcattccacctgaacagagagcggggttacgctacgcctgatgaaacaacaaagccagcaaccgcagcaaaacaagctggaaacaggaatcaaaaaaaaaaaaaaccccgtctcaccttgatctcgcggaacgggatcaggaggctcttctcgagcttggagtcgaggccgagcagcctggcggcctgccgaaagttacggctggtggcggcgagcgcgttcatggccggccaaaggtggcgcgtcgccctccaagaaaattagcgcccgcggccggagaagaaaaaaaaaaagggactcgcctttcgaacagagcacgcgactacggaccgcgcgcgagcaagatcgatccgggggggacgaggcgttcgcgcccaaaaacggaaagaggaaaaaagatggagccttttttctctctccggggatcgaggaggaaggcacgggaggaggtcggccggctgcgtttggcttgaatcgtgaggaggaagaggaagaagcgtgctgtattaatagggaggggggatccatccatccaggtaggcggagcaagaaagcaaagataggatcaaagagctgtgctaattgctaaactcagccagaaaatcctctctcatctgttgggaaggtgactcatcagagccgattagaaatttagaaccatagcagcacgtgtgtggggaaattttgcacggtaatttctagtacgagggattatgactgtgtataagcaagaagattgaggacgaagcgggtcaaagattgtaaatttcgaacgcttttcctatttcctactagtacaatattacttggtttcttccattgctttgggctctctctcatctctcgctgaaagctgtgtttagttccacattaaaattaaaagtttaaagaatttgaaacgatgtgacaaaaaaagttaaagatttatatgtaaaaaaaattaatgtgatgaaaaagttaaaaatttaaagaaaaaaattagaatctacacatgcccgaatcttccaggctccaccaccactagcgtcaagaactactcgtcgtctactcctctttcatcatactacgagtaaaccagtagtctgtggtccacctgtcagcggaagtgcaccgtctcctgcggtcctgccctgccctttttcgtttctcccttttttctggcccagctaccgcctgaagccctgagctgaaatgaacgtggtttcaggtttttttttgtctgcatctcactccggattctctgccctaccttcagggctggattgttttgaggcctaaattagtcttattaatatttagtaattttaatagtatttagtgtctatttggtttgaagtcaaattttggcatgcctaagaaaatagatcatttcaatagttaagttaggctattttggcttcaatccaaacgcaactttaccttgccaaaattagccataccaaaacttgataaaatttggcattgccaaaaattagtaagaccaatttagaccaccaaccaaaccagccctcaatgccatgtttggtctctggtggtgttggtcagtcagtgctagactgctagtgctgggacgatgccactactgtattttggcctggggtgtgtttaattcacgtcaaaattggaaatttggttaaaattgaaataatgtgaggaaaaattagaagtttatgtgtaggaaagttttgatgtgatggaaaagttggaagtttgaagaaaaattttggaactaaactcggccctggtttagtttccaaaacaattttttttatccatcacattgaatatttggagacatatatggagtattaaatatgaaaaaaaaatcaattaaacaatttgcatgtaaatagcgagacgaatcttttaagtctgacggagcttggggctcctcaccgggagaccgcgcaggcccccctttgccggttcggccgggggccctgggtgaggttctaaactccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgggccagcccccgatcgttctgggatcgttttttcccctcccctcttctaagtgggcaaggtcctccttttatatctcaaggggataccacatgcaccatctctccctctctttcttttgtggggacttatcctatcttttcataaacagacggagacttgtatggttgccgtccgaatgaccttctgatgggacggcccacacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggcatatatctgaccggaaccaacgtgccatctctaggagctaacacgccggctccggctagggacgagtgcttggaggctctcgtcctgacgggatggggcgaggcgtgcgtcagaccgcctgtcgccacctaacccacgatttgaccggtctgtgactgatcacagaccggataaacgagcgcgctgcactgcgttacatgcggcgtgacgcgctcgtccaaaccgcaataaatgtggttaggtgagccccgctatgctcacctaccccatatacgcggcgcaacacccacaaggggtcggggcgcctcggccctcggggctgagacgggagcggtccgacccctcggggagacaaagagaagggcggccgtatcaccctcgggcccgaccccccgagggggttaggccacgtgggtgatcgtgtctgcctcaagtctctaagtcatgatactcccggtcccatgtcaccgacaaagtctaattgtgccatgatttgataatgcggtgctatagtaaacatttactaatgacatattaattaagcttaataaattcgtctcacagttttctggctgaatctgaatttgttttgttattagactacatttaatactttaaacgtgtgtccgtatatccgatgtgacaaccaaactcaattttttccccaactaaacaagacctttggatcccaagttgctccctggcagcctcatcatctgcctacaaggaaaaaaaaacacaaatattagaaaagaatctaatatcaaataattaaaaggggtgatgtatcgaatccaggttggctatccctataccttgtgaagctacccctagcgtttctcatctgccaccatctgtactattataaaaattaaagatgttttcaccggtattttggtacgtcatttgtgtttgatttggtttttaaatttgttcgtttttaaatacatattcgtgtttgagtcggattctaagttcgtttgcttttggaaatgcaaaaggagtcgtataagaaatctttttaaaaacttgcatgctaacttgagataaatgttggactcctaattgcagctcatgattttctagaaaaaataatcaagcgaattcccatagtgaaattcaccctagccaaaccgtataacaataattaggttaaaatagcatttatctgttgcaacgcacaagcatattttctagacaaaactcaattttgaagattattttagaatttttttaatttagcttccttctaatatttgtttttaagtcgttaaatacacacacaaataagcatgtgattaattgagggtggattatttaaaaaatatttgttttaaaaagtaacttctacgtatattttatataaaaacaccatttatcaattttaaaaacatactagcaaaaattgagaaaataatcaagccgatcctttagtcaagagcagacccgaagaggctagcatggggtagcgcctgacccagtcagcatctagctcagttgagaacttgagattcgtgagataatctcgctcgcgaacactcgtggactagagacctccccgcagccggctgcctccccaggaaaagtgctgttcaaaagagatccaccccgtccaaaagtctgggcggcggatgtgtatggccgtggaatgggtgtgggtgctttggagtttggacagtgggcagcagcacgcacagaacagtgctcgcccatgtccgtaattcgttaaacagatcatgtgtcaaacaaatctctttcccatcccgtagggtggcaaaatcttcgattctgcgcggggacaatggtctgttctcagggtggcaaatcattttgattgcacatcgctcggatatttccattttcgagttgcccgtagatggtgtccagccactccgaagtccaattgtccaagctccaaaatgcaaggactcttaaaatacaaacaccttagaagtctctgtgagtattaaattgttgagataagaagtagatgaaaaattatgattagttgaaataaaatagtaggtgaaaaataaataagagagggttataataaattcttatgcaaaagatgacttattttggaacgacgagagtataacaaataagtaaaaaagaaaagctataagtagtaacttttatttaactatatatgtcataatcaaaggtagtagaagtgaagaaaatagtaaattttgtgccacactatatatgtcataatcaaaagatacggagagtactaggagtaggacattatacgggaactgaaaaattagacctttttatgggtacgcgcactacatctttttttttcttttctttttctcaaactggtcctcctctgctctccactacatggcctcccccacactcttgtttctctctcatggtggttccttgaatgcaaaactaactaattaactagcgttgaatgatttttccttcaaaattatttatcccttatattcactacaactaaaattttacaacaagatcaaatgcaattatattttgatgaaaaaaatacaaaacttagtcaaatattttaattaattttattaaaacatttaactaagtttcaattaattttattaattcaaatgtttcaattaattttattaaatattttagaaaaatgcaacatttaagaaatattgacagtatcactgacaccttttgcataaaacgttgagtcacaatgagtgcttcatcgcaaagaaaaaacatacgacaaatctaaatatacttttaccaataattaattatgttgaatttttttatcacaagtgaaacatcaagttgtaaatgtttagacatcataaaaactagttgaaatataaaaaataaccacgtgaaacatctacaaatgaactagtgaaatatcatgaaataattattgaaacatgcaaataaagttgtacgcaacattaaaaaaaaggcaacaacaacaaaacttttaaaaaatcaaaatataatcatataatattttgtcgtaaagatttaattataacaaatataacaatatattcaaatcgtatatcggatatcgtacaaagttgctttatcacttggaagagtagaagccaaaatggtcctcacatgtactgatccttgctaaattggggcatccagtttttctcctcgcaccaaacgtccgaggagtccaaggactaggcgtccaatgtccgatgagaactaaaattttggacgctactgtggtacgcatgccattgcttgttatattggggcatccaatttttctccttgagccggatatttgaggaaaaacattcttttagagatgacttagcgtcggacgtccgacgaaaattaaaatatcatatgctactgtagtacgcatggtggtcctcctatgctctgctccacatggcctccccccttctctctcactcatcttccatgatgtctcattaaataccaaactaactactaattaattagttttaaacaatttttcttctaaattatttattcaatatatgatttgattatgctgttgtattcgttacaattaaatctttgtaataattaaatctttataataagatattacattattacactttaatgaaagaatatatataaaaaaatgttgcgtccttattctatatgacatatgaaacatcaatatgtaaatgttagaacatcacaaaacattgggtgaaatataaaaaaaacatcacttcagcatttaaaaatgaactaataaacatagtaaaatacttaatgagacatataaacaaaactgtgtacaatattaaaaaaaatctacaatagcaaaattactaaaaaaaaattccttccgagtaacttgtcataaagatttaattataataaatacaacggcataatacgataatagctgaaataaataattcaggtgaacaattattttgaagattgatagactttattttatcgcttaagagtgtgtttagttcacgctaaaattggaagtttgattgaaattagaacgatgtgacagaaaatttgaaagtttatgtgtataagaaagttttgatgtaatggaaaagttgaaagtttgaagaaaaaatttgcaactaaagtccttaaaagagagatgaagtagtgcactcctgccatgtttgctatatcggggcgtcccttttttttctcgggtagcaggagaagcattctctcaaagatacgactacctcccccaaaaaaaaaaaaaaatcaaagatatggggggtgtgtggggggagttgaaattagtaccagtcaaataacgagaccggttttgcagatcagatgaaatcatatgatgttctccatgcgactaacgtctcggcagtcggcccgatgttccttccgagcagccaccaccggtccattgtaaagtccgacgccgaagctgtcaccgaccgacggagcaacacgccatcacccctgcgcgccgggtggaatatggacgctcgccccgcggccgatacggagagcccccacgccatcacgcttcacgcaacgcagacgcgagcccagccagccggcgggcgtcacatcccgatgtgcatgcagctcacctgcacacacactcgcgagtggagtaaaatcacaggtcaaatggtggccgccatgggtgaaaagtgagaccgtgaaagcgagcgggctgcgtcgttgaaacaacacgcgcgctatagctgacaccgcgacacctcatatatacatacacatattaaacatagactaataataaaacaaattatataatgcacatgtaaactacgagataaatttattaagtctaattaattcgttattaataaatatttactgtagcaccacattgtcagatcatggtcaattaagcttaaaagatttatctcgcaatttatacgcaaactgtgtaattatttttttaaaatatttaatactccgtacatgtgataaaaaacgttcgatgtgtgacttggaaaaaaaatttgccgtttgatctgaaccccctgtccgtagtaagaataggtgggtgcggataagcgcggcggcccgggggcgccgcgtcgaggcggcgtcatgcgcctcatccgcggataatcctttttctaatccatcgttacctgtagcacgcatgctcaaacgcggccacgcgggtccaaccgcgaaggggaaagggaaagaaagctgaaagtcaatggcttctgttctactccagaacagaaggggataggggagtaccagccagcgcgctggcacgcgacgtggacttccgtatccgtaaatggcgtatgcttctagttaatatcatcgttaagaatgctaaacaatcattagatcactggacacatcaaatcaaaaaaattaaaaagagaagccacagtcaaacccgtccatggtagtctggcatctggcaaaagctgctagagatgctcgacaagccgaagttagcagaggccgttgctttgcatcagaacgaaagcccattatggctgaccagctctcctccgtgctccggcccaactagaggaataacccagcaggggcacagtccggttggtccgttgcggcccataatatccgattatacgatacatggctcgtattcttgtttgctcgaacacgagtatagtgtatgtatacatgttattcattcatcgtacaactccatccgctcgcatacgtatacgtaagtaatatttgtatataccaggactatccctgttcggggcttcacgggctcaacgccgcggcggggaagacagcgagggggatcctcacggtgtgcttcttgtcgcccctgaggaccacctcgccgaagctgaaggtgttccccggcgcggtggtgttgagcacgatcctcagcgtggccgtcgcgccgggggcgac

SEQ ID NO: 12468 - DNA, 21132 bp, Oryza sativa
ggcgcccatgtcgaacggcgtcgcgcgctccagtacgcccccgtcacgccgcgccatcaggggcctcccggagcggtcggtgacgtcgacggtggtcatgatcgccgacatgaccatgacggggctccacttggggtgcctctgcctgatcagggccaccacaccggcgacgtgcggggtggccatgctcgtgccggacagcatcgcgtagctctcgccctggaactcgaccatggcgtcgctcgtcgggctccaggctccccagatgtgatggcccggcgccatgacgttcggcttcagcacgtccgccgcctgcatctgcatgtcgtcgacgtccgggcccctcgacgagtactcggcgacgacgggcgcctccctggtgtagattgctcgccgtccatccagaattcggatggttgcgccgaacttggtgacacttccttccttgtctcggaccaagttgtcgtcgtagtactccaatagagcctgcatccggttgcaaaacacaacagagcccagttactgcataagagaatagtaaaactgaacaagggcattagcaaatcatttggtctgcaaaaatgtttctacaatcacctgtgcatcagcactgttcacaactatggctgaagggattgacgtcggaaatgtgggatgatattcaatgtcggagtcactcgaagaacggtcagtgatgataactccggcagcaccaattttctgaatcgtatcgacaatgccagcaaggaagtcgccttcgtagtagtttgacgacacaaacatgcaaataatcaccttcccctggacaagagatcttatgaagacatccggatcttggcagttggaagatccaccagttgaattcgtgttgcacacatcatcagccaatgctagagggtacatggtctcgcctggtgtcgatgctggacagaacaaggaagactgttgaaacaaaattggtaccaggtgaagaaattgaaacgaagaaagccccagtataatgttagttttctagctacttcagtgcaaccctaacagaatgatgatgtaatctaggacatatagaatctaagagcaaaatgaactacgaattctgaaagaaaaagaaaagagaagtatggaacttagtatcatcagttaaacactagaacttgagaaggctccaaattcattaatttcataggttgaaatgaattacgtgataggccgccgcaagagaagacttgcccatttccaattataattgatttgttatacttcctgtcagttgtggatgccccaacacttgttatccatgggctgaacgaaactactgagtttgcatcagggcctccattgccaactgcttgaacaactgagatcccagccttggtggcaaggagaagttgtgtctcgagcaaattgaggaatgatgctggcccagatgtaatagtagttggtcccagtgaaagactgataatatcgacgccatcttctacagcctgcatataagttacactggcattttaacctacggaagagaatagtagttatgaaagaagtatgatttacaaaccttgtcaactgcagctataacatctgacatgtatccaccaaaagaataggcagctttgtagattgcaagactgtcacataatcagaagagacagcacaacataagagtagttttgctttgaacatctgaagaatggaataagcattgttcactcactgagctccaggtgctacgccacttgcatgcccaaagttgtagccctttgatattgctggcgtatgaaaattgccagctgcagtggacgctgtgtggctgtgtaggcaatgttttgatcagttggtacttggtaagtccttgaaattaaaaatgcaacataggcaagtcgtaaagaaaaagtgattagcattgttagcaaaggagcatgcacctgccatggccatcaggatcgtaaggagatgcatagtgcattgtagcattgaactctccagttgcttgaccagcacgtgcaaaccacctagctccaacaatcttaccattgcatgaatctggaggaaatctttcgccagtttgacatgttcctttgaaactggccggtggtggttttgcttggtccgatgtgcttaaaaagcttgggttgctggggtcaatgccagtatctaccatgccaatgactactccgtcaccagccttctcggcaccaccgaggagcggccagactacattagctccaatgtacctcggagtgtatgtggtcatcttggccatttttatatcttcttggatgagtctaactccttttgctccactaagagttttaattgcctattacacatacaacaaagacagataaatatttcataaacaggtaagcagataaaagatcaactaaatagaagcaccttttcagattttgcatagatagcaaagccattgagaaggtgggtgtaactgtatagcttcttgtaagatccagctgggagaaatgaatccaggaagatatcatgcttcgttgtggtcattgccttgtacttctgagcttcctcacctctcctggatgaaagttcagtcataaatgttcttttccaaaaagaattaaactaacaggattcctaaatggaagtcacgtacattactttcttttggcttgacttgggggaaatgattgggtcatcctccatcaccaccataaaaacctttgcaagtacatgagatggaccaccatttaggatcagaaaagtaagaacagaatagaatactagacatggtttgcaaaaagccatgacaatagtgtcacttgaacaatcgtatgaagtttgaaacttatatgcctgaaggtatgcgtttataagtgcaagcataggattgcctgaaagaatgttaggtgaggatcaacaaatgtcttcctcatagccaagacaagcatgcaataagcacttgcctatctccatgggagcttcgagtcctcaactaccaagcattctttttgattgtccttgttttaattaaagtcgagttggattatcatcctggagtttggtgaagaccgaaagcacacatacatctccaaacaagattgatgaataaaaccaaacaagctgaagctgcatattcggaggttaattaagggcaagtcaatgcactttgggatgcagttctcagaatagtattcccctgaatctacatggacagaatcagttctttttttttttttagataatggatagatattgtgaaacatatatgcatctgatctgatttcaagaaagagcagttacactgcaagcacaaaaatacattttctcagtttcctccttggcattctttgagtgactgcaagaaccaacctagcttccacctccaccaaatcacacaaagatccatggtgacgctgttgtgcttgtgcccaatcacaaggcgcacctacaggaagaacactcttgactctttgcggcccgaatggaaaatccacggcaccgaccccgcgccggcggaacaataaccggagatcttgcgacaagctgttactacccaaccatagttcttccgttccgcagggacacgaacgagttactaatacacagctatgctaaggggaaaagggcacaaaccatcggccccgacggcctcgatctccatggctgcttccttttgccgtcttgaagtgacaccaccagggttgggaggaggaggaggaggaacagggagtcccttctcctcccctcgccgcgagctccccattttttcctcgttttgcttccgccgtgcgattgccggctgccgcagcggagaacgaagctagcggtagcggagaacggaaagaacggtgggctgcagttgttctactaggcccaaggttgaccaagaaaatggcttttcttggaatttgggtttatcttggcccactaaatatggcccatttaccattgtgatgattacaaattgaaaaaaaaaagagtttatttaactccgaattatttcattggttcatttgaccaactaaactatttttggttcattttacctttaaactattaaaaatagtttactttattgcttaatatagcatttctcatatttgattctctttacatgagtcgcattttaaactacaattttgtagagctatagataacactattatcaaagttcaaaaatattttcaaaagctaaaattttgtagatccattggtgtttaaatcatgcttagtgcttcaaatatttgtatatagtaacgattttttttgaataatattgtgaggtaggttataatgtacctaccaatcctaccaaatttcattgcaatgaaccattaggaagtaatatgatccgtttttaatagttcagggtgtaaaataggccaaaaaatagttttacttggctaagtgaaccaatgaaatagttcaaagtagtaaaatgaattttttttctcaccgactcaccagagctaagccctgtcgttgtttgattgcaatagttgaacaatatagcaatagggggtgacagattcaccgctactaggctgtgtacatcctttgggtgtagagaccggtttaatccattatctaaaaaaagattcaccgctactactactcctttttaaaggagtatagacaatggaataattcagtaagcaatgaaatatacattctattccaggcattgtttcaaacatgggtaattttttcatgattttgatatgggaatgaattgttctccaacacttcttccttttaaatttgtgtgcaatattattgatgttcagatattttgttagttgtaaacataagcttaagttaccttttcaataaggaagaggattacatcttggcctctgcagcataatacaaaatccagatggtatttgactttgggcaattgggcctgaacaatctcagcttttctcaatatatatactgaacacccacatgaacatggcataaccttttctgagttcaaggtatgggcgattggattaggatttatactatcatacacctcattatccctattccaaattaaaggacaggctaggctgcatgcctagacctgtagcatctaacctacaccctccactttgattaacagatgattccatgctagccttctggccacaaatcaaaatgattaattagcagttgcaaagccgccctctctctttccatcaaggccaccattagtggcagacgatgtgtcaagtgtgataccttgtgttgttctttcttcaggaaccccatatagtgccagctagctgctgcttaagccctttttacataagcatatcctacgcgaatagtgcttagaccgctcaggcaggaaggctgcagctagctagacagctaatctttagctatataatctttactcgatcgagtattaattacatacagtattccaccgatcgatctgcagttctgaataattctgacgctttcatgcagcagctcgtcctcgcgttgatgtgtggctattcgatcgttttatgcttgctctctgaatctttgactgctctgaacttgtcttggcctctcgttcatgccgtttaatgtactccagctatcctcatgcatatcactatgtctacaaagtcgcgtgcttttgtaaagttgatcaaggaattggatcagtattcaaagaatcacttttattccacagttttattccgcttatcatatactatctcgattggacactttttatcaactgtttaatatacctaaccaggtcaaggatttgattcggcatgctgccaaacctagtgattatgggagatgaccatcttttatgctttggttcttcttgctgaattccataatgtttgctcatcttatgtatgatcaggagatagagcaacttgattatccattaacaatattatttcgtccttttaatttggattcagctttgatactttgttgtaactgcgcacatgtgtgaaactactggaaataaaataaattcaatggatgagtgagatctaattacctgacagtcctttttgcttaataattttcaccaagtgtgaatggcttgtcgacacgtcggcatatgctcatgcatatgagatgtttcctactagatcatgtttatagcatctctctcgctgcctccttatagggctcatgtagatttgacctcctttgcttgtggttaggtattaatcttacctgctaaaccagttgtcatcaggagacaggaatcatatctggtctctgctgcatgcatggatttgatcaccatttacaaacagctacttgaggcatctacatgtctgtacctctgaagtctgaacctcatgccatgtgagcttcatttgttagcaagcagacaacacattagcttttgaggagccatgattacggagtaatttccatggtcacagtcacagcggactctgtttcgataatataagaggatttttacagtccaacggtaccttacggtaccgattattgaccgttggatcgagacagatcgaacggctggcgtagatcggtaccgcggggtaccagttttgtccccgaagcggtaccgagtgatgataatcggtggaagggcagtattgtaatttcgcgtgcaattgatgggtctggatcgagatcgagcggcttgaaccctagcgaagctggatgattttcgccgccgccgccgccgtgttctttttcctcgccaccgccgccgtgttcctcttccaccgccggacttgttcctcttccgccgccggacttgtttcctctcccgcgccgccgccgttccgttttttctctctcgcgccgccgccagactttatcctctcccacgtcgccagcgttcccttgttgctctgcgccgccgccgggaacgacaacgacttggacgccgctgccgccgggaacgatgactcgaaacaggtactccctcatccacccttgctcatcttttctctcccgatcctacccatcccggattcaacggttagatgtgttttggtaccgcgcggtaccagtaccgcccggtacaacctgctgtaccatagcaatcctcataatataaacatttctacgtatttttggcatttcagctcggttcatattcatcgttagaaatgcttacttatattttaaaatggaggaagaattatatagagtacagcagtatctagcagcgacctagctagctgctagcaatttctgcatgcaggagacttcagagatcagatcacttaaattttttcaactgtatatagttcagacttttagattgttcagcgttggactgggtgtacagtgttgtttcagagaagggcatttagcacaccccaactgttgagcatcagagcatgtgcaaatatggctttcatgtgtcctatgagctgaacacatgtgtggacactgagccagtgagcagaggctgcttggaaattaagctgcaaaagacagtgccttaatttgaagctactccagcatactccatgcaagctctagctagctaggtcagtatacttgcagtagtcagtactcagtacatatatgtgctgtccgagcgcgagcagagagagacttcaattcatttcccaccgtccaaataaaacactgaattcgaatattgaatgctctttcgcgtcgcggcatatatatatgaatctccgatcgatgcggctcgtcgtcgcagctagcagctagcacagctgagaagagatggatcagtgaagaagttaaaccatgagcaggctgtaatgacagtgggagagagcttgattagtttgcaggttaattggttggtgtagtagtcatggcggcgctgcgtgacgtgctgctgtcgatcgcgcagacgccgcaccggctgcggcggcgggcgctggtgacgtggacgccggcgcaggagacgagcgaggtgagggacaggtcgggggcgcggatgaagcggcggctggagtggtacgacctcgtggggctcggcgtcggcgggatgctgggcgccggcgtcttcgtcaccaccggccgcgtcgcgcgcgacaccgccggccccgccgtgttcgcctcctacgtcatcgccggcgtctccgcgctcctctcctccttctgctacgccgagttctccgtccgcgtccccgccgccggcggcgccttcagctacctccgcgtaacgttcggtgtgtgtgcctgccattaacctcttcgcgcgcgcgcgcgcgccaccataaaatccgcagttaatggcgccgtgcaaacggttcagggacattgttgaattaatccaacgcactcttcaacgatcgatggatcaattcaatcgagcgcggttaattgactccatctgttgctctcatcaggtgagctggtggggttcttcgggggagccaacatcctgatggagtacgtgctgtcgaacgcggcggtggcgaagagcttcacggactacctggcctcgacgtgcgggatcacggagccggacgcgtggaggatccaggtcgtcggcatcgccaagggctacaacgcgctagacttcccggccgtcgcgctcatccttgtcctaactctctgcttgtgctacaggtacacatactacagatcattgttgagtcgcatttgatttgattacacggacattgatccgttgataaaaactgtttattaagtagaagtgaatcgctttgtgtttttcgttaccttaagcttatgggtgaaatgactcaataatacttcttcgatttgtcatttttgtactggtgtgtacttaacctaccctagctagcttgatttaattaggcgcagcggcatgcatgtggttttgtgttcttagatcctatattttatggcagacatggtactggcagaatagagctaatgtccccttgccatgggctagagttcagcatgtgatttgattatgtacgtttgtcagtatagtttggaagaagatgagaaatgcgtttcaaatgtgcaattcatcaacaaccagcagcattgatggttggttggtacttggtttttgatggatggattcgtgtgatgctaagtgaagcaccaaggagagcgcgatgctgaacatggtgatcacggtgttccacctgctcttcttcgtgttcatcatcctggccggcctgtggaacggcagcgcgcggaacctggtgtcgccgcacgggctggcgccctacggcgtccgcggcgtcctcgacggcgccgccatcgtctacttcagctacatcggctacgactcggcgtccaccatggccgaggaaatccgcgaccccgcccgcgccctccccgtcggcatcgccggctcagtcctcgtcgtctccgcgctatactgcctcatgtccctcgccctctgcgccatgcttccctacaccgaggtagacacacattgtcactcacattgacacattactagctcatcatcattctgatggtgacatggggtgtacgtgtgtatgtgtgtagatagcggagagcgcgccgttctcggcggtgttcagggaaaagccggggtgggagtgggccggggagcgtcgtcgggtccgggccgagcctggggatcgtggcgtcgctgctggtggcgatgctggggcaggcgaggtacctgtgcgtcatcgccagagcgcggctggtgccggcgtggctggccaaggtgcacccttccaccggcactcctatgaacgccaccatctttctaggtacctcaaaacacagtacaaggttgttgttaacttgtagatttgtagttaatctatatatataacggatcgattgatttcaacttttggagtacgtactggtatttatgtgttcataaggttgtatgtttttatttttaagaaaagttttgcaaggttttgtagaattgtggttgagttgttgtttatctcttctggttgaaagaggttgagaggttgtagatagagtgattagtgttaatacatctgcagtttatgccatttcacaattggagtttagaagtggagggttaaaatttgtggagattgtgagcttgctatagatactatcttctttctcttttacttgctgccaacattcaacgattttaccagttatatttttaattttgacataaaccagttatatgtttgaaaccctaaattagttaatgaagattgtattcacagtttttttgggaaaaagattgtatcgttcgttagttttgccactagaaatgcctatatgatattataatgttaaatgtactgtgataagattacgagaactattggtcaaagttatgtctcgaaggccgtgaaatgtcaaaaatgtaaatagaaaagttgaaggcagtacagctttgcaaagatctgacaaatgaggtaaactagtagtgaactgatgggtttatgtgatgttagaccccctgcaacctacataataaacctaatttagatagagcaaacggaagcataaaatacactaataacttcaccgaagtcaaggtccttaccactgtatcagatcatgaaaactgcaatgcaggtacctttttttagataatgtcattgcaggttacaacttatcataattcataactagcagcaatactatttctggcatttcttgaactgctcttacaaatatcatcaccattatctatgcgcaggattgtgcacagcatcaatcgcactcttcacagagctgcaggtagtgttcgagatgatatcaatcggaacactcctggtcttctacctggtcgccaacgcgctcatctaccaccgatacgcgaagctgggtgccaaccgatctctgcatgtcctcctcttcctgctcatccttacactgagctcccttggcttctccctctcgaggaggatccatgggcaatgccgatggggaatggctttgttcggcgccacctccgtgacgattaccgccatgttccactgcgcggtacggcgagacatgccagagccaccatcagagtggatggtccctctgatgccatggccggcggctgcatccgtcttcctgaatgtgttcctgatgaccactctcaaggtgatgtcatttcagaggtttggcctctggagctttgtgatcatagtcttctatgtctgctatggggtgcactccacatactctgcagaagaaaatgaggctgtcaatgctatgattcatcatgccaatatggacatatcttagcaatagcagcacataatacattgatctaggagttactttggagctaactagcttggcaattaggctgtctccagaatggtcccgaatctaaagaggatggagggcaaaagagaagctgcttttgcattaggttagactcttcttttcctgcttttgtgcttgcaaattggcttgtaacttttttttttctcaaagtgtacatgcaggactgtgaatggcatgttttccttttgatcaaagaccagaaattttgtctactttaaacatagaaggtgaccatttccgtagaaagtaccaagtgacagcagaagagtaatttttaacagctagatttaagtatctgtttttccgttcttttagaagtactgattaaatttacaggtgcaacaggaaatgccagtgcaaaagaagacaatcaaatgctggtttactggcttccatgtccaaagcaatgcacaaaatgcaacctcgatagttatattttttgtaagtgtagccatgaaaagcaacataacgaatctggagaacatactgatttcgttataactgaaagtagttgaatgtatcacatgaatataccagatataaatttcacaatataggcaaaaagaaaaccctgcagatggcagatacaccttcagtataaaagctaatgttttgatatatttgaaacagagaaccaaaaagtgctattttcctgagcattcaagaacattgcactcagatgtatcaaccattaaaaatactccaagtctggaccaatacagaaagatccttaaatttaccttcctgtgcccagaatatcgtaccaacacggttcaagagaacacaccgaagtcctataaacaacataacagaaatgttcttatcaaataactaatatttgcatatgcaataaaaagatacagctgaattatttcaaaagatggctctagttctttgaaagccatgggaattttcaaggaatattccacacaaagcaactctcaccagtcgcaactctaccttcgaaatgatttctgataaatgtaactgcttattatacataaccttatcaagaattcaaggaccacacatggtggaacacggaagtaaagccgagcatcatggagaaatttcgcgctttcaaaatcaacatgctacattgagtcaatgagcatacctgaattttcatttgctgatgctcatctcaagtggttgcccattgatgagcatgccagttagctaaagggtaagcaaaaacatgttaaaggaccactcactttgattgtggtccaacatcctacttaagtggcacttgccttcatctgcagaaaattggctgacacataaagggaacactagatttcactgttatattatactcaaaaaagtttcaaggagtcatgtggagttctcattggataggaagattctaggcaataacgaggtaactatagcatattgatcaacaatatcctgatgtttttcacctaaagcaactaaacttccagctcagctgagagcatgagacttggcatgacacaaacagataaatcgataaattagaatatcaagcaaagggaatatgtcagttgtaaaaggatggtgggcgtatttcagtaatttactcacagatgcctctaaaatctgtgtcacaagcgtggctcgatttttatcaaaaagacaaaaacacagacaaaatagatacaattaccatcaatgatctgaaaaccctgtggcaaaataaaagttctaatcaagcgtagaattgtctcaagttggttcagtcaagaaaataatggttgcaggcagtgttcaaattttaaaaaagagaacaacttatgagcaccgcaatattttcaaaaagaagagcaccacagaatctcactgaagcaatctatgtattaatgtatataagcaagtttaaacaatttcaagtgggaagagaataaatttacctttaatggcaagaagtaagacggccaacaatttctgagtagaacatgccctaaagaaaggcctcatggtatcttgatatgaaaaacagtatgctcaacattacagttgttctacaaaaaagagaattttctgttttctctgttttctgttttgcaatagatcaacttgattatcaaaaaagcaaaatttgattatcaaaaacagtatgctcaaaatttgattgcagtatgtttttctttgtttcctggtatctattgcttttgatcactctgtagtcaaattttgcatggaattttctggaggcattcaacataggtgctatttattattttctaatgtatgaatttatttagtgcacactatcaggaaacaaagaaaaacattatatgtaatttgaacatcactactgctttttccttccgcaactgcttgaaataaccacttagagagttatagaatgaagacatacaacaaatgacacaacagaacaatgtgtacaactgtgccatgtaatggtcaactggctactggatattcagatctatccaacaaaatgacatccagaacaaagattatgctctgcttaactataaatatgagaccacgacatgagaacttgcttgggctaaaaaaatttagattgtagttctgcctctcggtttacaaagttagtatcagccccaacccagtaaggatggacgaattagcaaatgaattctaaatccaagtcgctggaaaaattttctgctatgaaaagcgaaatctggtacaatcaggatacccccaaagctcaacaacatcaatatttccagtgaattcctttttcttccgcttacataatctgctgttagggcatgtaagtttttatcttgaccattcattcatctcacctcattttatctcaaccctctattcatttccatttcccaatcccacccctcataacccttaacccattatccaaacacctccttagggcttcaattgactacttgggcagttgtcacaaaggtatcaaccatgtcgacaagctgcaaaagaacaggaataactgatttttggcggtcagaaactgcaagtctggggggagatgcagttaaattctactatattctagagttcagatatcttcaaattaggttgccacacacaattgaacaaattaaagcttgagacaaaacaataaacacagaacaggctaagttattattttccatacgccatacaagatagatagaaaggttactacgatttccaagctacgcctacatcagacatccatcacagtacatatgaacaactctaattaactcctaaactcgcaagccaagccagtgggcaatcaggacaagcaagaaaaccttgacaggagacacctttgcgccaccgagatttactctagggagtcaatgatgcggtcgacgagcgcttccatgagcctccgctgcgaatcgaggtgccggagtgccatctccatgcgcatctgctgcgtcttcctcgccgcctccatccgcctctgctccgcccgcaggaaaccctccccgatcgccctcagcgccttcaccacgtcgctctccccgtcatcctccgcatcggcatcggcatcgccatcaggcagcctcctcttcttgggaggcggggaggagggagcgggaggaagaggcggcggcgaggctggcggcggcggggagggggattgcgacggggacgcggaaggggaaggcccgtcgaggagatcgatcgcgtcgaggagcgggcaggggcggcggcgcttagatcggaggcggcggcggagcttctcgaccttgtggcggcactggcgcgcggtcttggtcggggtgaccgcgtcggcgacgaccgcccagtcggcggaggtcaggtgcgcccgtcccaccgcgaggcgtcgcgcggtgtaggcgcgggcgagcgcgagggtctcgtcgggggtccagcacggcggcggcacgcggcggccggcggcctcggcgttggtgggggaagaagaagccatcgcaacggtggtgagaagtaggcggaggcggaggcgaaggcggtggtggtggtgtggggcgaaggttgggggaagggacggtgaggggggattataacggaggagtctttttagggcggcgacaggtgacggtgggcgcacgcggacgtcggtggacggcgtcgacgacggcgccaaccgcgggttgtgggggttgacatcttgacccgacacccccgcgcggcgcagccgcgctcggcgttaaagtttcgtgtccgttttcttcttttctagctttcgtgtttcgactttttgcgtggctaaaagaagtgtttttttgttgagcccacaggttactctagccgtcagatcgaataggataattcgatttgtatcaaatcttaccatttccattctagaatatatagattttaaagttaaatacggttattatgaaaaccgataaaattaagtggtgaaaaattataataatttagtagaaaagatatatgaaaaaattaaataataaagaattataattggttgagaagaaaatatttgtgtagaagatattatatttaagataaattataaaaaggctaaaaattattatattttaggatggatatagtgttttttttaagaaaaatggtacaatttgttactgtttggccgtagttttgtgttccgccgtgacgcccgtgggggtgccgtttgccgggagcggcggcatgcggtgcgacttggtgtaacgccgtgcgcgaagggggtagcggtagcgtgcgggagcggcaaggtggcgcgcggtgcggcggcggcggcgcgcggcggtggggccccgtgtgtgcgtgtgaccgcgtggtttcgccgacgcggccgtgatgtgagacccccacatggcgatgacgccgcgagcggcgcggcgcgacccaccgctcgcgttctcgtgggcgacgcggccgggtcggaggatggagcggccgagacgtcaccttaccgtgcggcgcgtgcggtgggacggccgcaccgacggggcccgagtcgcggtcacgcggggtcgcgtgccgtgcgcggcagccggggcgcggcgcccgcgggttccgccgtggatggcgtgtaggcgcagctcgagtgaaaccgtgcaacggcgggcggcgtgttgactcggccgcctcgatcaggatcgggatcggggcagagtcgagagacccacgccatcacggcgttgccgcccacgtcgtcgacgtgccttggggtagggtgtggctggtgcgggccgcgggcgtggagctccgcccacttgcccatcagtagcagtaggatgacggatgacaacaacacgaaaaattacaggtgatgccagggtggcagggttaacagaaccagccaaccatgtcacctgtcaccggggacaaacaacaagctatcatcggtaggatgacggatgacaacccgaaaaatcagagaagataccaggattaacacagaaccagtcacccaggtcttcgggacaaactacctagtagtgtcctaccatcagccccgtttttggccaggagctgattatatgctaaacaactttatttatgtttgtacgtccttgaagatttaaaagctaatgctaaaaaacctatgttaaaaacttgtaaaattaactctaaaattattttttaaaatttaaattttggcataagctaattttatataggatgaaaaattgaactagtaatactttcaacgaaagctaggtagctaattgttaaactctaaacgagagctaggtagctaatttgtggaattctaaggtcattcataatgcaagctaatcctacaagtgtcttgagaggtgagagaatatattctcaaattatgtggatatgcgccaatgtgttgactccgtccgcgcccctgctgagccgctcgccccttatctgggaggcgcgctcttcgaccgcctcgagtgcgcgtgccgcaaggaacttgaaccgcacatgcgctgtgaaggttgtggctctgagtcaccgccgcttcggagatggaatccccaaaatcaccttcccgccccactgattcgtgcctctcacgctcggatttggttgctcccacccttgcattctcgtccccatgttgcatgtagagctagatatgttggtgttgcacgaggagctcgggccgtcccatcaggagaagctacaacaggcgaaaatggcgctggagatggatgttttcccaccttccttcctcctcctcaccttagccaaattcgagcttctagcccagggccaacaatctccaatccacttcggagcctcatcgttgagcctcgaccgtgcgatggcagcgctgacagatggaggcgaagcgatgtgagggagaagagacgaagcaaccggagggagaagaaacagacacgaggggtacaaccgtacaatggaattatttgttgatgacacttgggctggggatacaatggtgtttaaatcttctgaagataaagatgaagattaagtgtttcacgtagaacgaggtggtaataacgtgtgattaattaagttttaattattacaaacttgaaaaatggattaatctgatattttaaaacaactttcgtatagaaagttttcgcacgaaaatgcaccgtttagcagtttgaaaaaagtgccgctttaatccaaaatttaatccactattttaagtagattcgaacgggccacagaagaccactcagcactgtggcccgtgtagcccaagagtgtttcctcaacttaggttgggtccattttagtttggtttgttgagcctggatacgtgcgtatcaaagttaattttcttttttcattccgattctctatagcacagtgtgaccggcggtttaagtggtcctttaggcccatgttgcagttgctccaacacggctcacacgagccctttcccacgctcgagtgggcttgccacggccgggccacccgtgccctcaacaagagtagcctcgtgagggtacgcccgtggctgataatctgatatgtagtagaatctccgatctagcaaccctcaaaccacacgccgcgctatgagtgtaggacatcgcagcgacacacgaacacagctgctctagaggggaatctccgagatggcaacccgaaactatacgccacattgtgaatggcctaaggccttaaagtcgtaagatgcattcctatatagaccttcaaatgatttaatgcattctaacgcagtaacatccccatgggggctgaagcatcatcagtacaaattcacattggccgtagctgagcctcaggacattcaagtaatcaacccccttcgacaaggctgtggcgacgcaaactacgttcccgatgaaactgtgaatatagcctataccacaagtccgcgatagcaagcaaaagatatacggagcacatcatcacagccagacacaaacaggcccaatcaagtatagtttttcatgcaatctcaacgcaaccatttcatacctgtacatgaaatccgttcccttgcttacaatgctcattacaaatctgaaaagtagaaaaaagaagggagaaaaaaggaactctgatctgcgtttagtatacctctcatgaagcagttccttccaggttatggacgaaatagtagtgcagcaacaagcagcatcttgtataacaactgcactatctactagtataaggtcaaagcacatcttctaaaacaaccaagccagtgctccgctacagtatcaaatcgatctcacaccacatgagaaaaaataaagtactccagtacttggccaagcaaacagcagaaaaataggcggataaaatgaatttattagacatgatttaactgagataaacatcaacaagagatacactatagcattcagaactaataaaatatatgtgccagttgattctactgaaactattcagatgtcaaaattagaagataccatcaccaaaaaagtagtactgaactaaatgaatgcaatgaaactttgtgaccataaggtataaaagatgcattgtattaaatattaataattcaatagatatgtagtagattaatatgtgtatttgttcttttctacttcaaatcagtatagttttgtagctaaagcagctgaaataatcaactaaactgtatggttaagttttctgttcaccaattcgaggccctcaaacaaatcgtttatgttgctttgcatttgctacttgaacaaaaatgcttccatagtctatcttgtaaaattatgatcatgctgttttctggctatcttcattccactaaattcaaccaactgtcccttccttcccctcctccccttctattttagacaggcacctaattatccaacaacatggtgctgattccctcagatttcaatccaatatccgaattcaccgataccttctctctgtgctggatagtgcaatcttccatccataaatgataaactaatgcagttcaccaagatctgaaataattgtgggttgcccttatgggatcctactccaacaaacacactaaacaggaagtgatagaaatattaaaacatttctagttactgcaagggctggcaaatgtagtacacacataaaaatttgaagtgtaaaaatgcaaactttgatctcaggatccaataatggttattatcacttatatgatgaatcgagtaaatttcagacaatgcagtcacttactgtattaactccttcctatacctcagagaatggttgtattaacactaacaagtttgctaggtttgttgcagctctctgtatactgtgtaattcgtatttggtagtattaaccatcaatttcaccaattcactagaacacacattgcatccgctactgcctatagctatcaacagagaacttgttccctaatgcgttaatatcttggtaaaattgtctatttacaaaaaattgttacaaaataaatttggttgtaagaaatttggcccaaatatatctccatctaatgggataaagggcccaaatataccataactatcatgttatcatgatggtaaatcaaacataggtgtcatagcaaaaccatatttatttttttctgaaacttatttagtcagtgcatcatgcttcatgcttcctgcaaatttcttcaaagtttgcaattgtccaattaccacttctttcccaaagatatattatccatgctccatgcagcacttgacagaaattacagaaacgagtagcaagtgaaatgttgtgctcaatgatggcattgcttgttagatatacctgggtgccctgaattctatgctgctgctaatcaacagcggcaatccaagaccataatcatagttctgtaactgcaggttctgttatcttaaacttattatggcaaggcctaggtaatcgcttggtgaaagaactactttgagccatataaatggtttctcccaatttcagcaaccaacaaatccaatttttcagcagttaccaaataactagtccagagtttcagtctgaccaatcatcttttggcacagcaaattaccaaaccactagagagcagatgccaaatgtttcagaagtaacagccttacacaaagcgcccccttctaaggcttcatttgtaagtctgatcttcagccagcacatcacaagagatcttcaaggcaccatgtatttcagggaactacctcataatactattttactgaaacactccatatctctcaaaaatgtttagaaacactggaagtaaacatgccaagataccatagctggcgattatgttcacaattcttgaccaaataaagcaaagccttacattaaagaaactagccagaacatccacaagactattgctttaaccaacttggtgtttctgacttctttgatcatgtctaattcaggagccccacacacaattccacttcttgtccaggtccgtaggccttaaattaaggagctccatacaatccggggcctacaccaacctcctacggtgccatgtgtgttccatagacgatatgatgcaaaatctgtaccatcaaaacaattcatggttgatcacggagggtgttccttgtttgatagaaggg

SEQ ID NO: 12469 - DNA, 688 bp, Oryza sativa
  unsure (1)..(688): unsure at all n locations
cccccggggtgaataatcatccctataggggcgtctatccactggaactcttgaactatagtcaccaaaggtagctctgcttcttggcggaggaagttcatcacgccttccatattctctccttgggcttctctttgggtacacaggagctgtaaacagatgaagtatgaaaaagtgacctacagtggtttgcacagcaaaagaagagagagagagaatagnttgcncatacattctgcacactgggnggccttctgtcatatgatctctcgggtggaggcaaacgcctaactctatctggtattgacataacagggcgcctatctctaatatctactggcctcttcagtgggcggctcctgaccggtggtggtaagcgactaacatcgggtcttaaaagacgaggtgnaggccggcnaagtgaaggagaacgatcatatgcaaaacgtccacctcgaggagcaccctgcccaaccctaaaatttcctcttaatccatgcttcattctaggaggtctctgcaatggtctcgacaatgtggctctcacttttgcttgaaccatcaagtagcaaggtgttgtgtaatattagttcatgtccaacagaatgagtagacagtaaaaaagacccatcaaactcagttggggaaacagaccttgctgtccccttcaccaatctcagaattagtt

SEQ ID NO: 12470 - DNA, 13110 bp, Oryza sativa
  unsure (1)..(13110): unsure at all n locations
nnnnnnnnnnnnnnnnnnnnnnnnnnnnnnnnnnnnncctgccaggaaaggaacccccattgccatcggtaggggaacccatctcccatactttggtgggcaaaggtccctcgtaaggttagctgccactgcaaagccaaaaaacccatagcagagctgcaagcaatgctggggcagagcagagaagccctcaacaccaagaatcgccatgtttcggtagactagagcatatggtgctttccagtacccttctgggttgccaatgtcaaaggcactgtagaacaagaagaaagttagtggtgaaattacacaacccatgacaggtccaatggcctgagcaataatcatcgatctcggtgatgttaatgttagatgtcccgtcttgaaatcatgcatcagatcagcagatatggacaccagcgatttcaccaaaccacagcctactaggccagcaactacaccagagtctttcccagcccaggctgcaagaatgaagagggcaatctttccataattgtaggccatattgatgtcagttaggcctgctccataggcattgcagaaaccaagggcaggcgccaataagtatgctatgacaacataataccacttcatctcatggaacatcatgggaatggcaattactgcaataaaagttaatccaagataaccagagaaggctagccaggaaggaatattgtctgttgtaaaaacttcattacgatgaagttcatcgagcactggcatgtcttcccctgtaagtggaatacaccttatatcagatcatatataaactagaaaggtcatattgagttctgtcagattatttacccttctttgcattcttcagttttgagctatcaaacagattcttaatagtgagtgcaactatcttcacaaaattgtataggccatcacctaggatgagagctacacagatgaaggcctaaagaatatatatgaggtggtaagaatcaaaagatcatactatacttgtacactaccaaaataaaatgacgaaactaaccttgtacccttgcaggcttttcatgctgctttcaggtatatctgctgaataccaatcccctttcaaatcactgatcagtggccacattactccccatgagagaatggcgccgagtaggagagacagattaacaaggtgggagcaaatcatccctgccccaacatatgtgagactgaaatcgaagaagaatctgataacccaaaaagttttgaatcagatgaacttgttttttgaacaaatcaggtgacactattgttggtcaaaatttatttaatagaataatgagctaagtgattgttgttacgtttgttgccaagcttttagtccaaaagttggaaactgcgagaacccacaattgtctccaccagagtaaaaccactggaagaagctccaaaagaaactcatagcaaaatatttggtgaatccatttacttgctgcctgatgtgccaaaaaacacgttcagttaactgaaattttataatgaatagtagaactcattatgagttatgttagagaaccacatactttgccattgcatccccatgaggtgtgtggaatccatttataagcacagctgttgcagtcccacttgggtaagttaatttgtagtcaattatcatgacctgaaattttaccaagtttaagaaacaaatggaaattatcaagatctggaattttactaagtttggtaacaaatgaaatcatccatttacatgtggaaaagcactgccagctgttcattttttatgtattcacaagataaatatgttgtgaaatgaaaaggagaatatgtccagaatcacgcataataagtctttgcatgtggacttcaaattatgctttcaattaaattcaactgcaactcaagattcaaataataagtatgctttttttcagaattaaaaaaatatattttatttataaaagtacaactcaaaccacaagcaaaatagctatattttcttcaggggactagagaagtaccacacgctaatgagttggtattgtttgtttcagcacaaatcactatcaatcgattaagcaaaaatgttggtatgtcttaaccaataaccaactaggtggtttaataaagccagactgaaagaggtttcatgacagagacaaatttatttaatataccagaacgattcattcagcacgccaatttcaaacaactaaacaagaccatacaagaacaattcaatcagcagtccagattcaacagggaccataaggccatcaatcagatacgttaaaatactagctgcacttcaactctatcacctagctaaatacaggcataattgtccttttttttagcttatgtaatctgtgacatcgtgaaatgaaattaaaacacctacgaaatgttgaagggacaaaagatagaaaaggctgaaatggagatgatggtcagtttaccacaattttgtgaaattctcacaagggtgaactggtgaacgacaaaaacgcctatgaaatgtagaattgcagttctaaggagtaaggagctacagcgaaccgtggtcaaatggcagaactgttgaaattataagcatataatgatttaatttattctataaataaatcaagacattgcagatataaactagcatgagcgcatcattagatctacacatataaactaagcagtaaaacacgaacagaactggtcaaatggcagaactaccgaagatacagagtaaggctgtggaagctcactgacctttctaagagggacgagagcgagaagtccgacgaagctgacggcgagaaggaatccagtcatccacgcaatgccgggctccttgtagctccccggcacgttgccctccgtgtcctcgcccgccatctcgtaagtcctcttgttgagcccaagcaagtaagaaccaaacccacctgcacagaaagatccaaagaaccaatcagtcgggatctccattagactaggtagacgacgaatggaggatggatgcaatggggggtggtcctggcctccaactgcgatgctgtagcaggcgacggcgcaggtctggacgacggtgttctcctgccgcgtgaacgggcgggcggcgaaaccgaggcgggcgagcgcctgcgtccagccgcggaggacgacgaaagcgatgagcgcggctgaaacgttgagcgtggggacgaggcccgtggtaaggttcagcttcatcacgatgacgctgtacatggcgcccacgggcaggctcgccaccagcccgcgcgccgttagctgctcccgccacggcggcggcgcgccgccgccgccgcgggcatgcgtggccccctcctccgggtcgccgccgccgtcgagcccggacatctcctcctcccgcgggtgcgctaccaccagctcgaggcgcggcgggccgggctgccgcttcctccgcctctcctgcttcatggcggaaagaattttccggcgtcagattcacccccgtgtccgagttccagcggaggcatgtgaatgagagaatgaagggtcggtgaaacaaaaagatcttttttttttcagtacgaggatgagttagcacgaatatgatgctagctagtgagctcctcacttgtgttcttctacatccgttgtgctaagcaacgaagctatgaacaagtgcgctctctcgccaaggatcagtgcaagaaatccataggggcaaagaaaaagatgaaatttttatgggtgattctccaaagaaaatcactgccttttatcttcagtgtggtatcgaggattccagaaagataatgtaaaaaagacccacctgaattagcctggattctctcttgctcttgctccaactgaaaagacaagaacagcgagccaaacgaaactgaaggtgagaaagagaactgaatagcacgtcacaaaagaaaggggaagtgattggcaaagagaaatagcgtatacttggttttgtttcgtcagaaaaggaagcaagcaggtttggtaatgtttttatctaccaatataatcactagtagaagaaatagaatttatctcacccatttatttatgagttaaataattagtagaaaaaaattctcctagcattagttgaagtatttgaggtggtactataaaatatatctattaaacggtttagattgattatgttgacaattactccttctatcttaaaataaatatatttattttgagatgggaggagtataaaacaatttctttttcagatagcatcaactgtcaacagtaatggggaaaccaataaaaataaataaccatgatcagtggaagccagtgtacaggaactaaacagcagacacatactccctccgtcctataaaaaggcaaacccttggtttgcgtctctaactttgactgtccgtcttatatgaaatttttttataattcgtattttcattgttgttagataataaaacatgattaatattttatatgtgacttgtctttttaatttttttcatattttttttaaataagacggacagtcaaacgttagacacggaaactagggtttgtcttttttttttggacggagggagtcggcacaacatacagtaaaaaatcgcttccattaacattccgtgcaagaaacacaggcagagtcccgccactcacgcgcaagcaaaccagcagaccctgaatgcttacgaaatgacaaaggttataaaaacaaagtcaacaaagaagaatcagtcaatcagaccttcaaagcaagatcgaacgattttaaactaagagccaacctgcaattatacgtgacgccggtaaaagaaggaagagaaaaagaccgcgaaggcgaagctgtcaagaaagcttcgtcaaaactcaaaacgacagtgaacgaactcgcgacctgaaccattaacagtcgtctgtcagtaataaacagcaacagaaaaagcattaactcgccggcgtaccaaacaactagtattagtactcctgctttccttcgtaccggtctcctcctcgacgagacggcgacgtcgacgacgacgacctgagctgcatgagccaaggctatagcgccgcggtggctaaggagcacacgcgaccggccgaccgtacgtaagcaaactgtccgcgagcaagaacatgcatgcatgatgatgccatggcatgccaagcgggggcatgtatgcgcaaatttctcaacctggcgcaagcaaagcaactgaagcgagcgcgtgcgaagcggcgtgcccccgcgcgcgcgcgaggtggggttgggacggcaagcttcacaccggccgtgccgcttgggctttggctgcttccccctttcgttttctgcgggcgtgtgtgctcgcctcgcccacacgccaccagcccaccaccgcgatcgcgacacacagatatcacgacagaattccacggccctcggccgcagcgtgtgcgcgcgcgtgcgtcctcccggcggttcggtccgtatgctggggcggcaatggctgtgtacatccgatccgatgtagagaccgggtttatcctattttctaaaaatatgctggggcggcagtgtgaccgtgtgagtccggaaagacggaaagtagtaacagtggcctctgatgaaagcgtgaaacgcatctcggcgtcggcaagtaggcgcagagatggatggataatctgtggatcatatgcaaacgcgagatagcctcgagacctcgagcagatagtaaaaatcaagctgtagcaatagcaaatatcatgcgaatactggatgaaaaggactaatcacacgaagaaccgcaccgccgcaccgtactgaatgaaaaggactaatcagtacgtatggctgtgttctacagcgcattttgcttttacaactcccccgtttatcacgagtatacttttcaaactgatattttttatcaaaaaatcttttatatagatttttttaaaaaaataaactattttttaaatttgtagtgagtaatattccctccgttataaaatgttacaaactagaagggtgagtcatattatacccattctacatcaacaaatctggacagtattttagaacaagaaaactaaacagaatcataatattttaggatgaagctaggatatacttaattaattatatgctaatatttttttatacgattaaaaagctaaagctaaaggcacattcgaacaaagcccaaatcagtgaatcactgaacccttcacgcgtccatgttccggacaccttcctgaggaggcggacaaatttatggacgcacgaagcgcatatgttcaggagtgcagacaatgcaggctgatgcatctgttctcgacttctcgtgtggtttggagaagttgatagttagggccctccatgtcgtgcccccctcatcacttcatttagtttgttttcttcctatcattgtgggggtactagtatctcttacccgtctctcatccagcaattttttttctggtggaattaagaggttcactttcagttgaagacaaggcctttccctgaagttctgagaagactggtacggcggcaaatctttacataggactagaggctggggcgccgcctgcacggactaaaacgacaatcagtcggtaaatagatgagggaaatctatgaaaatttgataagcgacatcatagattacagttcaactcttgtggatatcaatagcatcgtaattagtattgcctttttccgtaataaatatcctactacagatggacactttattatcaacgtagagcatctctgttgaaatttcggttcgttacagactcttggttcacatgaatatacaatgtttttattacataataacccaaaattaatagaaaaataatccctggtacacattgctatacactttgggtttttgcaaatagggtaactgaagaataatgggcccaacttttcaagattacattcagcatcccatcatattctgaagaatccaaacatgttggaatgtaagtacatgaaaacatacgttagctaatgaaatcatatattgagaagcacctgcagatatataccataccctaataaaaccttaccgcactaagtgcccgagcacacgaaaaaattgttcataggtcaatcagtgataatggaacaccaaaattccattgatgtttatttatgagctagcagctaattagaagtgggtaaaatttactcagctagtatacctcttacaggcacatgggaaccagcctctagtagaatttgttcagttcacgacaccgcaaactccaagctccttcaacaaaagaaggtcttggggaatggaatggcaccgagcagaagatgctgatcgaaccaaaagaaaaatacactatcaaagcacagcaaactaaaactccaaatgaatcaaaacatcaagactgcaggaaaagtagtagctccccaacatcaatactggatccacgtgctgaagaagttggtggaggcgcgaccatcggccaccacgtgcgggagcggctagaccggccagttgacgacgacggctgcaggttacgacgatgacgatggcggcgaggcacagttcctcgcaggcaaaggagagacgagaggggaagaggagaggagtgttcgcctcgtcgctttctccgcgtccgcctcgaagtccgcgctcggcgacaacggcgaagcgaggggggagaaggaggtggaggcgctcggagacggcgacggcggcggaggcggcggcgactacggcggaggcgcgagacgatgcggacgacgatggcgacggcgcgaagcagaggtggcggcgcgaggggaaagcggagacggcggcggttagggttttgggctagtgcgtgccgttttgcgaaaaaacccctcagcttccacattttagagcgcagacctaattcacggtttttctcaccttctaatagaatacccggatctacgaagggcctaaacgtaaaaatacaactcagtaggggtgggcaaaattagaccgaaccgaaaagaccgagaccgagaccgaaaaattcgggtagttgttcggtccctaacatcaaaagaccgaatttatttcgggtatttcggttattgggctcggttaaccgaaatacccgaaaggaataagtccattttgcgtccctcaattcttgccctttatcgaattacatccctcaaccacaaaaccgggtatatcacctccccaagtgttaaaaccagtacaaaacaactcccttggtggtttttgatgctgacgtggcatcctagtcattaaaaaaattaaaaaatacgtgaggtcccacacgtaagtggcatttctattcttcctctccaccactctcctctctcctcccccttctctctccctgaacagagcacggccaggggaggcgccggaggtgcgtgaggtgtggggaccgtcggaggatgcggcgggtgcacgccgcgagggagaggatccgctgtcagtagcagtagatgcaggtggtagcggtggcggtggaggaaaggaggatgcaggggttaggaccgaagcggagctcgaacaaggacccaacacaccaaggtggacggccagggacggcggatccgaatgccggcactgtgcgccgcccggatcttccagctgacgcgggagctcagccacaagtctgacggcgataccgtccagtggctgctccagcaggcggagccggcaatcgtcgccgccacggggacggggaccataccggtgtcggcgctgacatccgtcgcaccatgccagggctagagctaggactctcataggacggccacatcggcgtgctcccgcacagtcgctcagccagttctaccaccaggtcggcggcgccggtgccaccggtcaactgccgcacccgcaccaccatcaccaacaccatcagcagcagcaggaggaccgggaggatgagcgcgacgacggcgagtccgatgaggagtccgggcagtagtaggcgcaccgccaattgttcatccatgcatctcacgttgtctctttggagaagaaaaacagaattccaggaaggacatgcagctaatggaggggggatgcttttgttactgttgggttgttcttcatggggttttttatgtctgattttttcctcgtgtggtgtcgaagctcgaaagaggctaccacttgctccggcgacttgttgggatggatcatgatcatcttcagttgttactcctgctgctccatggatggtcgccggtttatccccctccaagtgtttaggtggcagctcaatcttttgcactccacagtcagcacatgacatgctattcgaaaggtagcttgatgagcttatgtattttgctggaggttggcggcgcggatagacaacaggaggatgtgttgccggccgagcagatcgacgccgtgacaggtgaaccctccccgcgtgggcgccgcggccggcgatcctctcccttgtggcatgctcctgcatcctccggcggtccccacacctcccacgcctccggctccgccgtccccggccgtgctctgttcggggagagagaagagggaggagagaggagagtggtggaggagaggaagaatagaaatgccacttacatgtgggccctcacatatttttttaatttttttgatgactgggatgccacgccagcaaaaccactgtcaaaaaccacgagggagttgttttgtactggttttaacacttggaggaggtaatatacccggttttatggttgagggatgaaattcgcaaagggaaagaattgagggaggtaaaatggacttattcctacccaaaataaccgaactagcccaatagactaggaggcccagtaggccagtactaagcccactaaaataaaccctaaatcaccaaccctactcctagtctcccactcggctcggctccctcaccctcacagccgcactccccactcctccctctcgcgccgcgcctccgggctctagcaccgcgccgcctgcctccaccgcgcctgcgccgcctccgtctccaccgcgccggcggccggcgccgcctccgttcgccctggcccactgcgtcgccgccggcgccgcctccgtccgccctcggcccaccgcgtcggcgtcgcctccacctctgcccgccctccgcctccctcgcgccgtctccgccttcaccacgccggcgccgcctccgtcgtccaccgcgccgacaccgtccttcaccgcctagctcgatttgcttttcagtttgtctttctgaatctgcttgatttcctagttgcatgtgcagatcagcagatgcatcatctctctattgatctattgagttgccttttgatttgtcaaccatacatttgttgtttggcttttgtgattttttttgttcagagacttctgctctcgggttagttcggtcatgaccgagaccgaaccgaactaaccgaagaccgaagtgctcggtcttcattttttttgggaccgatcggtcttgagtttttgatgactgaaattttaaaaagaccgaaagaccgaaccgaatttctcggttagaccgaatgcccacccctacagctcagaggatggttggcgagggacgccggacgaattacgaacaaaacagagggcttttttgtaaatttccaccacgcgtactgtagcaaaacgcgtacgtggcacaccccatcgcgcgccccttccgccagcctttatatattccgatatcatgacacagagcgctcagtgacaaccgattttacgtcaaggggatggagcgacggcagatccggtgttggcggcttggtgtagtggcggagctggaaccatattaagggtggtgcactactttactgtatagatggcggcatttactctaaataatgatagttgttcatttgtagataactattgataaaaaaaatcgttgagtagcaagtaaaagtgcttactgaaatataagacgaaaagaaaccgcgaagggaaacatcaaaaattacataaaagacgttcaatctatataaaatacatccccggtctcaaagctgtcaatctcaatatcatcgataagtaatccataatagcctacaataaaagcagaacagaagtcagaaacatcttagttttcaactaaaaatttatatccaacaatgaagatgtaaaaacataaaaataaatgtgtcgcaatattcttacaattttactaagtgatggttgatggactgatggcagcaggacagcaggagtccttgtcccttccagaaatcaattgaaactttcagttcttcaaactttaaaccctagcttatatataaatttggatattgaaagggtgctatcaacaagttacaaatcaaattaataggatttaaaataagactagaactagaagagagggtaaattgaaagtttggaactaactaaaaggaagatgttctcaaaaaaaaaaactaaaaggaagataatacctctctttagtctcttgcttgtgcactgctgagtgctccgctgctagctgcaggctgcccctgtagtctggctgctcgctgccgcagtgccgccgtaatgctgcgggctgccagctagggcgaccagcagcaggctaggacggcgagcaatggtgagtcggcgaccagcggttgagcgacaggagtagacggcgactcggcaaactgtggtgagaggagattgcgttggatcaaagacgaacagacacacagtcactcagatgccgtatcgcgggaaaaagaaagacaaaaggcgaaaaacgggagtcgaagagatgtgcggtgccggcgtggctgtgattaacgctcgaggcgtcgctctcgctcccggtggcccagatggggcgctattttcatgggcctcaggtcttccatgacttgctcatgggccaggggtggtgcacgaatttgggtcgaggggttcccatgtggtgaaaatagggggtaagtactaaatctgaaaattaggctgggcgcctgtgaacccccctaagcccattggactccatccctggcttggtgagacagcggagaggacgttgccgaggcatgtgacaacatatcctgaagcggtggtacacggggcggatgacggatccaacacccctgttttttacctgtggccatcatgagatccaccgatgctatccttcgacgtcgttgcctttgtcatcactgtacgcacgcctctacctttcgcagtttcaccattggtggaggcaagatgtccatgccagtcgctagggccattggggagagagacggaggatgagagacctctgtcggtcgcttggccctaggtgacttgctacgaagctacacgatgcaagcagaaagacgatgagaaaaggggaggatgccgatatgatagtttctattatttttctctcctgttcaactaggaatgaatattctaatgaagggtgtatagcaaataaccacattttgagagtgatttttttcaaagattaacttttttttgtgtctagcaactaaattcgcgaaatcacgatatagaagttagcaaaatttgcctagtactacaaatgtactgatctgtcacaccctaatccggcaccactatacaacggcacctgacatgagtgtgtcgtaggaaaaataacatgaaccgcttcctacgagaccacgatatcggtaccagtctgtcgggtcccaaaactaataattcggaaaccgacatattaaaactgtatcaagccctggatcagtagattgatacaggttcaacaatctggttcttcattgcatacatttagtcaagggttcaaaggagatattattacataataatattagggtatttacaagattgggctaactgttacaacagaagccatagaatgactcaactctactgttttgctatagacttaaaccatctatctaatctatacttgagaactaagttagaatgagactaacttatatgattgaactcccagcttcagcaagaacatcaaattgactctgaaaaaggggggttgaagcaagggtgagtacaacgtactcaacaagctattatattcaataatgaatgcatgaaatggtaatatctgagtagagctaggtttacttgcagaaagcaaagaatatagaggaagaaagcctagaatgttttaaatacaacaatatttaat

SEQ ID NO: 12471 - DNA, 11035 bp, Oryza sativa
ccaatgacatgctgatgcatatgatgcatatgtaatgctatgatgtgggatcctagaatatttcccccttttatagctatgatcataaggagatcacaaatagatcacaaatattctctcccttttggcattaatcaccaaaaaatgaaaaagggctataaaataggcaattacaaaatcccaaaaaggaataaagactcacaaggccaaatatatatatatatatatatatatatatatatatatatatatatatatatatatatatatatatatatatatagaaatagcccatttagaaaaactcccccttactcatagagtcttttctttggatagagaatttggaatatgtttcatatgtagaaggggtgagtttgagcacttgaactttcacttgagatattctcatcaaaggtttttttcaagaatgtcaaaaattgagaagagcttggtcaaggctatttggaagaattttactcaagtgcatgatatcggcaagtaatgacaatgatgagctagtgttgggttcaagatgatcaagggatactaccatttgttgagagaccacttgtgtataggaattcgaatttgggatcaaggaatggtagttggctttggtagcaaggatcaacttgtatttggtggcaaagattggaatttggagtctatccatgaaggcttggttttgagaagtccaaaaaaaaaacttttgagtttaggtggtttcatgtatcatgggcatttcaaaaaccaaaagagttcaaataaggaacatatccaacatagctcaaggattcatgaagttttcaaaataacaaagatctcattatttgaaacatcttatatttcaccaccatgctcaaataatcaacaagaagtgacatgaactttgaaatccatgtttagctgaaaaggcacatagcaatggcgacgtcttttagcaatagaaacctgtgtaactaagctcggaaaaatatgccataaatcctggagatagttcatgtaaaaatacaaaaatttcattttggggtcctttcccagatctcaaccgaattgaagaaacaaatctcacaagctttcagccaactcaaaatttcagactttttcagatttttggagactgaaaatgaggttgaaaaggcatccaaatgaccagctaaaattctgagtaaatttgtaagtaaacttcaactattgaggatcaaaagccatattgtgatcttcttcaaatttgcaacccatttggagatacaaaaatccaaatcagcccaaaaacatggttgttctgaaaatttcagcaagctgagcaaaacgagaaaaagtcaaaatctttgcaaatcaaatcgaaatgagttgaaaccttgcagatttgatctttatacttgtgaggaacttttccaaaaagaatttcttaaaaatcatttttctatcaaaagataagacaaaaggagcattgtaggcctttagggtgagtaaatttgagttgagagctcaaatcacattcaaatttgaaatcgatggagtttgacatttgtaaagccttaggaggattatagatacactttcaagccaagattcacaaagaaatttggctctaaaggcttaacacgccataagcaagtttaggccgaaaatggtcaagtcaagatttttgctgaaattcaaatggttgtagagtttgaatggttggtattttggaaaaacattgaactagataaatgtttgaaacgaccaactctaaaagttttgtatggaaagcttttccaaaaaactcaatagattttgatttagagaaataaaatattttcaaccaaaacaagaccctaaaagatcctattgagaccaattttgctattttgtttgacaaatggaaattttgactccaaaagccttgaaaaacatttgaaatacaaattgggatacatttgaaaggattttcacatatatgggccatttaaataagatttttgacttttgtctaaaataggctcttttgaaagggtatggatgcaaccttttggaaaattcatgtttgggagcaaagggaatatgggtttgattcagattgctcccccttgatgcaactctccttttttgcttcatgaattcaaggtttgatactaaaggccaagtttgagaaaaaggctacacaagctctcttttcaaatacattcctccaaaagtgcaaaaagaagcaaatgagatgatatttgagagaaactaatatgcatgaagttcaaatatgattttgagccaaaaagatacaattattcagatttaagaaataaactcaccaaagtgatagaaagtgaccatatatggtctagttaaaatttttggtgagttttgacatcaaatttcttttaatatgttggtcttttggataaggttcaaaaaccaaaaacatttgaaataaccaactctatctaacttgttttgggctccatttcaaattctctttagatatccctgtagagagaaaaatagttttgctcgaaaacaagatcctagaaactagaattttagtcaaaaatgcatttttactttgcaaatactttttcttgcaaactaaagtttggaaaacatattagaggccttttgaaatattttccaagtaatagttttcaagaattatagtttttctcaaaaaattgacttttggtcaaaatgggcgttttgaaaacatttctaccacttggattactttgttcacattctaagggttgtagtgcatatgtaagaaatgcaatactttcccttaatgcgatattcccttcaacccaacaaagatgagcaaataaacacaagatccaataaagatcaaataagattgacaataagcacaagatgataaatatgttgcattaatatgatcaagcctatagcttcatatgccactactcattatgctcaacatgcatttatgatgatgttcataagaagaggaaatttaattttggaactatgaaaatgcaatgcaacatacacaaggctatataaaaaaattacaaaccaaaagcatgttaccgagatggcattggtccttgatgtgaattctccatcctcattattggctccaattcttgaacttggtgagaatcacattttctcgcataggccaaaactccaatgcctctcatgtacctatattctcattttggcacattttggtccccaacaaaattgggtccatcaatgttagttaccaaaatacgaggcacccaaatggtcctccttctaggtgcaagtctaggtaaaccaacatatctagcaaacacattgccttgcctatttttcctaagcacataatcatcaaaaataatattaggcttaggagtattacctatgggacaatttttaccaatatgtccctttttgcggcaattgtagcaagttaggttttgacctctatgacttgtcgttttgtcttgcttcttgccggtttgcctcaatttgaagttgcacttctcatccttcatgtttgcgcacacggaggcaaagtgtcccttctcatgacaaccaaaacatgtaatgtgaggatggttcttactcacatttttctttccatcatttcttaagtatgcatgcttccttgcatatctaggcatgtgtcttgtcttcttagcattctccttgcgatgaaagccaagtccacacttgtcatttgtgctcttttgcttgcttaggatttcgtcaagtgtgttcttccctttgtagcttctatccaagtcttcttttaaatctttgacttgggcttgtaattgcttgttttcctctacaaggttagcaacaatatacatagaggaggaagaacaagaattttcatctatgcttgagctacaaggtacatctaacaagtcatcacaagaggtggacacactagccttagatgtactacatgagctagctacacatggcatatcatcatcaattaaattacatgtgatgcctatgtccacctttggcttactaaatgcatttccaatgagaagagactcataagcttcttttatcttcttataagaatcacaaagttccttataagaatttattagctccacatttgagtctttcaaagagagaagagttttctctaaaatttgattttttcttcttctctttggcaatgtatttactagcctccctaagaatgttaaaaagatcatcatatgaaggttcatcatcatcaccaccatcatcaacaacacaagtattttcaataatactatcgagagaatcattctttacctcattcttacaatttgtcattaaacaatgaggtgatgtggatggtattgggagctcctcatcatcacttgaggaggtggagtcttcacccgacatcgattcttgtgtgcaaccattctcaacaagtgtgggcacttcatatttttctttaagctttacccacatagcatgtgcactcttgagattgcatacttcattaaacatgtcatcactcaaaccacaaaataaagcattagtagcttgagcatcgagatgtaggcatttatcttgcccacttgttggagcatggtcatccaaagcatgagaaaagcccacatctacaatccaccatatttttgggctcatggccgtaaaataagaaatcatgtggattttccattgtgcataatttgtgccatcaaacataggagggtcaccacccgtgtgtactatatctctagaagccatccttttctctcggaatagttaagtccacaaaatgagagaccaagctctgatacaacttgtaggatcaaggaggccgactagagggggggtgaataggcggttttaaaacttaatggcacttaaacaaaactaacctaagttgctaggcaaggtaaggtgcaagggttaactaagcaactaagttaagttttgcaaacctaggtgatatgggctcaaatatgtctctatgaatgtaaatagcacaaatgtaaatgcaacaaataaatgagacaacagacaaggaatttttcaccgaggttcggaaactcgccagtttcctaatccccgttgaggcgagcccaactccaccgctcaaccacgaaaccaccgcacgcccccttcgtcaaggggtgggcaaggcgggagccggcccacggagaggactacccaagcctcgatcactcggggtagttcttccttcactccgaaggtggtgaactccaaaccactcacaaacggcaccgggcctcctccacaatctcctcggagaggtcaccgagcaacacctatacaagccgtctaggaggcggcaacctccaagagtaccaagtctaggatgcttgccgaggatgatcaagtgtcacactagctataacaatgaagcaatgcacttggattggcttaactcactctctaacacctcactagataaacaaagtgcacaagggtgtgagagctcttgcaagggttcaagataatgcaatggagtgccaaaccttacccttgctgctggggagtgggtatatatacccccaaccaccaaaactagtcgttggaaccgaaatccccaactctgtgccctgccggtcagaccgccgttgtgaggccggtcagaccggactactttgtaacggctagaaagctagccgttacagggcaatcattgagcccactcaacctggtcggtctgaccgcagtgtagtggccggtcagaccgtcaacggctcggtcagaccgccgtcggctcggtctgaccggttgcggctctggcggctttgtatcgccaccaaaaaccaaaccagtgcaacagaccagtgggccggtcagaccggctttaccacgccggtcagaccggctaacaggcctggtcagaccggcctaaggcccacggtcagaccgcaggtcacttttcagctcaaccgaccgttaataaaacggcgatatctcttgactcgggtctcggaatttggcgttcttggactctatggaaagcttattcaaagggctatccaacccatgaacaatccatccaagaaacacaacttttctctgggagaaagggctcacactccaaaggatactccaccggacataaccacatgaggctacccaaacctataggatttgcccacatctctctttgtttaggacttgagaaaactcaccatacttggctagacaagcccaccaaatacacctacatgcatatgaactaatatggcacaagatcatccacaagctcgcttcatagacccctcttgatagtacggcgcctatctagcaaatccggtctacaccaaacaccaagaccgggaaaagactaagaaaacattcttagctccattatacatttgccttgcgcatccaacttggggtcaagcttgagtcgagatcaacacttgtgaccatttgattcaaccatgtttataccaaggtattcacaatacacacacagtttgtgatatcacaatttatctcaaatatttacatgcacctcggtaaatattacaatcgccctgctcggcgtaagtttgcctcctgcgcgaggacttaagaagaaccactatacagaggtaccaccttttctagataacttaatcagctaggtctatgcccatacgagaattgcggtcgtactcgtatgttcttcacatgtacttggcaattttatgtcggttggaacagtactagccacccggaaatcaaccatttctaccgtattgttccaatctaagtttattatattttatgcaatctaactaggcatggctaagcaaaatctagcatatatctggtttgctatatattcaggttatgcattcgaaatcatgtatggctaatgcataagataccggagatatagaatataggattattatgctcaaaggggaggaataataacttgccttgctccaacgcaaataaatccaagataggcaacctgattatccgatccttgaaatatcacaggctgccatccaaaatagactctactaaagaagagaaagaaccaaattcaataaaaatcacaaaataataagaaagcgatgaagggcaagaaaggctgggtttggggtataaatatctcctttataaggtatagggattattggctaatattttatgtggaggttttagagggttggaggctaaggtggagaggggatcaagcaactaatgtcgcttatatttcatgagtgggctttggttgtttggagagtaagagaaataactggttaagtgagtatgtggctaataatggctggtggcaggtttaggtagtataatacctaggatttggttatatttaggccgattggggatagggcaatatatcggctagctctatattttatatataggttctaggtagttagagagtaggtggctgagagtaggatggataggcgatactggtgggtgtggaatttggatgacgggtgggatttatctagtaaggtgtcagctaggatttggttgtgtgctagtcgatgctagtgttgaacagcataacgattagatttggtgtcttctctagccggtgtcgatggacagtataacggctaggaggtgggtgcaggttaattcagtggggcgaaagtgttactccgacaaccgtgagtggcggcggagcagctaagatcacacagagcccgagagctaattgtgtgacgtgctgtggaggtcgtgggaatagtgaagctccgaccgttatacgcgtcgaggtgtaaggtgccaggagcagcacttcgaccttgggtttgggttttgccgggctttacaaccaacggttcgacgtcggggctagtagaccgcgaacgtccccatggaaggcgtaaagtttcaaccggcggctttttaatggctaaagggtaatttgggacggaagaaaatatttaaaaaggcaaatataaattcaaacaatatttgaataaattcaaataaaattataaaataacaaattgggtatcaaaatatatcttttgaatttagatgaatttaggtccaagtttcatcggaatcggatctacggttcaggagatatgggcttctaaagtttggattttgaatcaaatctagaaaatgtgaaatagtactgtaggggcccacctgtcagttttccttttccttttcttctctctttcttcttccttcttcttcctcccgttctcttcctcttttctgttgccgagtgagttgagaggagggagaggaggggcgccggtactctggtggttgagaggctgcgacgtctgcggcaaaacatgttcccgagcgacgcgcacccggggagggtggtttccggtagagagggttagggtcttagggaggagaccggaacggcgacggcaatagcttgctccggcaacaagagaaagtggctgtgatggtttgtttcaaaggggaagggaaaggggaaaggggtgaaatggattcgcctcgtctaggcaaacccgatggcgcaagggcttggccaacaacgctccggtaagggatatcgacggtggccggtggtggctagacataacaggagagagagagctcgaggagctcggctcatatgtggagaaaaggggagggctggccttctatttataggcgtcggacgtcggttttgaaggtcggttgtagagaagaagatggagttggtcttggtggcggcgacgtgagaaggaagacgacggcgccggctgtggcttgtgattggttggagatgccggtttgctccaaaggctgacgtcggcggcgtgaggtggcagatgacgtcggcggcgatgccttagcggcgacggcaggacgttgcggtcggcagagctgcaagcagagccgtgcacggcggtggtgacggcgcgtgataacggcggcggcgcccaccgaacagggagaagagaggagcggcacggctggagtttggttgggccgactgggccgcgtgccaaagttgggctggcacaacaaggaagggtaaaaggagatgggccaagggagaaagtgaaggactttggcccaaactgaaaataaatgtttttctacattttgaatgggatttggatggttagactttaaatttggaagagatttggataggagaattatttgtggttaaatagggaattaatttggaagagggaaatatattcttcttagcacaagagcaatcattctaatatttataatatatctattcttgtgccgagaagtcttagattataggaactggaatgggagtctagatcaaaatagaaatttgaaatttggaaagggaattaggataggtttataatcaaaggatgggtccacaattaattccaattaaaatcggaattacttggtttaggttctagggcaatagtggggaatttcttggaccataattcataaaaatagaaagggttttcaaactaaatttgaataaaagaattttagttgaaaaaaggttttaaattaaaaccaaatcaagaaatacctcaatttagccaaatatatttttaaatgaaaaacacaaaagaaattaaataccagagaaggattttatgcaagttagttttagaaggtccctctaattatattttcctaggtttataaaattattaagaacataaaaagtggcatgatgcaagattagaaaatggttaattttcggtatgttacacagtcccaggataaagcgttggtatccacagtaacaattataaatcatcgcattctttaaattaaataaaatagagaacttatttacgttaacttaagttgcaactcttgggcaaaccagagaatgcagcagatgacatgaagcagcaacagcaatagcagaagctgaggcggcgaaaaccaacgaactaacacccaacaccacatgcggcgacaaaaggagagagcaaggcggcgagacggcgctcccccacggcacgtgcgcatgcgtgcaagggtgaggtgggctgctgcttggctggaccgagaggagtggcgcatggcccaggcggggagaggaaggagtgggttgggccggccaagaagaaacagcccaaagaggaaggaggggaactagactttctgtagggttttgagggagaaggatttgatgttggaattgaattgggatgtgtttcaagtttgatatgtgaacccaaaaatataaaggattcaacaaaagaagtcaaagtgagaaatgtgacattcttagaattgggaggaatatttggcaagaattacgagggaggatcgaatttcggaatttgactttttgagacttgattcggaacatgaaatgctggggtgttgattttttatatcgacgagagggaataaggagatatttgaattgagatccatagtacgacttcaattggtttttattaatttaggtttttaacgttttgcaaaaagtgggacgttacatgatcagagtagtcaagctcagcccttactacctcgattttgctatatctcactcgaaagatttttttctaatctctcactcgattttctcacttaaatttacagtgcattttcttgtaagttacagtgtaatttatgaaacttacattgtaacttttataagttacagtgtaatttttgaatcttcgcatgtaagttttaaaatttatattggatttggtttttttcttgaagatatggtaatttagtgtccattatggtgtttcttagttgctttttgccttttactgtgtctatcggattttaatccaaagattaaaaaactgtgtgatacgatcataaaaatctttcgaaagatgtacaggtactccctttatgaaattgtaagcatcgacctagcgcattagcccaagctagtgagaatatgaattttaggaataagttcacttcgtgaccctcaaaagtgatcaaaatttaatccgtgatcctaaaccacaaaaccggatatctcgaccccctaactcttaaaaccggtgcaatttgactctctaggcggtttcgctgatgtggcgcttacgtggcagtattgactcggtcttctttccacgtggcgttgatatggcgcttaggtggcgttagaaataaaaaatgtatgtgggactcatttgtcattctcata

SEQ ID NO: 12472 - DNA, 11460 bp, Oryza sativa
  unsure (1)..(11460): unsure at all n locations
cgtaggcgtcatgttggtgaaaccgccctccaaaaccgtcgagggagtcaaattgcaccggttttaagagttgggggtcgagataaccggttttgtggtttagagtcacggattagatttcgatcacctttgagggtcacgaagtgaatttattcctgaattttataggtgctcaatgttctttcctttctttatataatcaaaagtacctacactatccaatatccggcgacaagcaaaaggagaacaatgctgattgcatcgactgcagcaccttcttctttgatcatcacggattaaacaatcaaaagctctgaccttgtcgaagatttggagcacaaattaaagctctgccattctattttgcgtatcatgctctgaatgctaaaagcaaaatgtatgcctttggtgatggatcaattaaaaaaaaacgaaagcttagccttttcgaacacctgatggactaatttaaacaatctactagcttctggtggtttctgatgcagaagtaccaggcaacatcattcgcaaatctcaggtcgtacatgcaccacttcaccaataggctgtggccctagtaactttcatggatagtatacttcaagcaatgcccacgagaatttctccctttccacacgttgttcttttgcgtgggcagcagccatgcaggcgtgaggaaagcagagcacatttcatggcctggaatttttcctggtggtgttaggtgcttagttgggtcactttccgttgagcacaatgccattctctgaagttttgagaaggctgctgcagtacagaatgtactgcaaggagtaatcagaggtactacctccgtcccagaatataaccatttttaaagttgaacatggttattaagaaagtagatataagtgattgatgtagggttgtgattggttaagatggaaaaagtgaatggtggagggttgtgattggttgagaagagaatgttggtgaaaaagttatatttttggataaatcttgagagttaaaagttgttatattttgggacggagggagtataatggtatagtacattgtactactacttcaatttggacgatcgtgtactatagtcttcgtgtgattactttattaaattagcgtaccaggtgcctgcaggtattcgtagttgaagttgacaagcattacttgtcagtaaacgtggacctttgcatagtccaaagttaggctgtggccattacaagtgcttgcatattcttggacagtcgagtaacctcactatgattggtatttttttgcaagttttttagtactgaattgcttttgtactgtcgattgtacatttgtactacgaagaacctgaactctggcgttaaccaacctgatattttccacaaatgttcaacagtcaacaaagagatgccaaccaccagaccgacctgaaaccatatcgaccgcgtcagtgaagcatcatatcacgattctcgcatgccctactgccctgcaatgcaaggaagaaagcttcatgattcttccaaattccaatccgtagcagtcagatgcagacggacgcaagggcacgagcaatggagattattcgtcagtaaagctgatatccaacattccaaccacgacgaccaggaaacagagctctgaactttgctttgatgcggacggaattgtttcttactgaagcccaccgcctatagctggagcccggaattgttagggtttcgggacaaagtcgttcttggtactgttcgggttattcatgtgctgactttacgctaacatcttcatcaaggggtcttcctagctctgtgttatttcccttctagtttcatcggggtgttagagatatagttttgtattcctatctcctaccctttttctctgattctctctcgattctgtttctataaatagattgtagagatagagatgtaccgggtctatgtgtacttatgtgcatgattaatctaattatcgcaatgactcctagcgctttcacgccggccatcgtaggggacgccgctcgcctctaaagattggtcgaattgggtgcgtgatttccttactcaggtgctcaccccctcctcacctccgtcgtcgtccccgtaactttctcttctccctcgacggaggagagtgttggttccatcgtcactaccgcgagcctcattcaactcatctactaatcactatgctgttctgtttacaatggtttgagaatcctaaaagcggaaacattctttggttcccgctaataaacccgttctttagtggtggattaacaaaaccagacaaaagattcagtcttttcgaagatctgtaggacagatttaatcagctagtggtttctgctgcagaaacaacaggcgaccatcttcttctgaagaaaggaaaaaaaaacagcaacagtcagcagcgctcttcaatctgtctgtggatggatgctctgaaccgaagcgccagtaacctgaacgcacgtgtttctatcgtttccatccgccaatgttcgcgtgggttgcaggcgcgaaccaaagtggagcacgactaatggccgagatttttattccttctcatcatcgtataattcatccatccaattattcagcgaacctatccggccttggcaacggaatagcctatctgacagagtgacagttacacccacaaaacctctactgacgaaaagctgatgcaaacttcgcgttgaaacgcaccatattgaatttgaattattgatctctcgatgataaacatccgcaaccttttttcactattatgcttcagtcttcagagggatgtaacaaatcagtgcaggccaagctcggaggtgacatgcagtggaaccaaaaagagctaaaagtcttaaaaggtcgtagcgtcaatgagtgtccagttcatcgtgtttgtgtcagcgagttaagtaccctgtttgtggaagtagtgacggtgagattgccacgaaagggaaaaaggcaatgtgccaaccttcacaaaaaaagaacttgtggtgcgagccggagaatctgttggtgataagttgagggaaccgcaacggtgggcaaatgcgatcgaaaaagggatcgtcgctgatgcggacatgatgggctgacgggaactggcacggcacgccgagatgccaatatttctctcgccagatatggcacgacgacgctactgtgctagcacttgtcctcgactgtgtttcagtatcgtagcacttgacaataagcacaactaattgttgtgttttcatctaattttcttctcaactgatatacacagtacagaaccccaacccctatgaacagcatttctgcttttggggatttatccgtcatagctacacccgttcttcctctcgctgcgcctaaatcttaaatctaagtccaaaacgctcgatacacgatctcttttctagtgtttctgcattgacgctatacgtctatacgatctctttttttacgatctatacgtctgcattgacgctgtaaattacagcgatgcattggctagtttcccggtatgaacttcatgcagatgggtggcttgaccttggccagcgcgagcagcgacgaagggaacgtccaaatcccgtcgccgcagatgaggccggacgcgacggccggcacgagcagcgcggccctcttgccgtcgaacctgtgccagaggaacaccacgaggctgccggcgcacatgtcgatggcgaagctggcgccgacgaggaacggcacggccatggccatgggcagcggcatgtaccgcccgtacctgcgcggcaggaagtcccgcgccaggttggcgagcaccgcgaacgcgaagaaccccgcgcacagctgcaggcagtgcctcggcagcgccgagaacccctccacgccgatgatggccatgttccggtagatgagcgcgtacggcgccttccagtacccgttggggtcgccgacgtcgaacgccttgtagaagaggaagaaggtgagcggcgcgacgacgcaccccatcagcgtgcccaccacctgcccgaccagcatcgaccgcggcgaggtcagcgtcaggtggcccgtctnnnnnnnnnnnnnnnnnnnnnnnnagatgagcaccagctgcttcaacagcccgcacccgacgagcccggccaccacgccgtcgtccttcccggcccacgccgcgaagatgaagagcgcgatcttcccgtagttgtaccccatgttcatgtcggtgagccccgtgccgtaggcgttgcagaaccccagcgccggcgccagcaggtacgcgatgatcacgtagaaccacttcacctgccggaacatctccgggatgaggaccacggcgatgacgctgaccagcgtgtacccggtgtacgccatccaggtcgggatgttgtcccggttgaacacctcgttccgctgcatgtcgtcgatcgccatggtgtccgcgtccgccactgcaaatgcgtaatgaactactcctgtaagcttcagcctgaactgaaaatacgcgaggcgatctaaatctttttttacggtgcatttacctctgttgttaagacccctgcgccttgatctttcgcgtacgctcttgagagtgacaacgatcactttgacgaagttgtagaagccatctccaacgagaagtgcaatgcagatgaaggactgcacaggtagcgatgttgagtttttttttttcaaaaaaaaaaaaagctaggaaatgtgtatatattgtgctgcctgaactagtctagtagtactacaaatgtaccattattgggacaggtgaactgatgaacacaccttgtaaccgaacaggcccgacatgctactttcagatgccttagcagagtaccaattccccttctgcttgccgatgagcggccacattattccccaggagaggatcgcgccgaacaagagagagaggttgacaaggtgagaacagatcatcccggcaccaacatacgtgagactgaagtcgaagaaaaatctggtgatggaagaaattactcagcaaaaagttgtttttgttgcggctttaccactgaagcatacaatgatcagtgaaaaagaaacagtaaataaaaattgtatggaaacagtaaaaaaattacgtatgtttccaagctttcagcccaaaggtagggaactggaggaatccgcagacgtcaccgccggtgtagaaccactggaagaagctccacaagaagctgatgccgaaatacctgaggaatccacggacttgctttctggcattgaggggaaaccattgaatcaagtcagtgaatcccaactatttctgcagcgtttttggtcggctcaatcatgatttcatcagcacttggctgaaatctgaaataaagagcttacttcgcattcttatctccttgaggcgtgtgaaacccgtttatgagaacagcagtcgctgtcccacttggatatgttagcttgtagtcgatgaccagcacctgcaaaatatcggtttttatcagattccttcatttttgcatgattgcgataattagcccactttttgttcagaaaaaaaaagactgaaggacacaataaacgtgtagaatagactttatcagtagtgtactgtagcactccaaaccataactgaaagacacaacaggtccttaataagtgagaaaaggagaaaacgatggttaatgtttgttaatcgtggtcaacgattgcaactctgatgctgaacgatcgtacaaccaatgccatttttttcagaacgtatgacagtaaagatcaatctcggaaaattcagggaatctgtcagaaacggtaaacgctgaaaggtacggcatggaaaggggaaaatcaaagaagagcaaagggagtcagtagtgtacctttcggagagggagcaaggtgaggagccccacgaagctggtggagaggaggaaccccgtcatccacccgatcccgggctccttgtagctccccggcacgttccccggcgtgctcgcgccggacagctcgtacgtcttcttgttcagccccagcaagaacgacccgaatccacctgtgctccacgcgaacgcgcgacgcggttagcgcaacgagacgccaagattggccggggtgatgagaggggaggggagacaggagagctaccgccgtagccgatggtgtagcaggcgacggcgcaggtctggatgacggtgttctcctggcgggtgaaggggcgggaggcaatgccgaggcggtcgagcgcgtgcgtccatccccggagcgcgaggaaggcgagcagcgcggcggagacgttgagcgtggggatgagccccgtggtgaggctcagcttcatcacgatcaccgtgtacaccacgccgatcagcagcgccgccaccatcccgcgggcggtcacctgctcccgccacggcgggacgcgctccgcctcgcgcgccgccgccagcgcgggctccgactccatgtcctccgccgcctccggcgtcttctcgatctccagcgcgccaccgccgcccagcgcgtggcggtccatgctgccggccgcacccgacgaggcgccccccctggggactagcagctcgagctccgagacgtcggcggcggcaccggtggccgcggcggctgcaggggagagatgtaatcgtgagcacatttgtttacgcgtaccagggcgacacaatccaacaacccatccatgtgcgcccagcgcccttgcattagacagaagagtacaagcgccgttgaattgaaacgggcaggattagttataaaattggcttctagcaaagccagaggcatttggccatctgccactctgctccacgggggtcagtaatgacagaggccacaaggcgacgaacaaaagaaccacaaatcacgagcagaaaccagaaaggcagcaaaagcacaatccaacaccaaattgtaacgagcaccgcatgcagaaacctctcacctgtactgtcctccctgcgaaaacagcagcaccgctcggagacgacgatcagacgaacgccaccacaccggggatgggaacgagaggaggcggcaggcgggtcaattaaataggcgtcaactgcggggaacgactgaacgagagaagcagctcggttcactgtactgcaccccctctgcacgacgtatccagtacacgtgtggatgcgggggagaagtacaaaaaagagaagggggggagaattttcagaggtgcagtacaaggggaacggacggcgacgaaaatggcggggtcggtcagtgatgtgcgatttttttttccaagagcaacgaggggttggcgtttggaccctgcacctgcagcaacctcctcttcttcttcttcttcctcccgtgcacttgacttttgcatggttgggtgagggatcgcgacgtgtggaaatacaggaataaactggtgatgggagtgtgccccatggctttgcaattttctttcccctctttccgtggtcggatgctcggattttgtacatgtactgcttgtccagtttcaatctacgcgatcttaatttgtgtgatctagagtcgtagtacaagcattcgcaatatttgaggagttcgtgtacgcaaatgcaaacctcatgtacctagtcgcatgattgctacagatgcaacagattcagtatcgcttgatttcgtgtaaatagtactagtagtagtatcatgcgactgaggtatggaatatatggcattggttgtcatactcatacccgtctccacgaatcggcacacgatttaaagcatgacaaaagagatagtgaagtgatatcattaaatgagctggaatttttctacgttagaagtgaagagaattttatgggtggaaaagagaaagaaaatgtgatattggagttgcagtttgtataaatttattcaccgtattcaataatttagcgagaccagagatttatcgttggcatctggacgtgtgttgctcctcttattcctgaggcacacgagtgtagtgtgcatctttctataataataatagaaaaaagagccttatcagttgtccatattttctaataagccaaaatagcttattagagaataaaaattaatttataggtaaaaattttatatatttgttcatagtgattaaaagccaacgctaaaaagaaattaagttcaaaatattttaaaatcaaattcaaaattttaaaatttggtttttgctttgaattattaggccaaccgatggggctaagagttttggaggtgtttcactgtgttaagctgctgctacacagccgtagtagtgcggctgacaccgtagatatatatctttgctctggtattatagttactgccccgctttcagtcacaattggtactaccgaacaccccctctatgtgttatactcaactaaattttaactgtgcaaatatagttatcgtgcatgtgcactcaaccgcgttccacctcacttggtggttccacgtcactcttaattcaattgatgtcaagttagtcctgatataattataaaggaaaaaattgtactcctggtatccagcttttttctgactaaaatttagggggcatatttaattgcaaattaattcattgtttttggaaagtcaaattcataatagagttggccgcatgaactcatgcctgttcagtgtatggtgttccgaaatttaatactaagaaatagataaggtaaagtagcattcttatgaggctacttgccagaaatgatataatcagaaaatgatatgatcagaagttggacatgaacaatgactctgtatatccaaatcgaaagtcaaatagcataggctagagatcgtcgagcactcgagcccccaatcaatctgtagctattacgaaacccaggtaattaagttaagaaatccggtgcatccatctcatttttcaattaagatttcccattgactgtagtttttttttttgtttggggggtattattcttcctagaatattggtggagtacagccggttgcaacggtttgtagtagaatgaacaatgcgcgacacagtattgtgataaagcctctgcatcagtataaaaaaaaggaactgaagtcgtaccattaaatgcccttcttttgagattataatgttgattataaagagcacgtagcaaacgataagatttttctaaaaaaaaactttcctcacctatatttcttaaaaacattttttaaaagtgcattttttgtaatattaatttattcgtttgtatactcaagtaattaacataaactcagttaacaattcatcatccattagcaaattcaaattgtcctaaattagctgggttttctatcagtattaaagaaattctattggttacactggagtactggactaatatttaactggtacggttaatataaacctagcgcaactctgttggaaagtcaaatgcatattagagatagccagttagccacatgagctcatggtttacaggaatcaagtgtatggcgttccaaatttaataaagaaaacagataaggtaaagtagaattcctctgatgcaactcgccagaaatgatctcatcagaacaggggaaacatacactaacatttctaaatggcaagtcaaacaggcataacatatagagatcaccgtgacccaaatcaatctgtagagtcgtagagtggacgatcgacaaggcctcgttgtgatagagagcatcactgcatcagcatcggcctataaaggcaacgagtgtcatacggagtattagcgttagttgccaaaaacaagcctggagttagctccatgtatggcagtatggacttctgaaaggagctagaaaagttcttaactaaccaaaagcatctgaaactgacgctactttcctcctggtactgctactctgctaagaagattttaaggctacgaaactttcgtagaagcctacataacgaaaaggttgcatgggcacgatgaacaacttggagacacgagacccataactgggccatcaagcccatcatgccgtcaagaatcaggaaaaggcccaaactgtaaccgctcctactacatcagcccaacgtaccaacctcatgggcttaatcggcccattacgcgctggttcggcccggtacagcgcatgctgcaaccgcgtacaggccatcggaacgacacgtcggatcgtcggcgtcggcagcagcggttaaattaacagaggcgggagggcagcaacaagtcaacctgccaccgtgccaccgcctctccgtccccatcaccctcgcaattactccacccgccggccagcccaattgtcgaaatggcaatcacccacatcacatgcagatcctccctaaaccactcgatcatcccgcccccactcctcctcctcctcatccaggtagatcccaacagccgatcagatctcccactccattattcgcctcgcccattgccccgtggccacgggcgaagccggagggaggggagagacgcggttcctcggtcgccatggacgggctcatcaaggggctgatcaacgtggcgatcgacgccgtcgaaggcgccggacgaggtgagcggggcggcgaggacgacgcgccgaggaggcaccgccccgcgcgggaggaggaggagggccgcggcgacgagcggtcgcggtcgacgtgggccgaggtgagcgccacctgttcgcgcgattgcggaagaagataaaggaaatcgtgagggatgtaattggttgggtttgtcggtctaagcttcttagtgttttggggatgtggcaggtggtctccgatcacaagggcggcgaggcggaggagcgcccggaccatcggaattcgaggcgggtgagtgacgattgctgttttgtctgggagaacattaatccagaccggaattcggttttagttaatcttcttctggtagtttgcagttagtgttatggtagtaggggcgtagttaaggcccgtttggcacagctctggctcccaagtccaacttatttggagctggagctgttccaagcggtccaaatcctttgtttttcggagcggagttagcagagctactccacaaatttgtactacgggggtggagctgggtttttctgctccacagctccactctaccccaaaagacccataagtgcttaataatttaattctctggttgaatttaggatgggaggcaagagaggagggaggatggggattgggagagggtggatggccggaagcagcatcagcacaaccaggttttccattttgtgtacacattttctgtaaaaattgtaagtgtgccactctgcttacgtagctgggctccacgtctgtagtatgaggaagagtacaggagggacagtagtagccgacgcccacagcagcatcagcaagcgccagcttacaggaggcagcaacaggttcgattcagttatcttcttcctttttctttttgcaatacagatatgtacatgaatttgagcaattcacatattatatgtttgtcgtgttgtagccttggtggtgctttgg

SEQ ID NO: 12473 - DNA, 8867 bp, Oryza sativa
agtgaatactaaatagagcttgataatctcatttccggatgtgtttttcctatgctcgttgcgcttgactaatgagttgatcaagttaataatggctaatatttactgcaaaatacatgcttataatctcataaacgaagttacaattatttaacagttcttcctgctgctatttagtttttttttctagcatcagtttaaagatgggacaggtattttgagtgtatattgtggaggcttacctgtttggtttggggtactcaggatggagatgagagaaatgatggagggtggcagactgttggtgagaaaaagcatcatggaaggccacagcaggtttgcttttggttttctaacaattagatacaataacatctgcaaatgttataacttactgagatttttaggtatctgtttttgagtcaatttgagcccatgtttatactcaaggtcaactgactactataaataccccgacaccccgtatcactgttcttgtttggctgaataaagtcaataaacttattacatattattttctaaaagatatttaacgtctgtcagttgatgctgtctttgaactggttagcatgcaaaaagggcccctaagctattccattttgttcaaccaaaccccttttcttaacttgttgatttgagcccctgagatatctacaatgtgtaatcaagcattctattgcactctctgttatatgacaaaatgagccccaagtgtcaggcacagttgaccaacaatctttcaggttttgagcaataccattgaccaatactttgaagctttatgtatcagcccaagcactttggtttattgtactttttgagaactttagtgtttgcatcgttctaccactgtcagagtcagttacccttttataaatgaactgatcgtcagtttccatttcacaatatgagatcgccgtattaatatattctgagcttccttatcctgtctgaattctgagcaccttcataattactatactatacagtctgaagcatggaatgcatacagaaggccaccatctgaacaacagtactgtgaggatgctggtcagatccaccatggcctaaatgtagaaccaaccagggaggagctcaacagcttatcaagagcttgtagccggctgtgggaactcgatatgaaccgcctaacacctggtaaggactacagaatcgaatgtggcgaagggaagaaggtatatcagaagggtgatatggcatctgaaactttgttcagctggctaggcgatgatgtgcttagaaagcccacctactctcgtttctgcgcgcttcttgacaattacaatccacatcaagggtacaaagaagttgttactcagcaggacaagcacgaggaagtagcatttattgaagagattgccaggacagcgccaatcaagtacttacaccggtatttagtgctcaagggagtcgcgtctcaagactatgaggacttcaagagaatgctgacatcgctatggttcgatttgtatggaagaggtggcagttctagcagctcttctgcatttgagcatgtgttcgttggtgagatcaagggacgacgaggacagggagagaatgaggtctcaggattccataattggattcaggcaagttcttgtaatgttacaacagttcttgtattccttgcataaaaattactctgattggtatttcgtgaaacaattgcagttttacctggaagaagccaatgggaatgtggattaccaaggttacatattcccaaggaggcgtggggaatcggtaagtatctagtcttaaaattgatagacaagatgaacttgattatgagtaatggagctaaaatgtgcaatgctccttttggcagcctgattcagagacacagctattgactattcagtttgagtggcacggtgttctgaaatcggtatccagcactctgattggtgtcagccctgagtttgaggttgcactctacacgctctgcttctttatgggaggggaagataaccgcgttgagattggcccgtacggagtaaacatcaagtgctaccgaatgggaaacagcaaaattgggtcagcatttccaattgcagataactgaattcgttccatgcctgctcctgcgtgtatgtgattccttcagctttcagtttcacgaagttattagtgtgctgttcgatttggtcgtttacacaaaagaaccacattgttcaatttgttgtcacaatgtctctactgaaaattgtattatttggattaaccatgctgtacaagttgtagtcacaaagtcctgtaatttgtttttctcaaaacccgtaacaaaaaaatatcatctcagcacaaaaaaaaaatccttcagaagtcaatcctgcattgtgattgtcaactccgacaagagaatgaacaggtcacgtcgcggcagtggcagcagcagccgccctcatgagcatgagccttctcctcgcgtgagcgctcgcgctcgcgttctccccgagcgcagcaaggtggagcatccgccgcctcgccgccgccgcggccacggccacgtcgtcctccacggccgccgccgccggcgagctcgagctctcctccccggcatcatcatacacttcgccgtccagctcggcgtgccgcgtcgcccgcctcagccgctcgaccacctccgccatcgcggggcggtccttgccgtgcttcgcgaggcagccggcggcgagctcggcgacctccctggccgctctcacggagtacctcccctgcagcctcccgtccatgatccggccgaaccgcgggctcccggcggggtgccgccgcacccactcgaggagcttctgctcgtccttgggccgactcttgtcgatcgaccgccggccggcgaggatctcgtacagcacaacgccgaagctccacacgtcgctcttggtcgtgaggtgccccgtccggacgtagtccggtgccgcgtagccgtacgtccccatcacctgatccaccaaagccaaaacggattcatttctgaagaattcagaagtgatatgatccgtgttgagttgacacattttctgaactgtgatgtttgcacataccgctgtggagacatgtgtctgaccttctgatggcccttcccttgctaatccgaaatctgacagtttgggtctgaactcatcatccagcagcacatttgcagccttgaaatcacggtatatgatctgacaaacaaggaaaatcaggtgaaaatggtgtgttttctgatgaagacgcgcagtttttcggagaagatgtggattacctgaaactccaggccctcgtggaggtacagtaacccctcggcagcgcccagcgcgatctgcagcctgacgccccacgggaggacggggtgggatcggtcgaacaggtggtcgtccagcgtcttattcggcacgaactcgtacaccagcagccgctgcgggcctcgctccgtctgcgccgcgcagtagccgaggaggttgacgaggttggggtgctccacgacgcccagcagctgcacctcggcgagccactccttgtgcccctgcacgagcacgatacaatggagtcgtcacaaatggcggaagcggtcgagatcaaccgggagcgtgtcgtcatgtgtgtgcgtgcctggcggctgtcggggttgagcctcttgacggcgacgggggtgccgtggggcggctcgccggggaggcggaggacgccgcggtagacgcacccgaagccgccccggccgaccatgagcagcgggctgaagtcgcccgtggccccgcggagctcgcggagagcgagctcgcggggggcgccctgcctcgcctcgtacggctccggggtgctcaccgccgaggagctcgccgacggcctcgtgctcgcccacgacgacgtgcacgtgctcggcgcggcggctggcacggacacgttcgagcacgcatcggtggaaacggcggcagcggcactcggggagggcggagccggtgccggcgccggcgccgccacctccggccgtctcttgctcctgcgcttgtcctggaagaggcacatgcagcccatttcttggaggaagaagcccggctgctaccacaatttcaggtacttcaagaactcagaggttgcagagaaaaagatcacgcattggtgattaaaacagagacattttctatttcttctgttgctcgacaatgacttgtctgtacttctacgtgattaaaatccaaccaggagaaggccaagagcaaagagaacacagtggaaggaagaaccaatcgatcagagaagaaaaatccagcaaagccagatttctgccagatggaagagaaatccaacagtagacagctgccgatcacaagaaactcaatggcagcagatgctcaagaggagacatgcctccaaatggccgaatcgtttgatacaacagtcatggaccatgaactgtgtactgcctaccgtgatccggctgaccggctccgaagaatcaaagtgctcaaccagtcagttctcagtcacctcccctgccaacctctttatccttcttgcttttgctcgaagcaagcagaacgcacacacggtttcctgctaatctgcattctgcaagcatcatgggtgtttgaaatgttcaaacttcaaacattacggcgtccattggatcatcaacactacaggatgcggaaagatatccgcagccacatctctggctttctcccaagtcccaaccaccgcctcctctccctcgaccgctgcctgaaccacgagaggatgactagatgatcccacacggcacactacattgatgttgctaataacatccttttttttcttcctctttgtgctcatctagtcatctctcgttctcttttttcattcttggaaatctgcacccggttgacaagaattattgactgccgaacagtgatgtacttcaacgtattgacccggatacgtcgttgttggcctgctcggtgagctatctatgtcctgactttttgcttcactctgtgtccatcttgacctgcatggctgactatcttgtcgttcggtccaaaaaccggcgccttatgagcggaggacaggataaatgatgtcccaaattatcacagcaaaacagattcctgccgcaggtaagggcatatacaacggtatttattaatggtctctctattgccatgcaaataaatttaatatatcgaagaaagataaacgagtatggttgttatgcatgacagcggcttatagtcgactcttagcatttataagagcaatttttgttgtatggcggtgaaagaaaggaaaaaaaagtaagaaaaagtattttgatacattaatgattagagactatgttgtctctaactgttgtaagatgctagtctctaggtaatgtagagttcatatctgactctacctttgtacacgtcctaagctaatctagtagagtatttcttcagactccaaatactatagtcaataacacgtgcattggcacgggttatatactttactagtactatgtatgttccatgtgttgcacttgcaaggggatatagagtaaaacgaatgaatggttttataaaaaatcatttttttttctattatggttttctagcggatctattctcacgtggaagagaattttttaccattcttgaggtaccacgaggtaccaggtactaagaggtaccaactttgtctatccatccgtttgcaaaggatacgatcggaataacacgtgtggtaacccttcgctctgcatcctcgtcttaatttgctctgggcaccggtgacgtccgcggacggcgcggcctcgcctttcctccagggggccatcgggcgtccgtccatcgttgcggccttcgatccaaggcgccacctccatccgtccagtgcgccgccgggactgccggccatcgatccagggcgtcgttgcttcacaaagacagcctccccgctttttctgctagccatctccaccctccccgctgcagggcaccgttgccttcctctttcagccatctccgccccctttgctcctggtcatcgtgttcgccccaactccacacagcaccagtgagtacggatccaaattaagctccacactttgtcagtcatgccatgtccatagcatgcagagtggtttgttattctaagccttgtttagttccaaagttttttttttccaaacttccaacttttcatcacatcaaactttttatacacacaacttttctatcacatcgtaccaattttaaccaaacttccaaacttcagtgtgaactaaacacagccctagtagctcgcatgaagtgagtcttcagtattttagaagtgccaaagtctgtttctggaactctgaaccttctgaaactcacctgaagtggaagtgtggaactctaaattttctttagtgtagtattcaggtagtacacaatgcttattcagatcttgtttgtggaacataggatttgttaggaatttacatcagacatgtattcagaactttttgaggacggctgatcttcaagctccctgttccttctttagatgattattggagtattgttcttgaaaaggctctttcgtaagcccttttgtaagtaattatgattcagcgcatatttgatgcaattggtttgcaaacaaagctctggtttgcaagactactagtttttttttttgcatcaggcctctgaatacgtggatttatactgccttctccagtgagaagctttgggcctgtttggggagctttagattctgagaaacagctgtttggtagccagcttctgagaatctggaaaagctctgaaacccagcttctccagcttctggcttcttagttcatttttcagaatctgtaactacagattctcagaagctgtggactatttggggcagcttctagcagaagcagcttttgggaaaagctgcagctgggacaagctcccccaaataggactaaatttgtctgcttccagagttccagttgccttgccgcatgttgctggaggcctcagcctcgccgtagcctgtagctaccgccgccctggcgcgattggcctggcagctgccggtgcccttgcgacgcccttcctcactctagcggattagggagaagagacgaggagacgacgccatcaggattgaattggcaaggggaggaagcgggagtgccgacgggatgggaccctgaagccgccattcccctcggctcaccttccccgaggtctatacatactaatagggaggagggactagacccctcttcctccctccggcctccctccgctgtcgccgaagaacgggagaagaggaggaagaggggccgaacaaaagaagggattacaatagcttgattaggggaaactagagagctctcccgcctgttgagtctaggcttcaaggatcaaagttccagtattgaattagaagaggccgaggagtaaggtagcttacaaaggaggaagggagggtaatataccattaaacttcgtttttattcattgcaatgcaagtgcagtattttgctagtaccattaatcttgagtattatattgttcgtgttccatattattttctccaaagaaagactcaactgccgagtctccggtcccacatccataatttcatcgacaccgacttcaatttacagggcaaaaccaaaatacagttcacgaaaagaccaaaacgccctctgcctcgcaggagaccggtcaacgcgtgagacaagtcttgatggcaatagcgtaaatacgcccgaacgcccagcgtcatcgcaggatatacgcctcgacccggagattacctaggccaaagggttccgttcctttccgtgttgcctcccaccgcaatctcgtttcggctctccggccctctcctagggtttcgattcctcgccccctcgatcctcgacgacgcgaggtgcgtacgcccatggattctatagcctcgccttccctcctcgattcgatccttggtccatctaaatccgtcgtctttgtttggtgatctgcaggtggttttccttttttttttggttttgtttgtgagagtggggggagatgccgccgaaggctaggaggggcgccgcggcggcggggaggaaggggccagggacgaggggcaggctggtgaaggcgcagcgcccgtggagtaggtgcccccgaggaggttaaggctgcggagaaggccccgaaggtggaggagcagaagcgccagccgtcaccgccactgcagcagccggccgcggaggagaaggcctcgtccgacgctgcagcgaacggcgcgagccacggtgaaggtattgcttgcttcttcttcttctttcttttttttttttggtatagatcgtttatgttgggttgtactatgtcagttttttggtatattaagatgattgctgcattagtgtatttttatgtggggtgcaatgaacgtccgaagtagcatgtcatggatgtcttgttatattgactgttttccatttaatcctggttagcattgcttatggtcgcatggtttgcagttggaatattagatctatgagatcatttagtactgttccaacggttggtctttgattcagtctgagtacatggcattgcccttcaacaaacagcaacattgatctttcctagttttatgcaagcaaaacatagtgagaaccactcttaataaaacattgaagatcatatgtttatggcaaacataaaagatcgtatgtttatactttatactcatggctgtttttttggctatatttttattggatagcagttgcccatgtagtaaggttgtacttatttcatttttagatgagggaactacaaaagaaacatatgaagaggataaaggtgaacgattggaatttg

SEQ ID NO: 12474 - DNA, 417 bp, Oryza sativa
ccggtgaagaggggcggcggccgaggacatcctcgtcgttgcggagccgaaggaggcgacggcgcaggtcagcgtggacgggaccggcggcgaaaggcggccggaggcggcaaaagcagcggcgtcctcggtttgcagtggaggtggtgtttgggcgccgttttggtggagaagagtggcggacaggcttgctctcgcggcagcgcagctggttggggtggtggcagggtgcgggagcggctcaggcggcgacggcgtgcggctggatgcggctggcggtgatgtagctcgggtcggcggtggcggtggggtttcggcaacggttaggggaagaaaggtgggggccggggtgcggtgtggagcggcgatgccggcggcgcaagcggcgcggagcggggacggcgggagcggcggcta

SEQ ID NO: 12475 - DNA, 3151 bp, Oryza sativa
gaattggcggcgacgtgggcggcaacgaccgtccatggcggctactgcctgggaagccgaaggtagaggaagagcctgacaggtggggtcgccgggcccacctgtcggggagggagagagggaggagaatccgggggtaatgtagactttgcgcgaggggaagggaaaacgggccgacggcccaaaagatgagaggggaggccggggaggaagggagagaggcgcgcggcccgcgggagagaaagggggattgggccgggagtggcccaaaagggagagaggaggtttttaatttgtttttcattttatttaattggttaaatgaactttgtactattcaaattatttctcgagctccgaaaattcgcgggaaatttcagagagtattttaaggcacaaagaatattacaaaatattctcggccaataatttttaaaggaaatttttaattccctcaataattcacttgattaaattgctttaaattttatttaatttctagaaaatacattatttaatgatttttaatcccgaacaaaaatcggggcgttacataggtgctaaatttgggtgtaaacagctgtcacattgaatgtttgaacacatgcatggagtattaaatgtaggaaaaaaaacctaattacacagaattgcatataaattgcgagacgaatcttttaaatctaattgcggcatgatttgacaatgtggtgctacagtaacatttgctaatgacggattaattaggcttaataaattcgtctcgcagtttcctgatgaaatctttaatttgttttattattagattacgtttaatactttaaatgtgtgtctgtatatcttatgtgacaaccaaacccaaaaattttccccaactaagggcctgttcactttgatgtcatttttaaccttaccaagttttagtaaagttaccaaaaaaaaagtggttacatttagtttgctgccaaattttgataactatataagaaatcctgctaaaattttggcaagttaccaaaatttaatatttttttggcgtcaaagtgaacatgcctaaaccgatggtcaacttttgcaaaaaaaaaaaaaaacccttcatcatcagagaagtttattcaaaacaccctatactttccgaaaatataaggacgaatcaagtttctcaagactatgatctaaaaacgtgagagaacgaggtcgttctcgcaaaaaaggcaaacctccaccacgtctccagtctccaccactcccagtttaccggctctcctctcctctcacgcccctcctcctttcattccccatcctcctctgtctctctctctctcgctccctccctcccgcgcgtgccgccgccgccgccgccgccaccgcccgcccccctcgtccgccgcgcgcgcgtgccgacgaggagttctcctcactccctttcagcccctcccaatccgagaagcagggtatgtatgcacatgtgctctcctcttcctccctatgtttttttctcgatctatttctgtcggggggtttgatttagttagggatggcgctccatcgtacctgcttgctagttgctatcgtgttgggaggtgaggtgatgttatcgtgttggtcatcgtcagcgctgcgcctccccaagtttttaatttaggttcccttttgaagaggtgttgaggatcattacatctaaacataccattagtataattacatcgcaacccagtagtattagaaagggtatgtataacccacataatttttgcaactacaagatgtttcttaagagtgatcaatgagcaacattagttttttacaacatacacctttgtcatctcgcagatcggtgggctgctgtccagcaatgatgtcgatggcctccaccaccgccagccccttttgcccttcacccatgcccagaggacgcaaatgcacagttcgagttcaaggtatccgtctactcaatctatgcagtactctgtaatctgatcgatttctgatttcttttgcttaatttgggggtacacagctggagctgccggagcggatgcatctgataagtcgctcgagattatgcgcaaattctctgagcagtacgcccgccgctccaacaccttcttctgttccgagaagtccgtcaccgccgttgttatcaaggtaatggaaccaaatctattttctacttctctcttgaatcctcgttaaactttacttttaaaaaaatctcactgcgtgcacatacaaatcaaatactagcaaaaatcatcttagccacaaacaaattcttctatgctgctatttcatgtgttctgtacctgcagcttgataagaagaatattacgccctattgctgctgttgaaagttgatgcagtaggcttcaatcttaggtagaagagaacctgccagtaggcccctgattttccattggttagcaaggccttccatacacctcaggggttcgacacggtaagttaacacgcagttttaagtatcttaggttgcattgatgtagaaggtgagtgctgcgtactgcctgagattttcagagcacaaaaggaactttgaatgcaacatgtatttctttcccagtgctgtttgggatatgaaacaactagagcagaaacagtgaagcatgccagctgaatgctgattactgaactaaaatgtatatgaagagtgtattcacagcaatctcttcatgaaaaaaaatagaaaacccaagtccaacataataaaaggcatatatttgagccccatcctctagataatcaatcatattactgcattgtctaagtgcccaaatctcaaaatagtttaccattcccaggtaaagtttgacagcatctccctgttaaattacattgctagaatagagacataaataatagcaaatggtatttcctctgataactgccaaaggagaagaaatcaacaattgcccaaacatgagtaagaaaagagtactccaattgatagtccgaaatcgtggatctcaagcagcgaggaataattacctcagatggtgacaaatccgtgagtagaaaacagatcaaggcgattgctatgatacaaggtctatatacgaatagatgatatggttggttgagttgttggaggtgggtatacatgcattttaaatcatggataatctttttgttg

SEQ ID NO: 12476 - DNA, 525 bp, Oryza sativa
taatgaatatgatgagctgttggacccatctgttttcaattggttgatcaacttttgcaggaaggaatgccattgcatgctttttcttacccccgacaatgactttgctggacaagaccaggcatgctcctttttcacaatgttttcttcacagataccatctagctctccgttgtcattgcatgaacgtcatttctacaaattcctcaaagtaattttatttttccttatatatactctatgcatattgcaggctataaccttggaggagatcaaagacgcaacatcaaagatataacctcagtgcaccttttcttccattattctgcttgacaccagagtttgtatatgtagtctctgtaagatgacattctaccgatgaaatcggtcatgataagatgtgtagtaaacaacaatttgtcgttccttagctttcatgttcttgcttttgaacatgggaaaacacgctcccactaatacaacagcctattaactacgcacttgatacaaagcatcatgtttgtt

SEQ ID NO: 12477 - DNA, 399 bp, Oryza sativa
cctcgtcgcgagccgtcccgaaggctgtcgcctgagcgtcgcccgagggagtaggcccaagcgacgcgccaacagctttgtcgtgggctgcctcgaaagacgccatcgcctcagtttggcgggctcgggcggcctcctcccgagcggtttcctcggcttggcggactcggccggcctcctcccgagcggcttcctcggcttggcgggccccggcggcctcctcccgagcggcttcctcggcttggtgggcccgggcggcctcttcccgagcggtatcctcagcctggcgagcccgggcggtttcccgggcggcctcttcagcttcccgaaggcgatctgcggcctctcgccggtcagattctcgcctccgttcctctgcggccgccggatcttcggctt

SEQ ID NO: 12478 - DNA, 560 bp, Oryza sativa
gagccaaatgagcccctgctactttacttagcggcgaccccccaagtagttagtgctttttttgttttggagcgcgaggaagacaaggcgcaggtcgtgcacccccattctgtggtaactaggcccgggagcgagcggggaggagaggcccccgagtcggacgggggcctacggcccctgacgaccggagccggccctctgcccgcttgtcagacggagctaggtgcccccgaccctcaggagggccccaaggccactgcgggaagggcgcacttaacgccctttgaccccgaggctaaccctgtgctgactcgacccgggaaagagcagggagaagaggccccccgagccgaacggaggccagaggcccctgacgaccgaagtgggccctttgcccgcttgtccgacgatgccaggagcccccgacccccaggacgggcccgaggccactgagggaagcccgcccctttcatcctccgaccccaaggtcatcggcacagaaaacaagtgcgccccgaaaggccacttgaacgaagaacgccccggggatacggccccta

SEQ ID NO: 12479 - DNA, 356 bp, Oryza sativa
acaaatgcacatcacatactacaattttttacaccgaaaatatgatatacaagtacaaaactagtgaaaatatgatattattataatgtctcaaaacatcataagtggcttacttaacaagctaaaatgacacattcactaatcaatatccctgctcctcttcatgttttaccaatcctgcaaactggaatgacacatttacttaacaaactgctctgcgctgatcttggacgtcgaagccgccgcacgcgcactcgaacgcatcggtaagccggcactgctgatgatgcactcggacagggcgcccctcgccgacataatatatcaatacaggggcgtagccaggagattttcct

SEQ ID NO: 12480 - DNA, 4291 bp, Oryza sativa
tcttcaaaaaaaatatgagagtattagattttttttctaatttttttactaacttttttttttgaattttatgatgaaaggaaagaatagagaggagtataggggggaggggcaagttgatcgctcccagtgatcacccgcccattagattcccccattatcttgacttgtgctttgttattgattaaccaagcatttcattaactcacaaaacatttagctcatttcttgttaactcacaaaactgacgctcatctaaaggcttagtgaatatgtcggttaattgtttgtcggtgctcacaagggataggaagatatcacctttggctttgtgatctctcaagatatcacctccatgcctaaccaatttaaccaatttgcctgcttgactcgttgtagtggtccctgcacaaagcagagacatggaatgtccgtaggcacttgccacgtgcccttagcgttgcccacttgcatagggagagatcaattggggcgacgttgtgtatagtcactgctccacaaccctacctatcggtgtctaggcagagtgggtgaaaagcggtagggctagaagagactcttggagtcaaccgcaccgcctggcagctcacaccgtctgacagtcctgcatatctcacaccttggcgggtggatatatgtcacatcacccttaatgggagtaacttgcaattgttgatgcgaaacacggtggcctaggagttctgcttaactccagtgcaggtccaaggctagcctcgagtgtgtcaagggcgtgccagctgatttgatcctgcaatcagcaagaaagacaaaagcagagttagtcagccgatagccgatcggccgacaagccgatagtgtatcgttggtagtctcagccgatgtagttagaccaaatcggctatggactggatagatgaaggaataaaagaccacatgcctcatcggccataatattgtctattaggtttgataaaaaaaagttcaagataatattaggagaatagccgatggaacagtatttagagcagaatgtatagataatgataaactactagctaatactctagtataaacttatataaacaaatcaatctatataaatatattaaatcatgatcagttagtgtttcagatagcccaggcgatactgatctaacttgatatgattatataggatgatttgtctatataagtggcaaatatacataaaaatagtaaataagcatgtatattaggtaagattggctggaactcccatactatctctaattataattaattccatgttagttcttagggttctaaacaagattagggatgatgcatctcaaagtaagctgagaaacctaaggtctaaacaatcaaggaattaatcacttttcaagatggtagatgccttagctaagctaatctagtaaggcaatttagacgataccggcaggaaccctaaagcgagaaccagccgataggctaaattgagatactaaggctagattaacgaagacatatgataatagatggtcatgataaaagaactagaacatctaaaatgacataatagccccgatagcacaagccattgagacgggttacctcttgttgagaaaactcgccgaaaataagaacaaaaagggtagcgatgtgctgaagttgtattggattgtctctcgtattatagttgtacggggttcatatttataccccaagtacagacttagtccattatggacatgactcaaacctttctaaagataaaatacaaacaagaccatatatggtggcctcttaccaaatctaacgaaaaccgacttaaatatcctaattaatagatacaattgccttaatcgagctctatctttaattggcaatgacaatcattccaatctaggcctataccgagcccaagttaaaccgtacgtatcggctgtatcggccatcgacctcatcaacttgatcaatatgaatctctgtttctaaccgatatggtgtccagccgatgcgtagtctaacttcaaatccaactcaattcaccaccaaatccgcttcgatcttcttccttcttttccaaatttgatgcaaaattccgttgttaatagcaatgcatgaggtgtgatggcacgtctcgctctagctgaaacatctaggcccccattgataattttgttaattaatgacaagcactaattgtggagtaactatttcatttcagtaaaatatttatattaggacaacatgatgtgtacgccaaggatgattaccacggatcaaaattgatggagcaaaaaaatgggataaaggtggcaaacctaactttttattttaatcgattgaggcattgggcgatagaattgtgttaggtttatttctagctttgccgtactatcaagaggggtaataactttggtaaagaagtgatcaaaatgacacattatgtcatttgcatgatggcttggtttgatagttttatttatctatctttctgtctagggctggtcagatcggagtgtcctggcaagtttgaccgagccaagctcggtctgaccgggcggcggatgagtccattgcacggcctcggcttcgcgatccatagccaccagagccgacatcggtgttaccaggtcgagacgggtctgactggagctgctagcgttctaactatccgagccacggtggtctgaccaacaagtgttcggccacgcattaaatgcaatcaacggctagttttttagccattgcccatttgccctaaggctggtctgaccgaccaccccttggtggtctaaccgacaggtatccgagggttggggttttggcccaacggcttgttttggtgggtagggatataaacactccctcaccagccaccaaggttctctcttggcgcattattcactcgcatacaccccttgcattcactctcacaccaatagagcttttagttcattcatgggggttgggtgaaagtaaattgacccaattcaagtgctttgcatcgttgaatgagctagtgtggcacttgatcatctcccagccaggttgttacttgttagtcttggaggtaacagcttggagtagttgcccggtgacctctccgtgaagattgtggaggaggctcggtgatggttgtgagtggtttggtgttcaccatgatgaaccctgagctccactcgagacactcaaggctgttgttggaccgatctttcggtgagttgaagataactatgatttgggagaaacgttgacgactcgactacaaccgtactagacattgttgtgttgcgccttagcgatcgatacacctctccgtgggttgttgatcttgccggtgcagatcaaccttattcctgcgagcaaatagaagaaacaagcaagaacaagataaaagcaatctgaattgcagataggaattgaatacaaatgataggttggggttctgtaacgagcaaaccggcgatctaaccgatcacgggattacccggcaaagtagcaaagctaaacttttatctaaacaaaacccaagaaactctaaaggggtacctaactatttataaaggtgtgaagacaaccaagtggactctagggtcgtgctccacctggttggggcgcaccccacatgggccccacttgggccagggtcccaaacgaagttacaagcccaaaggcccatgacaggtgacacagcaccttgtttttgtgtttgcggctaaactagatggagtctggtgatgaggctggatctgttggaaagagaactccgagagctttccatcaagtactcatgggccaaaaacggaggtcgtatgcagatttggtagccgtttgaagtcagcaatgtagcaggtggccgaatcggattccagcacttggaggacttgaacttgatatcttgttgttcatccatgatgtgagcaacggatgtatccgtagtagccatggtcacatcacaccaccttcagagtgaaggaagaactagggaccctagtgatcgaggcttggatagtccacttcggggccggctcccaccttgctcaccacttgacgaaggggtttggtggcttcgtggtttgagcggtgaagttgggcttgcctcaacggggattaggaaaccgatgagtttccgaacttaatgcattaagtaaatgaaacggttaaaaaatttcttgtctcctgtctcatttacttaatgcatttacttttgtgcagtatattttcatagacatacttgagcccttatcaccgctgaattgcataacttaatctagttgcttagttagtatagttgttcatg

SEQ ID NO: 12481 - DNA, 2305 bp, Oryza sativa
gctagtgcagatgaaccttattcctccaagcaaatagaagaaacaagcaataacaatataaaagcaatccgaattgcaaataggaattaaatacaaatgataagttgggattcggtaatgagcatactgacgatctaactgatcatgggattacacgacaaagtagcaaagctaaactttaatctaaacaaaacccgagaaaccataaagggatacctagctatttaaggaggtaggagaatgaactaggggtccctaggtttgtgctccacctagttggggcgtacctcacatgggccccacttgggctggggtcccaaacaaaatttcaagcccattggcccaatataggtgacactacatcttgtttctgtgattacaactgtcagagaaggaatatggagatgaggctagatcggttggaaagagggctccaagagcattccaccaaatactcatgggccaaaaacagagctcgtatgtagatttggcggccgtttgaagtcaacaatgtagaaggtggctgaatcggattccagcacttgaaggacttgatcttgatgtattattgttgattcatgatgtgagcaatggttgtatccatattagtgttaacgaccaaatttggtaagatatgaactaggtttggcattggactcagagtggattcggcaaagagttagattcaaagaacagagtatgcatcagctgcgatggcatcggctgagatggatcggacagaggacagccgacacagcttattagccgattctgatgaagacagttgtaaaactgcttctagaatcgatcaacgtgcttcgcaaggattgccacgatggagaaaagctctcagaaaggcaattgtatctattaattaggatattttgaatagtttccttagagatatgtttgggcaaaagtctgccgtaaagacttagagttaagagtcatgtccggcaaggacatatcatgtatctcgggtataaatatgacccgaacccaatgtaaacaaaaacacacaattcaataacactttcggcgcatcgccacccttttactttcgttctatttcgacgagttcttgctttcgggttgagctgcatcggtttcgatcttcaactagaggtaaacttgtcaagatggtttgcgttctcgggattagtgcttccatctttatgacactctaatcttgtttatgtaatttgtcgagttatcatatacacttcataatccttattagttacgctatacaacttgcaatcggctggttctcactgtagaaagtagccgatagagtttcagccgattttacctgatttagctatctttatctatatgcttgattgttatgctagatctgccctttatattaagatcttattgcattaaaagtatattacgctttctgtttaatatattttgcttgttttgatatcttaatatagagtggtatcgaagtattagccgatacatgctagatctatctgatcagctatgctataagcgttcatataatcatgatcttagtgtatctttagacttaaagtgatttatactgtctcgacatggcgttcgatctaccccaattacttagtttaagtatacatcgagagaaagattatatatcattaatatctacagccgatcgagtagatttagttttatattgctttatttctcattgctgatctaatgccgataacatcggctcagcgattgacaatatgtcatcggctcatagccgatcggctatcgtttatggatttaacctcattttcttgtcttttattcttgttgattgtaggatcaaatcaactggcatgctcacgaacctaaaagcaagattttggatctgcacaggagttaagcagatcttccaggccagtgtgtgtttttcgcatcaacaagtagccatggtcacatcagcagggaacctttgttaccatattaccaatagtttaccctctagagtttccctagtgcgatgaactgaagggctgagctactcttgcaaatttgtctgaacccacacggaatcgacaggaactacaccccaagggtggtcagttacctgagcatgggaatttcaccggaatcaagagagtttgaacaatcttatcccaaacttgttgctagcatcgctatcaatgttgcaccctagcaatttatgacccgagatggaataagaactaatattcaggggtaacaaagaagaagaacaacaaaggaagcttagggaagaagaatatcggaatttcttaggtttgcttttatctcatttcttaacaaagtgacagatttctca

SEQ ID NO: 12482 - DNA, 718 bp, Oryza sativa
atgaaccagaggaagatctgaccacacatattcccttggattcgatacccttggaatactccgtaggggaagtgctacatcggtatatccgtgcgtttgcggatttcatctatgatcgttaagaaataccaaagcatttctggcaccgttgccggggaacggttgctgatcatttccgaacctagttaatcctcgtatctctgttccattttttttgttctacctttacccctgctacccagagaagtgctcctgtaaaaccctcctcgaccatggagcaacctcttttcgagctatctgctcctaggggcgaattctatgagccacctccttcatcggagcccatttatacaattggctatgaaattcgccccgaactaatcagcatgtttagggaaaatcctttttctggcttcgatctagaaaatccctatcatcatctgtgaaactttgagcaagtctgctcatgccttaagattcgtggcatgagaagaaactgtgcagtggaaattgtttccgttctctcttcaagagagagcgaagcaatggtacacctctaccgttggatgtgtaaacggtagcttggaaaagttgcaagacagattctgtcttgctttcttcccagttactagtattactgccctttgagtagaaattctcagttttcagcagatcaaaaacaaatcaatcggtgcagcgtggtccacattcactaatt

SEQ ID NO: 12483 - DNA, 658 bp, Oryza sativa
aaaaattataatgctgtcatagcttttttggactccattgaaaatcttgagagatctcactgttcttgaatggaactttagaattcttatcagaaacaagctactgttatacctaaagtataaacaaatttattggcaaaagaagtgtattatcagatgggccaagtttggggggtgagaatacaaaatttttccatgctatggctactgagtcttatagaagaaatgcaataccctctttagtagattcttctggtttagtctgtacaagacatgaggaaaaggctcacatagcgtggagtgctttctcttcaagaataggttgttctcagtttgagtttatgccttttcagcggcaagaacttttccatgcaaatcaatctcttgctactttggatcaaccctttggtatttctgagttggacaaaattatacagaatctgcctatagacagagcccctgggcctgatgggtttaatgggatgtttgtgaagaaatgttggccaatcttttgtcaggattattatagacttgcagctgagttctactctggtacactggacctggatcctttaaaccattcttttatcatcttggttccaaagaaatctgtgcccgaaggtataaatgactataggccaataccactcttgggaat

SEQ ID NO: 12484 - DNA, 10284 bp, Oryza sativa
ataacctgaaagatcaaaaggactcagtaatgaattttctatgaccaaggaatttatcagtcattagggaagcaaaattgaaatgttatattgagctgtgggactgatgttttctaaacactgcaggtagtcaatacctcaaggttaggctggtagagagtgagaatcctttaaaaaaataaccaggtttgcccttgaggggtattctagccagttttgatagtcgaagtgtgtataaaatgtctggtgtcatagttgagggttgatttctagactaaaataattgttgaggtggagtaaattagacttcacgctaataaaaacagcatgaacatcacaaaagataagataaattcatttcaataagaaaaaaacatgaacatcacctgattaacttgatcgagcttgctgattatattgagccgaacatcaggaaattcatccttgagcaaagaaaggaaaataggaagaagttgttcgattgtagcctcctacagaatgccagaaacaaagcaagtcaggtttccaacaatcgtgaagcaatggtagtaaacaactgaacagtaaagctggtgcaaacaaataaattgaattatttcaagtaaaattttatgaagatattttgcttgtgacctttcccaagacccgggccatttccataataactgaagccaaagctgaacgaacatgctgagatgaatctgatgacaattcctgcagatgcagttggcaagttagtttgctggggaataaacagcagcaaaaaaccagttaataatatttggttaagcgttggcccaccttgacacaaggaagaatatgctgaattgcaagctgaggacttaaaatcctacagaacttagtaactttccctgcagccgctatccgcacttccgcctcattgtcacgaaggagacgaacatatgccggcaccaactgctccctattaccaaacacatgaacataccatagatgaatattggaatcagattacaaaattatgtatttagataagaaataaataataacttgcaccatttaaggaccaaagtatttatgattggttttgacagaaaagatttaggacataaggcgcataatacctagaatgttcaggaccaactgcctcgcagagctcatacaattgattggcaaccatataacgaactcgccatgatttgtcctatttaatgagttacagagagtaaaagatgtcataattatggtaacacatacaacagaagcaactcggagcatcaggaacctctagcaactaatgaatgtctgcaaataaatattatatgtgatatcaagtagatgacactgaggtaccaagtaggggtgtaatttacctgggagaaattgacaataactggaaggatatgtgctacacaatcttgtggttccaacaatttcccaagagcagcacagccttcaactgccaacaagcgtacggaatcttgatctggtaataaaaggccagcaatattgttagatgcattatttaggctgcagaacatgtatagtaaatgtcccaactggctcaatcatgcactatttgctccatgacagaattgtcccaactggctcaatcatgcactatttgctccatgacagaattccattgaaaggctagtactatgatttctgagagtttgtgttgatatttgttatcttcaggcactaatggactaacattggactagcataaacagttgtacaaattgaataatggatgcatacaaatagctctttatgctagttcttggtacaaaactgaagcagcaaatgaactgggagtggtaaattcaacagaattagaatcagcaatgcagtaaatgggtacagttttttattagttactaataggattattaaagactattatgtcatgaatgtaaagaagtatgaaatagcacaaaatattatgtgagaggtgcatggtaccatcttgggttagatcatcaaatatcgacatgacttctgtctttagatagttctgttcaactgtggctgcaaactttccaagatttgatgcagctgcccttcggaccataggcatgtcatcttggcatagctgaccataaatggtcctcaattctgccttcaattgatcaggagcacttggatatgctatatggaaaagtccacaagacgatactcgagctgtaaaccactcaccagctgctagcctctgaaaagagtaatgcatggttagctgaatacaacacgatgtagtgtaaaatagtctgtccataaagtattcattagtggtgctagatggaatggactaaggaaaaggaaaatgaaagcatgataactaatgccattgtggcactgtttccagtcaacaattgcaatgtgttaaaatagcttctatggagaacaatcaacaatatataacaaaattgcaattgacaggcaagaaacaaacacaaatatcacacaattgtatgccaaagtaacaagaaacctacatagtgaagttggcagcgaactgataaatctggcaactctacagaaaaaaaacaattaaatattaataaacttcttacctttactactggaacgaaccagtctacaatgtcactttccttcatctgtgctccaatacggcacagagattcaactgccttgtctcggacacaggtttcctccactgtacacaatgtctccaatggtggtagcaaaacatgagcatgttctacacccccaacgtaaggaatgaacacgcccaattcttcagccatagcaagaagcacctcatcttcatcgtcattattttcactgagaaaaggaattaactccttccgggttctttcttctccaagtgctcgtgcaattgtggagagcctcctaatggagttcagacgcaattgaatatcttcgtttttgagctcatctatcagtatagcgatgggataaagaggctcatccatcgaagccatcagccttatcaaggattcctacaactgtaaagaaagaagattagtgctctatggtcattggaatctagcaaaacctataatcatatatttctcatcttaggcacggttccattagagaaacaaatccatgtaaatctaaaaggtcaagagtgaaccacgcatataactcacaaaatcaagcctaaactatatcactaattaatatatggttcaatcaaaccaagcatacaatatacgacttgcccaaatacaatatttgttgactctcattagatgtaaaacagagatgtcgtctattatctacacatggtttccggagaaaagtcagaaaacaatctcatctaaacattctcagacatatcaagcacaatggaagaaaagagatccttgtgtcgtcaacagatctaaaaacaagatacctaaaacagaagaatttcagctggtgaatgaagctcagacaacttaattcgaattagatcaaggaccaccctctcagctttttatggtatatcgttaacataatttttcacctttccaggcacattttcaaaaccacaaattgcaacctttccaggcacaaattgaaccacaaaatagcaacgcagaagaataaatttgatgtgcggcgagtgattcatcacatcagggtaacagaagaaccaaatcgaaccacaagagaccaataccaccaccaccaacgcacaaacgtaacatcccactagaagcacccacacatacggcaaataataagccctcccaatccgcccccaaaatcacagccccgaaggagaacacgcaggattcgtaccaaccgcgtcaaaaccaacgtttccccccaaccaaaatggcgcagatctaaagcagatgaaccacacggcaacataaattaacccaaaaaaaaaagcagccgcgaaccgcgcaccgcacggcggccaccggaaacctaacccccgcgcctcatcctcgacggtgggggtgccgatcgggggcgccgcgggccagtcgaggtggggtcggcggcgcagatctaacgcgcggggagcgaaggggaaggcgagcgacgggcggatcctcacctcgcggggccggatcggcggccggcggagaggggggcaccgaggggacgcggcggcggcggcggaggaggatgaggaggagcggctcgcgaggggtgtcgccgctgaagtttaggaggaaagggaggggggagagatggatggggatgggtgatgtagtggtgggggtgatggatgcggaaggaaggggatcggagagagataattgagctcaacgggagcgggtggaacggaagatagcaatgggccgggccgggccgtgccggaccttgtccagagtgattttgttttttactgtgcccgtgcgttgcaacgggtaaaggtaattttaatcatttatacagatgggaaaaaaatataaaggaataataataataataataataataataataataataataataataataataataataatgaaataaaattgcagtaacctttgataaaaaagataaaaaatatataattaattttccattaattccattagctaaaaataatataatacgaagtaggaaaagttattctcaaatttttagcaatttttaaaaagcttaaatagagcaaactaattatataaatgaaaacaaatttaatcacctaaataaaacaattagacctataattgaaaatatgttgccagttcatttaaacatgagcctgcgggtgtgtgtggtatatatctctcacttgtatgtcgtggtcttttttttgacatagaaaaaatgcccatgcgttgcgacggctaattaaaattataacaaatataaaaattttataagattaaggtttagttttatatgatatgagctctttaagaaaatatatttataatgaaataaaaaaagttcagctgaagtgacctaaagtgaacttgttccatacggagcgcgtacacgtggtccatgaggcggcccaatagtgtgggcggcctgggaatagaatcggggaggaacaacttaagcgacctaaagtgaacttattccgtgtgggcggcttgggaatggcgttcgacctgacgcgggagaagccaaagccgtccgatctgatagacggtcatcccgacctatataaaagttcaacagcccaaaccctaaccctaaaatcatttcccctccccctctctctctcaaaacaacgtggcggcggcccggcataccgacatccctgcgacggcggtggtggttcggcagcgacgacgacaccctccccttctggcgtcggcattttcttagtgttcttgaatctgatcttgtatttttgtagtagtgttttctttaggatttaggtccaaatttgatgcggtctctcatttattttctttcttttctttttttattttttgccatcggagagggattgaagcgggatcgattgcacgtgcgatggaaaattttttttatggacaaaaactataacccataagccatacaaatttttttaattaggtatatatagatattgaatcggactttccttttttttcattttttttcgcccttttttcgttactacggatgtcagaaacgtctttatttatttttaccgcgtcacatataatcggattcgatttttttcgcccgatttctttttcacgctttttttcacagatggacgatggaaacactttttaatttttaagtagtagagataaagatagagatacagattgagatagagaaagagaaacggaaaacttttttcgcaaccttttttttggaatcggacagaaaaaaattttacgcttgttttttaccgcgttgatggaatcagattcgatttgtttttttaccacgctgtgtcacatataataggattcgattttctttggaatcggacagatacttttttttattttttttcgccattttctttaccgcgtcgacagagttggattcgtttagacttttttccttttttcgcccttttttaccgtgtagacggagtcagaatcttctatttttttcctttttttcgcccctactttttctggatcggacatattttttttcttttttttggccggttttttcccttctttcgcctttttggatcggacaggtttggttttttttttcgctcgcagatttttttcgtttgtttcgtctgtttttttatcggacagagtctttttttttctttttttgcccggtttttttcacacggttttttttcccacggtttttttgacggacgatagaagcacctcttattttttaagtagtagagatttaatgttctataatataacgcgtttattatgtatatatagaattaactagtagcaccttcatgtttaattcattttttaattctctaccctaaaaatatttaatcttattgagtgcatgcattttactctatcatttattatgtaagtcatcttgactttttaaaatcaaacttctttagatttaactaagtttatagaaaaagatagtaatatctacaacatcaaattagtttcattaaatataacattgaatatattttgatactatgtttgttttatgttgaaaatgttcctatattttttataaacttttccaaacataaaacaaaattggctaagaaagaagtcaaagcgacttatggataatttattagagccaaaaaatgagaaggttataatattttttttcattgcgttactagttgttgtgccttatatttttggttgaagagaatattattgtatttttcttctaaaaatatattgctttactactaatctacaagctacatataatatccatccaatacaaaaggttaaaaaaaatccaccttggccatctccctgaaataagcacgatctgttgagcatatgtttgaaaacaatttttgcttgtttaacttattcaatctaaaatgtgacattccattgtaatatatgatttgtgaaacaaaagctcgacaaattgtgcatgcctatcttagaatcgtttactgatcatctttccttgtccctactttatatgagtaagaagcaagattcttttgttttccctaaaaaaaagaaatacatttgttattgtcatgtattatttgaatacaagcatcatgtgaatatttccttttaggaaaaaaatggttatacaacattaagagctcccatttctaattttgtagcaccaaaagttatctccactctttaatttagcattccatccaaacctctatttgttttcttttctttttattatcttcctgacaaaatatgatataaacactaccgctaccttcttttttcttcctttagtcctttatctctaagggcaagagcaatgcttaccccctccgtccaaaaaaaaaaatcaaacccagggacatactagtatgtctttggtggaaataaggtgggtcccaccacaccctctgactatggtcacaatgcttaagacataaagtgatggtaagttggtcccacaactatgtaaaaaagtcctacataaaaataggttccaccatgtcatagagtcattctcaccctttctagtgtgcatgtgtgttttatctcattattttatttcttaaggttgagccataagcttatggccatttttagcatttaatgctttatggctaatatccacaatgtatatgacttgttataaggtcttatgtcacatcgtggatgccctaaatcaccattcctaaacttagcctgaacttgtataacctccattctcaaacttcccctggaccggcacttagccatacctctgtttctgaactcgtcatggaccaagggcttttaactatttgccactcttacgagtggtacttaatgatttgccactagatgtcatgagggtcacatgtcatatacagtgagtggcaaataattaattgccatatcccaagagtggcagtagttaaatttccccatggtgcattgctcatcctatacagttataaacacttctcattggaaagctcaaactcaaccaaaacttgtctattatcattgttgtgctcaagctttccctaacactacgcttcttgggcattcaccatcactcccctgattccttctttctatagagctaatgctcactaaacacataaaactcaacatgtaaacatagtatttattaacactcctaaaacctacatgtaagcatgccacatcaacacattaagcacacaaagctcaacatgcaagtatatagtaattatatctacaatttatttcattctaaaactaaacatacacatgctaaatcatcatattttcaaatcattttcataatatttcaatccaaattattttatcatttctccaatatctaacatatatcccgcagcaaagcgcgggacatcatctagtatagaaatatgtccattaccactgttgtgctcaagcttgctctaacaccacactttttgagcttgttcaccatcgctctcattatcgcccttaggtggatttcattgtccttgagctctccttaattgaataacaccctacagcacgctagttgagctctcctcaaatccattgtcacctaggctcccgactactatctcaagaatcatgcatgtctggttgttattatgctgccctccatctcacgagatgtgccgccatcgagcttgtatgcacgctacctccaacctagcccccgatgcagtgcatttgaactcatccgctggttcgtatttatcgtgatgcgcacaagctccccaagaggcctgctatggtgagttcgtggcatatggaagatggtaaatgaaggaagaaggcaaaatgtatggtagagaaagataacatagttttgtggtgggagaggtttttcgttttggttttgatggaatgttaaaggagtaaaagatataactttggtcttactaaaataatatacgaatttgatgttatatgactaaaacatgaattaacgatgctgtagaaccaattttatctttcttctatgccatcacaatggttcatgtgccaacatctttttttttctaccgctagagctcgtatgtgttatgatagtgagtggcaaagtaatcaaagtaaaaaaaaaaatctatttctcaatgattttttttaaccatcagttaacctaatgttgattaaagttgaaaggcttatagaaaaaaattatgggaggacttttatatacatggttgtttacattgtagccaaaataaaccttaccaaaatttggtaagttggcaatattgctaagttttagtatgattccttatgtatttactaaaatttgattaaaaaaaactaaatgtatgcacatctttagcaactttttttttaaaaaagtatgatttgaaatgacatcaatctgaacaacccctatgttcttagtgattcagaagttaatgttaaaaaaaagttgatgttaaataaaagagttaattacacaatgggccgcttatgtttaccaaggttgcatcttggactaggggagaaaaaaagattttcactttggactagataagtttgcaaaataattcactttgtaccacttccctctactgctctctcatcactttcttctctgccatctaggaaacttggtgagctcatgaaggcagcagcatgcggcccctcaaatcctcaatgcatcagatcagcatgagcaggagtcaactactaccaatcaaggatctgctatagctaggtgctcgcttcttgcgttgattttgggaactgggagcctaggagatcctcgagcttcacgtcaggtagagggcacggcccggaggagatgctccttggcgatgagcaataggcgctcgccgtagcctccacaaattgggacaatattccccgatgcagttcaccaaggcatcaactatgcttgctccaatgcttcacgatatgcagggcatggcagaatgtgtaggtcgagtagagcgcgtacggcaccaacggaaatcaagctcgagtggcaatacgtagacggcaatacatagaatgtggaggcctgcgttcttgaacttttttttgtgcgtatgtccttctcatctccttcatccgttgagtccgctctcatctctgcttcctagtcgaccgcaagtagctggccgtgattacggaggagagggcagtagggcacgacgggcatgggtagtgctacctgccgcaggcattcccattactacatgacgggcaaggagcactgcccatgcccatcgcctgtgggcgccatgtgcctgcaggcctgcctgtttacccatcacaattctccacagaccacaagtaagacgcccatggttggagggga

SEQ ID NO: 12485 - DNA, 8801 bp, Oryza sativa
gactagaggaaggtgtcacggccgacggctggaggacgtcgatggccggaggtgggagctcggcgcagacgggataggaggcggcggtggtcgcagcttcgtcggttgcccctcccgtggcggctgtgaaagtcgtcggctggagggtggggccagcggctgtgaccagaggtgggaggtggtggcgattcacgcgcccctcctgtcccatgtcggcctggagtggcgactgtggaggaggaaactggagtggggctatgaaggaaaggggaagagaaggaagaaaaccccatagtcttagatgtggtttttatattaagttgaccgagggcccacatgtcaattggttctcgcgagtaaacaagcgaagtttttgcgcccgtttgcctgttgagtacaggttttgacccaataaaaaacccaagggtaataaatggagaataaatccaactctattagggtttttacccacggataaacgggcaaacgggtcaaattgccatccctagaggagaggaagaacactatttgatgctgacgtgtgggccaccggttaaaaaagcaaagtttggtaataaaacttggtcaaaagtgtaaagatgtgctgataactggtccaatttgcaacttaggtaataaaatctgccctaaagtacaattcactccaaaaataaagtgcgatgaaaaaaaaaactcgaaatcaacttcacaagtaaattttataatttaaattttggcagcagcttaccagctagaatatgtaaaatggtaagagcagaatcatgacatagattaaggccctatttagttcccaaaacaaaaatttttatgctgttgttggcaactttttgtgacaagttgacaacaacgattgcagcaccttatgtcttgcggtgatcttagagtcgccaaccacctccatctagcaaagagctaaacctagatgggttttgacaaataaaccggctagcggagccaatttaagataactacccgtctcgtgggcaaaacggaaggttttcaggacaaacctacaaagagatgtcgcactctcgcagcaggcagcggacggtttacggcgcaaaccgacaaagatggacaaactaagagaaaactaaaagcaatatgaaaaaacgattcaattgattgattgtagattggatttttacaataatccagccatgtcccttatataggggttggtcttgccctctacaggccctcctccacgtccaactcggggtagaaactaaaggaaacccgaaacatgccttcacgagcaaggaaacctcgaaacccgacgaaacacagtcagacttggacctgccggttagaccggccacacaccgcaggtctgaccggccctcaatcggcggtctgaccgcccaacacacggcggtcagactggcccactcaaagaaaaccggtagacttccaaattttggcaacctttcctattttaatcctaggtgccaaatttgggtgtaaacacatgccccctgcctttttgatgaacaacgtgaatctaaaagcatagaacatgttttggtcttagggcgataatctaattaccggccatagtacctcctaagcgtcttgccacacactcgggaagtatttcttcaagtatttcccattgattgctcgctgaaaacgctcccttgaagtgtctccaagaaatatgcgtttcgtcgaacaatgccgcatactcgggaccctcccaactaggggaccacttaccgaactccctggatcgagtacccaaaggcaaaattgtcttccaaaccaagtctccaacttgaaacaactttgctttcaccctcttgttgtacgccttggccaccctcttcttttctttctctatctcttccaaagccttcaggcgcttgtcgatgacttcatcaaggttgtctcccatcaacgtcttgtaatctttacttgacaaatcatcttgcctgatgtaacgaagataaccaagatttacctcaaccggtaaaatgacttcttgaccataaaccaactcaaaaggagtgactttagtggcaccatgtttagatatcctatgcgcccacaatgcttcgaaaagcacttcatgccacctctttgggtgttcctcaatcttctttttcactaatttcaacaatgtcttattactcgactcggcttgtccattagcctgagcgtagtaaagagaagaactcaacaatttaataccataagattcggcaaaattcttcacttccttagatataaaagaagcaccttgatccgtagttaatgtttgtggaataccaaatctatagataatatgcttcaaaataaagtcaattacctccgtatgagtcatattcttcaacggcacatcttcggcccacttggtgaagtaatccgtagcaactagcacgaacctatgcccctttgatgacgaaggataaatttgaccaatgaaatctaaagcccaacctcggaatggccatggtttgattataggattcaacacggcggcgggcgccaattgaacattgccgaaccgttgacaagtttcacatcctctataatatttgaagcaatcatcaatcatcctcggccaatagaaccccgctctcctaagcaaccaattcatcttgtgggccgattgatgagtcccacaaattccttcatgtacctctcccatagccactttagattgatcttcatctaagcacttcaacaagacaccatctatatttcggcgatataaatcttcatcaagcaatgtgtacttgaatgcttgccgtcgaattttccgatcaaccttaagcgtgggatctttcaaatatcgaatcaaaggaatcctccaatcttcttctgtttcttgggcacaaatgtccgaattcacaattaattcggccttaaaattgattgaaacgtgccctccagcgctctgcctagaaccggtcagaccggccataccaggtgtcacaccctgaagttctcctcctaagcctaaaattgaatttataaaccagcctaagaaaatgccggtgcaaatcaagacaaaaccttaataaactaatgcaaataataatcggaattggcatgtggaatttttcttgagttctacatgtcgaaatacgctaacaagatttttagtggaattttcagagctctcgaaataattttaaccaattaaaattgagcacatgcaattttaatcccaggaaaaatcatttttccttctttttcctttttctttcttttcttttctcttttttcctttgaatgggccgccggcccattccttctttttctccccctcctcccgctgggccggccgaaggccaaggcccagctaggccgcgtgagccggctgcccgcctcctctcacccgggtcgccgacaggtggggcccacctgtcggacccgtctcccacctcgcgccgcgccgccgcgcccgcaaccgccgccgcgcccacgcctccgcctcctccgggccacgtcggccacgcccgcgcatgcgccgcacctcccgcgcctactcccctctctcccgcctgcgcccgcgcccgagatggccgggattcgattttcgaatcccgcctctctctcctctcccactccccgcgttggccggcggaatctcgtccctaccggccacgtccgggactcccctcccctatttaagcttccccgccgccccctctcgctttttccccatctcgccgaactccctcgtgctccccatcgctcccgcgccgtgcaaccacccgccgccgccgcttccgttactccggtcgccgctagccgccgctagggtcgccgccgcaccgcgccgtcgccgccgtcgggttcacgaggccaaactccacctcgtttgccccttccccgtcgggattcgtcgccggaattcgcatcccctcgcgctccggtaagttctacctctaccgccgccttcggccatggatgccggcagccgtggttcatctccctctctctaatttctctctcctccttccttagggcaccccgaagcccgtccgccggttgccgtcgtcctcccgtggctcgccgtcgccgttcgccgtggtcttcctccgcgccggccaccctcggtgaggcgtcttctcccctctactcccctccctttccctcctagtgccgcgccgccgcttcaagtcatgcgccgtcgcctttggccgccgccaccgcctcccgtgccgccggtcgccatcgccgtcggccgcgtgccgtcgccgctaggcctggccggccggccggctttgatgccgagccgagcccggcggctgcctctatcgccaccgcccgatcggctaaggggccgatctgggccgtcggtcccgtggaccggcggtggaccacccgcgtggtcccggtccacggtgcaccggcccccctttgagccgctgaccagtgggaccctcctgtcggcgccaccccccttgatgacgtcagccctgggagttattgtgcaataaattatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttgtagcctgtttgcaatgtttgccttgtatgtcgctagattccggttcttccatcgctccagtgtacttcgaaatagtcgccgaggttcctctagcagcagagcaaggcaagtcatgcttgtcacttgatcatgttgatcctatattgcaaatgttctaatgttttctttcaaatactgcatttgttttgcaatatcactatgggatgtttacctattgttacagccatgctattttggtaccctgctcctttgttagctcgggttatgacatgaatagacgttgccctaggagttggttagccatgcttagttcaactagtacacaatgggggagaatcctattaatgtttagactgttggttctaatggtaatgttggtttagaaccaccgctttggtgttggttaattaaaatgaatcacatggtgggctgtgggtgcatggttttgctgatcgcacccttggcagttaaggaccggttcgcgggatgccctggaagaacttatcgtacttaccacaagccagcctgggcaacggctgggcttgtagtgtagctttcctctagctgacgcatccaggcaagggtgggcgtgatggagcggggcgggccctgcgacggcctctgtcgcttccggattcacctaggcacgagaggggactgcccgctaccttgcgaggactgggggtgaaacctgaggtgtggtgtgcttggttatagggggttatgcgaagggtcctgtcacggcctctttccggtatgtcgtggtggcatgtcggcacacggaaatgtgtcgtggggctatgtcttgtgggtacagttgtacacctctaatcagagtaaaactattcgaatagccatgcccgcggttatgggcggtcaaccagattcaccgtgattagtctcaccctagtttagtctattgaaattggatagtataggtggatggttgggcctgtcgcaacgtggtatagcgttggacagtggatgattaatattgattaattattacgactgttttcttctttaaacttctgtttataaatgctcgctttatgcaaatgaaccactctagctctcctttgataattccctgcatcatacccctattccggtatgacttgctaagtacagtgggtagtactcagtcttgctctatttttcccaaccccagagtacgagtatgtgtcagatggaggtttctccgaggagtaggcttcgtccgtgccgtcgaggatgcctgtggagtggtgttcccgctgcagttctagtcaaggcttagctcctgttgtctttcgtttttccgctgcatttatgtaagacttttatgatgtttgtaagacgtggatctgaatgtcaatattgtcgtttgtgtaccccggccggtcctggacggggattttaatgcacattctgcttggaattctattcgggaatttctgggcgtgacaccaggccggttagaccgctcggggtcgctggtctgaccgacggcatgtggccggtcagaccgcccctggtcaccggtcagaccggccgtgtaatgccggtcagaccgctcctggtcttcagttttgccaatatcgcacaaagatttaaaatcaagcaccgactcttctaatatcagaaataatcatttcttcacattataaccagatgcttgttgtgccaagtcatttgctctagaattatcatgcctagcaatatgtctaatagcaaaattatcaaaattggcaataatatccaaacatgaatcgaggtacctatttagtgatccgtccaagcatttgtaaactccggcgacttgttgcagcaccaattccgaatcaccaaaagcttccacgtacttagctccaaccatctccatgacttgtaagccgaataacaaagcattgtattcggcttgattatttgtacaataatattctaaacgaaccgatgcttcataacacatgccattaggtgaaaacaaaactacccctatgccttgaccttctttgcaagaagaaccatcaaaataaatcctccaaggtataacttcaactaggcaaatctcttcctcataagcaatatctacatgatggtccactataaaatcacatacaatttggcctttcatagatttcaatggttcataagccaaatcatattctatcaaagcatatgcccacttgccaattctcccacttagaattggcctttgcaacatgtgtttaataacatcggcttgacaagcaactatgcatgtactagataacaaataatgcctcaatttggtacaagcatagtataagcataaacaaagcctctctataaagacatacctcgtctccgtatccaaaagacggcggctcaaatatgtaataatatattccttgccatcttcctcttgcgtcaaaacgacaccaatgactttgtcttcggaggcaatatataaccgaaaaggttttccggctttaggcgctcgcacaacgggtggagtagacaaatacctcttcaactcctcaaacacctcttattgttttgctccccaagtaaaatcggcttcttttttatgcgaagtataggaacaaaagcatcgattttacccgctaggttagaaataaaccttttcaaataattcaccttacctagcaacttttggacctccttcttgcatgtcggcgctttgaaattacgaattttttctatcttcttaggatcaatctaaacccctctctcatgcaccatgaatcctaagaatttccccgccgacacaccaaaagcacacttaagtgggttcatcttcaaaccataccggcgcatcctttcaaaagctaacctcaaatcggctatgcgtcctttccatactatctgatttgacaataatatcatcaatgtagatctctaagataatacctagcaaatcatgaaagatcaaattcattgccctttgatatgtagcaccggcattcttcagcccaaaagtcatgacaacccactcaaacaaaccaacaaatcccgggcacctaaaagccgttttgtacatatcttcctccgccataaagatttgattgtagccggcattaccatctaaaaagctaatcaccttatgacccgaagcatcattgatcatcatgtcggctataggcataggatattcatctttgggagtggctttatttaaatctctaaaatctatgcaaactctaatcttaccacttccctttttctccaccgggactatgctaaaacccactccgcataacgacatggcctaataaaccccgccttcaacaaccgatcaatctcctctttgactcggtcatatagcaaaggattaaaacgacgaggtgattgcttataaggcctaaaacctggtttaattggaagccgatgctcaagaagctcacggctaagacccggcatctcatgatactcccatgcaaagcaatcaacatactctttaagtagctcgattatcttaaccttataatcgactctcatatttttgtttacaaaagtcggccttggtttggttccatcacctatgtctactgcctccaacggatcggccgatgtaaacccttgtccaagcttctccacttcatcaaaatcttcaatagtttcaccaatatcgttctttgtagaccgatatttttgcaccctcttttgtaaccactctaaattagcctctttactcattatacaaatttatatggcttagccgtgctacactagccagctttacagagataggtacaaattttccatcggagatactaataaaatcatagctagaaagattcctccccgataagcattgaatattcccatgacgccactcaaaagtagcatcggccattgcaacctcggctgatgtatccgcttgaacaatttcaacatcatcgccgtcccattgaattaaacattgatgcaaggtagaaggcacacaacaattggcatggatccaacaacgacccaaaataacattgtagttaccttgcacatcgacgatgaagaaagcggttggtaacgtcttgttccccacggtaagctccgctgaaaagatacccttcgcctccgttggttcaccattgaagccattgagaatcatgttagtcttcttcaactcatcatctccatgcctcaacttcttgaacaatgagtatggcatcaaattcacag

SEQ ID NO: 12486 - DNA, 9402 bp, Oryza sativa
gcagcccatctttagggcctagtgaaaattgagcaacctcggcttcatccatagcacaaaactccataggcaacatacataccatgttgatatccatgtcttcttttggagatgactcatctttagcaaccgattgttcttccctctcctctacaacaaccggttcttccttctctatggttttacgcctccataccggtggtggtcgcaactcattgaaccttttatccctttactctttggcctttttctctcttatttcttgggcccgaagacgttgcaaccttctcctttgagtagccgtcaaatccttaggtatccacctaggtttcggctctgttccaggaggtaaataatgccccctattaggtttagttgatgacgatgaagccctcacatcgccctttgcaaacctcctatcaaaccggtgctggagcccggtcagaccagacgtagactaccgatcagaccagccagatgcgcaggtcagaccgacattcggtgggcggtcagaccggcctgaggcgtcggtcggaccattgtcagttcggcggtcaaaccagcctgatggcccagtcagaccgaccgtatggctgcggtcagaccggccgtatggctgcggtcaaccggccagaagacctggtcagactggccaactgcgatgagctggtaccagcttcggattttttgcttgaggactctccaacttcatctccagaaggtattggcacatcatgagaccctactttgatggtaatcacttccgaagtccttgcctccaccttaatgcgctttccttccctcctttcttcattggcccggttcctaccataaaactggccattgtttggtgaagaaaaacgctcatgaattggccttcttggtcctccccacccttggttgaattgcattggaggcatatggttgaacattggcgatgttgccccccatggcatataataaggataagtataactcggcggcggcattgaataagaaccccatgacatgtcttgtggatgatgatatggaggtgaatgcgaccgtcttagcgagtgaacaaatcgctcccaaagaggtgatcttggtcttttccccttgttgtgagctctctcaccaccctgcttttcatatttctccaaaagcatatcaagggtcactttagtcttcctaggagctttagaagttgaagcttcacttttattctctttccaaacaccaacctccggcttctttggtactatcatctttggccttggttcaccaatgattactccttttcctttagtagattcggcttgctccggccaaatcaacaccttcttgtcattgaaattaattgtattcaccggaaaaggatcatgatcaagcttcatcttggagccatcggtgaacttcaatcgtccttcatctatggccgattgaacctgtcgttgaaacacattgcaattattagtggaatgagaatgagaatcatgccatttacaataagctcgacgtttcaattcttcttgagatggtacgatatggcctttaggtaatctaattttttttcttgtaaaagataatcaaatatcttatcacacttggccacatcaaaactatatttaacctcactttgccgatctttgcgaggagtcggcattaagttagaacaaacaaaaggcttttttttgttagtccatgaccattcagcagcatacatatcatgatcaccctcatcttcactatcactagcctcagggtaatcaatcacattaacattaggctttttctcatatggtctaacaatttttttattatccttaacccggctttcttgagccagagccctttgcataagttgactaacatcaagaaattgttggccatctagtctttctctaagaggagcaattaaaccattaaaagcaagaccaaccaaatctctatcagttatatttaagctataacatcggtttccaacatccctaaatctcttaatataatcaacgacaggctcattatatttttgcttaaccgatgttaaatcacataacctaagatcggtttctccagtataaaaataatcatgaaatctctcctctaattgagcccaagtatgaatagaatttgccagtaaagaagtaaaccatgtaaaagcggtaccggacaaagataaagaaaacaagcgcaatttaaaagtatcactattagcctcaccacattgcgctaaaaattgacctacatgctcccatgtggtcctaccatcttcaccactaaacttggtaaattcgggaactctataattactgccatagcctgaatttccgtttcaggatttataaattatttaataaattattaatagaatttatattaaaagttcattaatttacaagtgaagttaaatgtgggaaataaaatttcctaaatataaagcatggttggatttaatttttattaaattctccatgattaactatactctttggaattttctcggatttttcagagctcaattcttaattttaataatacaaagaacagtttagcaattatttaaataataaattaatcattaaatgatctggatattattatattaaatactttgagtgtccaagtatgttcaagatttttcttggaattatttgagcattggaagtatttttaataattgaaagatcatctcattggttaatttatttggaaaagtaataaaagtcctcctcatcagttgggccgaattcagcccattccctcccttcctctcagcccgcaaaaaagtctgtttgaccttcctggcgctacagtactccatcttcctcctccagccgactgtctcccgtgccgtgcacagtgtcgccgatccccttccgaaatccggccacctcgttgctcctttttccaaattagttgcgggaatggaatcctctcaatctcctcttccttttccccaagaaatccccaaaagtttctatggaaatcctttccaatttcgtggttcaatctttcctttttccggcgaaatcctaaactttcccgagtttttcccgtcgtcgtgggctcgatccctgggctcccatggctatatatagagccccctccttctcctctttcggccgccacctctccctctctccgccgttgccggaagcactctccccgcgagctccctctctctccacctccggccgccgctccagccgccgtgcgccgtcgccccggccgtcgtcggtcagcgccgccacttccctcggctccgcaaagtcgagctctaccctggcctttggttccttcgtgccaaatccagccggaagccgcttgccgacgcgaaccagaaggtttcggcctttgcggcgcctccagccgcagctagcagccgccttagccgccgctttccgtcgccatcgactccattgggttcgcaggagcaagatgaagcccggcagccggttccccgaagccgaaatccaccggagctccatcgtcgccgtcaagccgaagttcgccatcgcgttttgatctccggtgaggccttgctgctcctcccgtcatcgccaagcttcgccgcagcctccctcggcatcgcagctgcgaagtgaaccccgtccacccctctgttgccgtcgttcgtcgccggaaaatcgtcgccgccgtggacagtaccttgccgcccttcgaagctcgtcaccggccatcttccgtcgccgtctgtcgtcgcgtaagtgttggtaagaatcgccgtcgccttctctacctcccggtgcccccgtttgcattattgtgccatggttcaccggcaaccgccgctcccatgccgttcaccggtgtagattttttcctagggtcttaatccaatctaatctaatccgttgtttgtctagcgtcgtcgtcgtctccgtgtgttgccgccggatcgtaaacgtcgaccctccctctccgatcgctttggttcggtgagacttctatccgtgtcccctcgggttaggtttcaatccctcggtcgtgtcgtcgccgttgttgctctaaccttagcgcagccgctgccgtgtcgcttgctggctgccctgtgcaccgccactaccgccggctccttgttgccgccgcgtcgctgtttagccgctgtacgtcgccgtcgcgctgctgctgcatgtgtgccaccgcaaccgcggttgtgccgttgccgtgcgcaacgcctatcgtatcgctgtgccgctagctgctgccttagcgtcaccgctgcactagctgcctagccgccgccatgccgctccctgccacagccgtgctgctgctgctgtgcattgccgcttctgctgtgcattgccgcttgccgctagctgtcgttgggccgctacttgtgcatgccaagtggccgccgtcccgctaccgcagctaccgagccacttgctgtcgtgccgtgccgtcgctgttgtgtcgtgtcgcagctgtgtgccgtttaaacctagccaccgctttagctcgttgctcggtagtcgagttgtctagccgtaggtacatccctaggttcctaccggcctatcgtttgccgtaccggggctttaccgtgaatcgtttctagtccaccggtttagccacagccgttgttgagttgttcgctcgttcgttcgaacgaggtgttccccgtgtttcgttcattcatccgtgtggagtcgtcctttagtttagagccgtcagagctgccggctccgttcgccggtttcggctaatcatttaggcgatcccgtgtcatgtagaattgactcgttgagtcggtatctcgtgaggctcgcttgccagatcaatccaagccatctgatcttggtcaactctcggtcaagattaatctcagtcgtccaaaatcgatataaatcctctcctcttttcaatggcatattattcctttttaatatatgtcatctaccaaatatgatctaatcttttctggaggttgctttaatcttttgtctcagttataaatcatttgtaaatggtttaattaatttggaatagtcttttctttaataggtttaattggaattaaatcttgtaaaatttgtaattaattcatatgaaatcggaatgagaccgttcaagtctctaaatttatgtaaaatcatgatctacatgtttgtttacttttatgtactgtttatttggtttttattagtctttctcctcgtttttgcgtgttagcttgtcgtttccgtcgtttcgaaggttcgaaagtgcgtcggaagtgttccagaagacttattgaagaccgaatattgcaaggcaagtcacacagatcccaaacacaattcctttgagcatgttaatcctatatttaaattctctatttatttcaactgtgcatttatgttcgaatgtcaccgggtggtgagcctttcccatttaattatggccgaagatgactttatttttttatgggttataatttgattagctagaaccttatatattagtttggttcagctagatacttataatagatgcttagccatgcttagaaacaatagctcactaatgggataaatcatgcttcactatcacttatggatatttaatggaagctcacgatggtcaatcgtgattggttaattaattaatgtgccaactaaaacttgataatggtgggttgtgaacacatagttttgatggtcgtgcgcatgacaattaaggaccggttcacgagtttcggttgtgaaacattaaccgtgccaaccacaagccagcatgggcaacggctttaccttttgtatagcatggttcattgcggagcactagactaagaagtggcggagataagctcacgggggtcgctggggagtccatgccttgttttataagggggtgattatgatccaggaacggtacactgctttgagttgtgttgtgcgaggggtactgtcacagctcctttctgaggtactgtggtagtatcgaggcacatggtgacatgttgtggggctgtgttttgtgggtacagtggtacacctctggctagagtaaaactattcgaatagccgtgcccgcggttatgggcgggtcgaacaatgtcttttgtgattagtctcacacttcacaccataataaatgatgctataactggtaataatttgattagctcctggtttggaatggtacattcctggtttggagataggtctgtgcagcatgggtgtgctattcagcgttgattaatattaatgattaattactctactgttttacaattcctaaatgtttgctaaatgctgctttcgcaaatgaaccctatattatgccattctttggtattcctgtgcacttgcatatttgctgtgtggcttactgagtatgtcatatactcaccttgcaataatcaatcaaacctcagttgaagacaagttgcgaaggagaagacgtttggcttataccccagttgagctgcctgtgggagtggagtcggagcttcgctagaccgtaattccgctgctgtttttcttttcttttgtaagtatgtaacgttattattatgatggatttgtatattaaattgtcagtttgtgtacctcggctgattcctggacaaggattttatgcacaaataagttcagaaattactagtgaatttccgggcgtgacaattacggggaaacgacacattatcataatagtcaggatacggctttttgtaaaccctaccacgattcctagtttcaatctctaatttatccctaatagtcttatttcctccatattatcaggcctatgttgatttagcggtggatttggtggcctaataggttgtgtttgtggcgcaatatgattatattggccttgtctagtatcgggaggataccccctagcaacatcattataagcattaggaacatgtgggggaacttggggattatttacagcagtagatacaggaggatcaaatgttttaggatgatacaaataactagcattagtcattggatctatcccctatatcggtataattgcgccggtctgaccggtccagggcccggtctaaccgacatccagaggcgcggttagaccggcttgagtcccggtctgaccaccgggataatacccggtcggactggccgtttggccggttggaccgacggcgaagttgcggtctgaccggccgtcaagcccggtcggaccggccgtcaagcccggtcggaccggccgtcaagcccggtcggaccggccgtatgcgccgctccattggttccgctactcgtttgatctataggagcttggttagcagtggtagaggctttatcttttgacatgtaatcggccataagagggccgaatttaaaccttaaaaactcatcaaatttaccctcaaaagttgcatctaacttatctttaaaaacagtcatagatgaatctattgtagatgctacttgttgttggatagattgtgttacctcttcattgcttaccaaatcagaagcgagcttagtacgtggcctgggcttgatgatcacgccttgatgagtcctagtgcatgctctcatcagcgcctcctgtgtgatctccttgatgtactcctccatggacttgcggtcttctcctttgaaatcatccaatgtgataggtatcacattagatggctctacctccgtcttggatggcggcttcgtcatggcgaagtcgaagttgagttgacgctgaacggatttccccagctgagtcgccaaaatcatgttggcaactttttgtgacaagttgacaacaacgattgcagcaccttctgtcttgcagtgatcttagagtcgccaaccatctcgatctagcaaagagctaaacctagatgggttttgacaaataaaccggctagcggagccgatttaagataactacccgtctcatgggcaaaacggaaggttttcaggacaaacctacaaagagatgtcacactctcgcagcggcggcagacggtttacgacgcaaaccgacaaagatggacaaactaagagaaaactaaaagcaatatgaaaaaacgattcaattgattgattgtagattggatttttacgatgaaccggccatgtcccttatataggggttggtcttgccctctacaggccctcctccacgtccaactcggggtagaaactaaaggaaacccgaaacatgccttcccgagcaaggaaacctcgaaacccaatgaaacacagtcggactcggacctgccagtcagaccggccacacacaccgccggtctgatcggcactcaatcggtgatctgaccgcccaacacacgacggtctgaccggcccactcaaaggaaaccggtagacttccaaattttggcaacctttcctattttaatcctaggttgtcacgcccagaaatttagcccaaatttccagactattttgtgtattaaatccgtgtccaggaccagccagggtacacaaaacgacaagtaatatacagttccaaacgtaaataaagcgtaaaatacttacagaagaggcacttagtcctcacaccgaaacgaaagcagcagcagcggaaacaggcgatcctacgaggcttcagctccactccacaggcaaaactcacctggggtctgagccttggtcttctaacttcgccttcagctcagaagcactacacttctgaaaaggggaaataatagcaaggctgagtacaaccaccgtactcagcaacacacaccaacgatgctaacgtgcaaggggaacacaaggacggtttgtggctatttgcattaaggcggttgtaaaacattttattgagcaaacagtaaaacagttgagtaattaaagtaacattaaatctccactgatcaacgctacaccacgttgaacaggcccaaccaacccacctaaactacaatgcattgggtcgatttattaaggtgggactaatcacggtgaatctggtcgaccgcccataaccgcgggcacggctattcgaatagttttactctggccagaggtgtacaactgtacccacaagacatagccccacgacatgtttccgtgcgccgaaatgccaccacgacataccggaaagaggccgtgacaggacccttcgcataaccccctctaaccaagcacaccacaccttaggtttcaccctcaatcctcgcaaggcagcgggcagtcccctctcgtgcctaggtgaatccgaaagccgcataggccatcgcagggcccatccaaactccatcacgcccacccttgtctagatgcgtcagctagaggaaagctacactacaagcccagccgttgcccacgctggcttgtggaaagtacgaggaattcttccagggtttcccgcgaaccggtccttaactgccatgggtgcgactagcaaaaccatgcacccacagtccaccattcagtcgcattttagttggataattacgaccattaa

SEQ ID NO: 12487 - DNA, 919 bp, Oryza sativa
atttgcaaacggtaaacagttataaattaggatcaacatgctcaaggggaatgtgtgacttgccttgcttcttcaaacaatcttccgaactcttatccttgcgaacgcgaacttccgaaacgacggattctacatgctagcatgcaaaacgaggaaaaactctaataaaaacaagggaaacaatacataaaaagtaaacaaacatgtagagctcaattttagatgaattttgcaagttgaatggctcaattctgagttcgaatgaattagatatgaattttagaagttttgagccatttaaatgaatttctagaattattaacgaattattgcgcaattaaactcgatttatgatgtcaccgagagggaaggggtggcgccgacaaacgggacccacccgtcggtgactcaagggctttggcctaccgtggaccaagtccacggagacacgggctagcgcaccacgtggcgccgacggagcaccgacgtggcggccacgtgtgcggacacacgggcggcccgggtggagactgaggccgatccgacggcccagatcgactgcggctgggaccaaagggaggcggcagccggcagtggtgcgggcgcggagcgcagcggcgacgaaccggccggacggccaccggcagcggcagcgcacggccatcggccactgacggcgagcggcggcgcggtgagcggcggcacggcaagcggcggaagggagcagggaggagaggagggatgctcaccaaggcggcgacggcgagacgacaacggggaagccagcgggacgggctcctcggggaggcaacggtgacggcggtccggcgacgggctcctcggggaggcaacggtgacggcggtccggcggcgttccgcgagcaggaaccggcggacggcggctgcgagaacaggggaa

SEQ ID NO: 12488 - DNA, 1411 bp, Oryza sativa
cagagcatcctctacaaagatatgtggacgactcaggtcatcatcatctaaccccaaagctgcagcaaactgtgccatagaaaccctatactgctgcccctgaatggtccacttcacaaaatcaagccccttcttggtgatgccaaagaaagcagtaaagtagaactgtccaatcacttcctcattccaggaatactgcaaggccaacaaatctaccacgtgcttgcgctcacacaccttgcgtacctcattgaagactatattgttctttgaggacatgtactgccagtctagccacttcatctctaccactagatgagatcttcccatgatcatagagttataccaatcaacctgcaccaaggtcctgaatctgtcatcctgagagtcagctggcagagtatcaggactaaccattctgtcctttccacactggagtagattcttcagatagttcactcttgtgcgtttaggatctggatcaacagcccttgtcttgtacagcctcaaaggattgcttttagaaccaggctcatcctcattgccaccatcatctgactcagatgcagctggagagggagagcggggtgcatcacgaatgacaatgctaccagccctcctggaatggatcggaatctgactcccactgtaaaaaactccaactttttctttgcccaatctccccctaggaccacgaaccggggggctcgagtcagcaggaacatcttgagaaagcttctgtctcttctcacgaggcataatgaccactgcaacaagaatcaacaaggttggagtgcaatggttaaatgaaacagtagcagaatcaaggttattggctggctggacagagaccggaagttccaggccaagaacaccggaacttccggcctgcaaaactgaagaacagaggatttaaccaggccagtgcatgtgacaaaatcctatagatcggcaatctacaaggtagcaggaacaattctatccaaaaggttttctccctaggttcacatatttagagatcggggcaaaaacatgatgaaccaaaggagaagatcaaaagtgctaccttgagagggaaaatcgcaaatcgatcgcgggatgaacctcctagccaccaatgtggttgattctacggagaggaatcaaatttccacggttggaatagaaaatcgccgagaggagcactgtagcggcggctagggtttgggaatcggggaggagaagaagtgacgagagagaaaagaagcttgggctccccctgggtagttatacccccgacccccggaagttccggactgggatgaccagaacatccggcctgacagaacagaggacagtcaggcccaagttcaaaggaatagatgagaattaaatgatttagaaatgaaaacctatggacgggctgcaggaa

SEQ ID NO: 12489 - DNA, 581 bp, Oryza sativa
tgaggatgctacgcttgaggaagtggaggaagcagaggcagctgcgtggtgtgcagccaatgaccatcccaacagacccgcccttgaatcataagacgtatgaagataagatgatgctgtttgacatacatcaagaggtatatctcttctctgcgaagtctgatacaaagccattcggtgaatttaagcctcttcttagcgcaagtttaataatatagtcaaccactaacgtcaaatcacttgtaatcaatttaagttttaatagcatagccgactactagctttaaatcatctatattcaatctaatagccaatcttggaatctgcgttaccattgactatatggatctatagcccacttcttctctctctaggcactagccggacggttacccccggtctagagtctagccagtctatacgatacgccatacttatactaccggcatattttttttacatatatgtaaatacacttagcaagtcaaaagttctagagaatatttgagagcaacaaaagatggtatttaatgtttaccttattttgcaagaatgaatcttcaattagcttcaaattcaaa

SEQ ID NO: 12490 - DNA, 899 bp, Oryza sativa
aggcggctatagcgtcgcgatgccgaagtgggaggagatggaggctagcttgcttgagaggggtatcgaaccggcccccgctaattggccggaacgatcgaagttctggtactgtgctcacggtggaacgctccacccagctgatggctcactggtcttcggcgatcagatacgagaggctgcgcgttgactaacagacgcagtggaagcctcttctcagggcacgttccgaccggatagagagagggacgagctgtcactcgccctgcagactccagagcatccaggacgaacacgagggaaaggggtgattccttggaagattgggttcaaggaggacatccacacgtacaggagtcggatgaggagcaagagagataccgaggcgaagattgcagatcttgagttcagggtatcgagctacgagctcagcatgcaagaggaggtagcaaggaaggttgatgaacgcatggccgcacatcggtccaatgatccccagccgaccattcctcctgcaatggtgagcccgttaggaaaccgtagcagctgcgcctcaacggggcaggtaggatcacagagcatggacgccatgcaaacccagagcatggacgccatgcaaacccaggacgaatccacctgccccgttgatgacatcactcagcggacaccatgtgagctgcatattcctttcaagaacttatcaataaaggtaagctcgtagtttatatattttagatttgcccattccactagttgctgcttatatatgttgattagtaataaataacctctcaccacatgaaggtggcgtcgggcatggccatccaacggacccttcaggtacttaccactgcaggccgattccagcaggatactccaaggtcgaagttgggctgcag

SEQ ID NO: 12491 - DNA, 1705 bp, Oryza sativa
aacgcagcatcccttttctgctgcagtctttcaagagaagtcagttcctttgccacgacagcagcctcttgttgctcaagcatctgctccgatttcgtgactgtctccttgaactccttttcctgctctttcagctcatcaaactttttcttaagcgactgctcaaggccatggaaatggtcctcaagttgcttccactttaagttcaatgaaacagcactctggctctcaagctcggcaaatgcacgctgaagcagctgcagcttggagcctgtagactccataagggctgtcatggactccatgtcggacatggcggcagctcctgcaaatgagtaaacaacggaagctgttggttcgcgcaacccaaatagcactgcaaacaaatccccgcacagtacagcaaaaacttcatcgaaactacgcaatatctcactaaaatggttcggttaatttcttcctgcgcatggatgaaggaacattgaagggaattttatacgctattgcacacaaatcggagaacatagcaacatcatctacccatggacggatctaacgtgggacatggtatactgtgatgtaaatttttttgggggaacaaacaaactgttatttgtaaggtgatcaaaattgagagaaaagaagcttccagatctggaagagaagctagaattaacgcagggaaattcaaggaaaaaagtgggtgggtagagatgaacgagaaagaggatggatactcaccaggatgcggcggaagcagcaggacaaccgacggggatggagatcggcgcagggcagcggcggccgaactcgcgacacgggactccacctccacgcccagccgacgggatgggatggggacaccctcaggcgaggacacaatgattttggccagcagatatttcctcttttcttttttttttcactactgttcaatcgcctaatccctactacgtctctgtttctttccttatccctaagttataaaaaaataaaaacatttccgtccgaaatttccatacattttccgtatttgatttgattattggtcgacatttctgattcgaggtgagtctagaataaatattataccagcccaacctaaccagtccacaccatctcgtcacctcatcctcatcctcacccccacttggcgccgcactagcccctccctcgatcggcatctttttctctttccatttttcttttttctcccaatcatcctaattctcttccgatcctttcaatctcgtctattttctcatttttcttttctcttccgaatttctcttctcataaatatttttcttttgaaattataattgtttaaggtgtgtatgcggcaagtttattactttgcaaatactttccatttacagtaaaataatttcactaattgaataatcaaaattacaatcttcggtcaatgaggtatagcaaaatacacgtgtcaaataatagaatagccacccgatcaatttgtgaggctatgggaaagtgtacatgaaggatccttcatatgatgatgcatgaagctagtgtgctcaatacttatatatgatttctgactttgttttgccatggttttgtttgtcttgtttcggtttgtcgtttaaattggtagagtttttatcaatcgtgaaattgtctttacctgttgtaacgcacatgcatctttgttgctccctccgtataagatgttttc

SEQ ID NO: 12492 - DNA, 7234 bp, Oryza sativa
catgctcccactacttcagctactcctaccaccagagtgactcgtgcttccacctcagctgctccttcttcctctgctgcacctcagcgttctgagtcttcttctcccataaagaaggctcttagggctatcttttgcatgtgtgccaagacagctaagaaggtaaagaagatagagaggcgtcaaaaggaagattggattgcagcaggcaaggatgtctctgacatttctgatgatgaggagtttgttgatccttttgctgcttatgagactgctcgagacattgctagtggtgagggtccctctggcacttctcgtttcttcaatgaggagtcctctcactccgaggagagcagtgatgatgaggagtcaaatgcccctaccgagaatgttcttacagatcccgatgaggcagtggacgccgccgggcaagacatcgactctcctcactccggcgacaccgagatcattccttctgatggcgatgatgatgaggcttgatcctcttcttcccttgtgattttgtctctttttggtgccttgatgccaaagggggagaaaattgcaaacgaaggggggtcaaaattttgtttttgatgcttactgcctgctatctgtataatccggaagttccggatcctcttatctggaagttccggacctgacagctccctctccttattgtcatgtcagcttatccggaagttcctggtattttatccggaagttccggacctggcaatcctttgacccctattcttaagaactcatggacatgttctaattctctatttgtgtgaatgtaatgtctattagatgctcttagccgccctttatttatactgctcttcatttatgctatgagtgtcttatttgttgtttgtgttatgatgttgattttatcctcttgagtgctcaccatgtcgtatcttttgcatataatatctattcttactgctttttgcatcccatgaatgagtagggatgaaggaaactctcctcggttgctcccttatatatatgcatatgagcttctctcatatcttccatatgcatacattaagggggagtttcatttacctttaaccattcaaaacaaaatttaattcaatcttttgtaagctttaaccatgttgtcatcaatcaccaaaacgggggagattgaaagtgcattaatccccctagtgggttttggtgattaatgacaaatgtggttaagggactaatgagttcattgagtgactttcaggtgcattagtccaaggtgtggaagatggatgcttggagacccccaaaaaagtacaaaatcaaagcggaccggaactcgagaagggcataggatagtttatcttttgaaatcgagtttttaggaaaaaccgtactattaagaggggttccaggtgatgctctgagatatatcaagtgctcttagtgtgaaccaagtgtcaagtttccctaggagtcatttttgcaaatactccatctgtccaaaaatgcaagtccggaacttcctgtcttccaggtccggaagttccggtcttgtgaaaaagattttcctaagtgtagtccggaagttccggtcttctaggtgacgtaacggctagatgacgtcacctagccgtcatacatatacagcttgattccagctcgttccttagccattccactttcatttttcaaacctagagcaattgctagcctctcccaagtgtttcttgtcttctccactcaatctagagcctaattcttgtgagaaagagagattgagagggagagaagaagatttggagatgtgtgaagactaggatcttgggtgagcacttggaatatctcgtgggctgtcatctcggtgcttattactcttcgagatgatctcctagatggttaggtgtcgcccgcgagaatccgttgcatattgtggatgtcccgggtaagtttgtgaaggatttcctctcctccgaaagggaacgaggtaagttggtgaagttcttgtgctgagattctagaggctttccaagtagagcaacccacacttgtggtggatttctagaagtaggttgagttggatcttggtggtcactcaattctagaaatttgcctaggggtgtttggggttgaaggctgtggatttcctcaggggtttttgcacaagtgaggcaaggggttaattgagacccagctctttggagctcctcaacggagagtaggatcgcaagattcgaacttcgggaaaaaatcgctcttgtctctttctgtgatgtttctgtgaatgattctgtgatatatcctctgcttagaatacctgtgcaccatcttgtgaagattggcttagtctcctgtttcaaaatttgaatttcatctctgttttgttacccggaagttcctgtcttagaacaccggaagttccgggcctagcaggccggaagttccggagttccttaccaggaagttccgggtctgtttgaattttaccgctgcgatttgtttttaagatttcagggacagcctattcacccccctctagacttcatcagcgcgttcagcaggtgaagggacgcgacggcgaagcagcgctccagcgagcaggccacctcgacaccaccgccgccgactccccacggcgcagcctcgccccgtcggccggcggcgccgacctgccaaagccgcaaagagaagattgagagagagagagagaggaggaagggagagaagaagggaaagggagaggagggtgaggtgtacacgctgacatgtgggcccacgtgggtcccacgctgacttagccgccaatggccgtggtcaaagtgccacgtaggacaaaaccgggatcaaaaccgccgagggacctcgggtgatcggttttgcatagttaatggacctcatatatctggttttgtggtttgaggacgtttttgtaactcgatgacaaattgagggaccttcggtgtactttttccatattttgggctagcgagatcgcttatggctccttttgtagcccaatccccgggaggaaggccagcgggagaaaattcaacgggccaaatcttcttgtccatttggaagcctacaaggtgggaattttatggcccaatccgcacagaatcgtgaggtcaagaaaatttcctctagctcgatacattgcgccaccgcttctccatctcgcgattgcgagcagacgatgccaccgagcctcctccagcgagatgctctcaccggtcctccttattcggtctacccctaccgctctatccctctctccttagatcttgggtatgcccttcttctttcccctcttctcctagagtttccgggtttcctatttgacaaagttggtgatgagccgctctgtcctaaagtgaacaagagttatgttatggttggcatgtctctatcttaagaggatttttccattggaatgggttagtttatctcttagatttagggtattttatataaatagatggccatattgaaagggtcttgagaatcgttaattttgcctagaggaggggtgaacgggtgctttgtgatatttcaaaacttgcagcgagattagaactaactagacaaaccgacacaacttccggtagtccaactatagatgagttggatagttcgactgctgtaggacaatccgattagtgcaacgataggaaaaatgataagtgacccgattgtccaattgctccaggacaatctggttaacacaaggatagaaacttaagtgatatagtaagaaacaaactagaaggtccacttaagcatgctttctacaagggcaagtgttgacggtcattatcgatcagttgcgaccgtcaatattaccaaaatagaggagaactagttatgcttgcaatacatatacaagttagaataataatattccactagtattgggtgtactaaccttttgcagagaataaccataaagtggaggagaatcgacatcagcacatacgataaatcaatcggacgatgtcgagaatcaaacttatgcatgaatgggccaagaactcagaattgacataatgaattgggccaaaattcacaagtctaagaagtgaagtaatggaggaggccacctaccgaattcggccgaaccccctagcaccgttggatgcagggtttcttctggatggcgtggatcactccccaatgacggttggagagcaattctgaccattccaactgccaccgaccatccccaaggagttcactctcttcacttcaacacacacctcaagcaagagctctctcatattctctcaagttagtttagtattcttaagctagtggaataggaatatagtagaaattaggtatggctctagtggctttcctttcctctttggtaagctttgtactttatttagaatacttttctatatacatttatggtattgaaatactttccgagtatatgaataccttctttacattatgttcatgttatactgaatatactgctagcttatctgggagatactttggtgcgggtataatgtttgcttatgcaattacactatgtcatgacgatgatattagagtagtatctggtagtttagacgaggtgtctagattacgggatatcattatttggggttatatgctgcggatgagaggtgggctgctgatggtgacagctcagtacaagtattcctccacgcatgtatatagtcctaagttaatttcatgggtagggtactcctccgtatttagccccggttgtatggccatgacgagctgtcgtaaggaactcaacagtcaggggtggcttctcgaagtacgaggagggcatcggatagagggtattagctagcatatcagatgactcgaatgtatgtatattatgtatactagaagtataggaatatattatctttctcttttctttccacttagcttagataatttagtatgagaatgaggagcttaatgcttgtgtgtcactctacccttgaattattttaacccctgtttagactatgattattacaagtaatatataaattattagtcaagttctctctaccatgatcttcctacgggataaaataaatacgatacccttggaatactctcgggtgaaatggtacaatggtatatccgtgcgcttgcggatgaactctgtaaccataatataccaggagtatttatgcgccattgctgggaattatatttctagtaatgtcgttaagaaataccaacagcaagctaatgataaatagaactaaacaagcaagtaaaggtcactaatagaacaatatagaaagtggtaaatacaaggtaaaagagaggaaaggatacactgatttatttactgatgtttggatccaacctatcctactctccgttgaggggttccgaaaagtcgggtctcgattaacccttttcctctccaagcaacctccgatggtgtcttggtttcttcaagcaaccgccaaggaaaagttcgtgcttcaagagacccactcggtctcaagctcggatagcatgcaactaccctccggtgaagctcgctctggcaagcaactacctagatgaagctcggcttccactcagtgacttcttccctttcaaaggcgaaatagagccttcacaagggttcctaagcaaaccacacgcgttggcggctctgagattacaaatcttttcttccacacactctcaactcaacccactattagctcacaaactcaagatcatagaaatggagagagttgggagagaatttagcgaacactctaagacaaatgatcttcaataagcacacaattctcttgaacacttcgatggattcatcatgtgaaatggggtttaatgtcttgaattgagtccatagcaccccaatttatagccctaactcctccaactagttgtttcttcccggtgaaaaagtctgctagaatttgtatagggccggattatctagtcctttatgcttttccaacagtcactgaaccacttgttgccccataaaggaacaaactatccgatagctatagaactatttagcagtgcctcctagatagtccggtaccaataggattgtccggtccttttcttctccaattgtccatctaagcattggtagcctccaaagggtgtcggacagtacggtaccgtgtcagatttgatcttttatcttccaaactttggctaatcatttccacttcaactcttttgcttttagggctgtctttactcactttagggcctaatgcctgatcattactcaataaatgaattagtcattgcttgtcatcaattagccaaaatgcactttcaatctccctctttttggtaattaatgacaacctgattaaagttcaacaaagattgaataatatttggttttgaatgcaaatggctagtttgagctccccataaatgtatgtatacaaatatgtgaagtgaaactcatatacacatatttttgagaatgctagagctccccgatgtcttttgcatttgtggggtgcaacgtgtgttaagataccaattgaaaccaactttaaaatttgaaataaatgacatcaattgaaatcttgagatcaatacttgaattttttttctcctctctccatatgcacatttaatcttttttaaccctcttcctttgatattcctctccccctttagcatcaaagcaccaaaaagagcataataagggatatgtgagccatgagtatcattgaatgatatataaaagaatgagtagattgcatttgtgatacataaacttgttaggtgggtttaatttagtacataaacttataaattgctcattttggtgcacaaacttgtctaattcgtgcaaaccaggaccacaatggcttgaaaaggttaattctagcaagctaatgttgattagaatgtgacgtccatacgtatagtgagtacgcataagatgtgctatatttataaatgaggaatttcatatatttcttaccctttctaacccttgtatcattgctcgggttttcatatatgtcggctatcactatttctcattttatcttttcattgaacaggtgtatgtccaaatataaatcttctcaggtatgtgtttatcctaactaatacctaaatcaacaggattagccatatagtgtacttttggccttggtccaaacgcactggacaagttcatgcaccaaaacaaacattttacaacttcgtgcactagattacacccacaagttcatgtactgctgatacaatttactct

SEQ ID NO: 12493 - DNA, 2081 bp, Oryza sativa
aaagtttctctcccctttgaacttggatttctcttccattgtaggaccattgaaattttagtaagtgaaagcacaaggaagataggaaagaagatttgaaaaacaaacttttaataccatttatgcaaaaaagaaagattgttttaaacttagagggagtctatgaattcaaaattgtgccaaggccaagattcatttagaatgagatctctagatattagatttcaaatttatatgcattatcttgcgagaaggctaacgggcgatcgatcgctgccagtgattgattttttttcttttcctcttttagtaagtttatacaactaaagtttacacatctaaagtttatccacctaatgtttgtaaggcgaatgtttataagtcaaaagtttatatacccgattcaaattcaaattcaaattcaaattcaaatatttttatattttcatcttttagtaagtttatacacctaaagtttacatatctaaagtttatccacctaaagtttgtagagcaaatgtttataagtcaaaagtttatatacccgattcaaattcaaattcggattcaaatattttatatataaaatatttctatacataaagtttatgcgtgcaaagtttaccgtataaagtctatgcacatgaatgagagtattagagtattagagctaatcacgatggcgactctcttctctggcgacgtccatggcgactctctctagaagatggtcacgccggcgccgcctactggatgggatttctccccgggggattccatccgcgatgaagtttggagccgttttggttcaccggtgcacttttcctctcactttagtcgttctccttttcgattagtggttgatgttcctcgttcttcgtttcgattgaccttgtcctcggtggcgcttgctcttagagcggcgattggtggttctccgtctgatcttcaagttgatcctttgattgattgaagttttacttttgtggtgtgttctaagaaagttggactctggatctactctctcagatccttttcttgtaaggatttctcggttcggttttttctctggaagaatggaggtcctgattggagacaagaatgggatctctggcaagctgagcaagataatgaatggaccattgtaaagcggcgatcttctttgggtaatcgttctcagcatttgataaaggcttcttctgtttttgatcgtcttaagtttaatattccatcatctccgaagaagattgctcagaagtctgattctattgtctccaaggaaattgttcttgctaattctgatccgaaaggtacgcatcttgatcgtgataagcggaattcttccttttcaaatttaaaccgatctgggctggtttgttttcgttgtttgggctctgatcaccttatccgggattgctgctcggaggtttgatgtttgcattgtaaaagtctgggccatattaaaaagttttgcccttctgctgggcctgttaagtctccctggcccaataaagtggtgtttgctaggggcttgggaaaaaaactgtctgtcccaaaaaagaaggagcaacctttgcgcattaaaactccacctaatcaggtctgggttaaaaaaaaaagaaaccccttcatcttctccggaagttgctcgctctctagtagtggcgtcagaatcgcaacctcaacgtaatccttcccctgctccaatggctaatactaaccctaatccccatcgcttcctgcgtgtggggcaagtggtacatcaaggtggtgatcgtgtgccaagaatcgacctctctgctgctaccaagccgccaaggtctcatgaagaatatgccattgctttggttgagccgatcttgccggaggaactttgggatgatcatcggattctaatttctgaatacattgagcaggtgcagcactttactgttcgccgtagttttcctcatgcttcagctgtgggtctgttcaagtttggttctgccatgcttagggacctactagtttatgctcccccttttatgtatgatggtataccccaggtcaactttgtcagacatgatcagggtcctaactgg

SEQ ID NO: 12494 - DNA, 710 bp, Oryza sativa
taatgtagctctactggaagtctggaactcaactgtattattatcatttttttgtattgttatcttatgtttattgcatgtgaactagaaaagcatgtctaaattttatagagcttcacattgaagcttatctagtgttgcaatgccactgatatctcaagttaacccctctggtttttatataatgtctgaaccatagtgtatttgcatctatgaaatccttatcgcaacaagcaagccacctgattcttttttttttaatgtagcctagtggaagccagtttgtcgttgttatttcatggaaggtagaaaatcatgtctaaatatttagaggtcaactatgaaactaatctactgtgggcgtgttgactgatgataaatctaatgcaatggtgctgataacatattgtcaagttaatgtggtttgttaatttaaggttaacttgttggttcagaaagtacaggataatctgttcaaacaaagcttgttattccaaagtttacttttgcttgagtctagttctgtccaaattaatacagtgaagtactgcatatatatgcttgttgtaatagcttgtaatttctagtcttgttaacttaacatgtttcattttctaggtgctggagaagataaacaacccgcattatctctaccgcatgaccatcctgccagctatttcattgctggcccctgtcatgggtgccgaaat

SEQ ID NO: 12495 - DNA, 16887 bp, Oryza sativa
tggatgtaagatactatgcaaaccaggcccttcaggcatgcgatcaaatcatgatgtcaagctaactgtcttcctgtccagtatttagaacttgattctcttagtccaaattttggaatatttgtaatttgcactttagtttgaagagttcctttctagccccagtaacagaccaaacacttcccaagatgataatgtatggctccgacccctcgttctctgtgtttgatgttgatgatgttgtaattgagcaagatcggacacattattatgtttgtttacatggtagttttgggccttggtttctgtgattttaatggatgccaacactgcaatgtgatttttgactgtagctattggtaacggtgtagtacttgcatcgtacgagttggctcttgatgtggacaccgatatgttgatatctagaagatcaaattggctttattaaatttaacattaaatatattttgataccatgttttctactccttctgttttataatgtaagactttctagcattgtctacattcatatagatattaaagaatctagacacaaaatgaagggagtatgaactttatcaaagttaaaatttgacttagaaaaaaaaggtaaaacgtctttgatatgaatgaagttctaatataaaatggagggggtactgcctggttcgttcttcattccaactctgggagtccttgcgtgaatggcctgttcttaatagtctgatggtcttttgtcgtgcacctgtcgtctatggattcaagtgtcggcttatagttactcgttgaatcaagctagtagtactccagctgaatggtctgcatcaaagggtacccatacgggggcaaacatgacaaaattggaggcggggcagatgtatccaagtcataactgaatacaagtatatgggggcatattaatttcttttctatacagaaagaaaacaaaatgtggaatcaaaatagtgtaagtacgtgtgctaccttatagatgatcataaatatgtgaagaacactacaatattgggtcatcatttttgcaggtagatcagttgcgcataggatttctcttgaaaaacatctagctaaaataaattctgatgactaatgcaacatgtctaaccattttttagctttctggctaaagagtgtaaatttgaataggccactaagccagctagtggcgccgttgaatccggacgacggtaacgttttctgatgattaactaatttttataggtattgatggctatctgtagtgaagacaatagcagcagagattggggatcgggcggcgtggccgatcacattatatatgcttaagcaagcattggaaccgacaaagtggcaaagagtgacaaactcaatagttttttttttttttgcctagtattgatatataatttcttaaccaaggatagcatttaatctttttaccaacataaaatgcatttttattcatacaatttgattatataatatttatactatataattattaatttcctagtattttcacttatagttttggacatcaataacgcacacgattttgccaatttttatttctaatttcccaaaaaaatggttactcttggattcaaatttattctgcaaagattatcatgccatatttaaatttctccccattctatcctcatacatcctcccctcaaccatttttcacattctaccatcaacaatcatttcctctcaaccaggagtaataaatcatttaatgcattgcatgtttttttccttgaacattaatccttgcttctaaaagaaacctagaataacaatctcttaagaaaggtgatagtagcaatacaattattgaaaatataatgttaattgtcaaaaacttcattttgctattacaaacgaagggactaccttaccttaggctgcgttcggctccttggcacggaaaacggagcaacgattagcacgtgattaattaagtatttgttattttttatttaaaaatggattaatattttttaaagcaactttcgtaaagatttttttttcaaaaaacgcaccgtttagcagtttgaaaagcgtgcgcgcgaaaaacgggtgagggaaggtgggaacctttggtattgaacacagccttaatcagttcccaacatgattatattttgagacttcaaaatcttgtttgagatgcttctaactagcttctatctagacgatatcatgcaacttgaaggtatttaaatatgatttttgatacacgtagcaatttaattatggtcattatgatgaattttgctacaggacatccaaaaaacatgtaattagccgggggacactgtaataacacgtttatgctacagggcactgtaaaaaggtggtaattagttgttggacattcacgatattattttattatacttggaggaattaaagagagaaacagatatgaaaatacagttttacccttcgaacccaataaagtctcactcccactctaggacctacatgtcaaggaatatttcttttcttttatttttctttttctctctccttctctaccccttcccttcttcctgctttcttcttccggttttcgaaagttagcattatattttcaataattttattgctactatcacctttcttaagagattgttattctaggtttctcttaaaagcaaagattaaggttcatgaaaaaaatgcaatgcgttaaatgatttactcctggttgagaggaaatgattgttgatagtagaatgtgagaaatggttgagaggggaggatgtttgagggtagaacggaaagaaatttaaatatggcatgataatctttgtggaataaatttgaatccaagagtaaccatttttttaggatattagaaataaaaaaaatggtaaaatcgtgtgaattatcgatgtccaaaactataagtggaaaaactggaacattaataattatatggtataaatgttatataatcaaattgtatgaataaaaatgccttttatgttggtaatccaaaagattaaatgctatccttggttaagaaattatagtcaataaatacagcaaaagaaatagaaattatcgagtctgtcactctttgtcagttctaaagcctgcttagagcatgtataatagcagactataaacaagctataaacacatattaagaagttagaagaagagagagatgagcagcgggctatagctacagcatgagcatggattttaagacatattgtgtgtatgataggtgagaccagatattaatagtgtagtatatatttatcggtaactattatataaattgactattaaattgattacagatgatttggaatagttagctgtaatcttaaacttgctcttaagcatatgtaaagtgatcggccacgcccgcagatcccaatctcgctgggcttttcgcccctcccaatctcccatagtagccacctcgacgcaaaccctaatcccatcgtctccgcctctccctctccctcctccccgcctccatggatcgcgaccgctcctcccgccgcccccgcgacgacgacgaccgccaccaccgctcccgcgacgaccaccaccgccgccgccacgacgccgacgacgaccaccgccgccacaagcgcggcggcggcggcgacgacgacgacgactgcgaccgctgccgccaccaccgtgacgacgaggaggagagccgctcccgccgccacggccaccatcgcgacggcgggcggcggtccctctcccagtcggagtcccccccgccgcccgccgcgaagcgggagcggtcgtcgagccgcgctcccagggactccgtggagcgccgggactcggccgaccgagaggcaccgccgcattcttcgcggaagcggaagggccacgagggtggtggcaacgagtccgacccggaaggggggaagcgggcgagggcttccgtggagccgcctccgccgaaggaggagaggccgaggcgggagcgacggaggtttgaggacgccgatgcgaatgggaagcatggcgatgagaggggtaagggtgataaggataactcaaaccatggcgctgtaaatggagattcccggagtggtctggtgcccaatgtaagtgttgctactgtctccatatttttcttttctagtgatgaagtcaagaattatctaagaaatgattgctttattttgttttggataacttattaactggatagattacatcttagtcacatttctgtagtttatatggtattatgttggtgaataatctgccaattctttagtaaatatatgggagtgaagggtttttatcaggagtccaggagggttagttctgttcttacgaaatgtttctgttgatagattgatcgttagtgcttttgtccaatttgttcaagttgcacaatactttcaagggataagcttgtattgttggttgacatgagcgatactactggttactaggtggatttttagccttgattaagagagtaatgcagctatggcaatactgcctcctgctttattaggaaaacttgatccaacattaggagccaactagccattagatcttttccttgcattgatgatgaactttggaagtacctgttcagtgtctctgctgatttactgataagaacatgctcaattgtttcagtattgtttgagatgtataagaagttaatatccttcctgtatattctcattggatgcaccttctgtgtttttcaggctggtgctcagcaaccgctcaatgctgcacctgttgtggtgccatcatctgttcctatgccttcaaaggtatcttcgattactaccaccaatgaaaatgagggagttagtattagatctgatgaggttactggaaaatctagtacagatggaagtacaagttcagccgctggcaaaagtagtaatctatctcttgatgctttagccaaagctaaaaaagcattgcaactgaagaaggaactatcagaaaaactcaagaagctacctgtggtaagaaatcacagttgttggtagtcccttgcttctatatttctattttacctttctaacttattgtgttttttggcacagcttaataataaacttggtgttactagtactgatacacaaattcctaagaaagaaacacagcctgtttctagctctggtgcatctgaaatggctgtgggtgcagctcttactgagaagatggcagctacagcaggtgcagttggtattccaggccttgctaacattcccaatttggatgctgtgaagcgagcacaggaacttgctgctaagatgggattcagacaggatccacaatttgcgcctctcatcaatttgtttcctggtacatcctctgaactaactgtgcctcaaaaacctgcgaaggcacctgttctccgtcttgatgctcagggtagggaaattgatgaacatgggaatgttatcaacatgaccaagccaaccaatttgagcactctaaaagtaaatctcttattttactagcatgaatactatgaaatgttatcagtaactcttctgtgcaatgactgtcacttttggttataccttgtaggttaacataaataagcaaaagaaggaagctttccaaataatcaaaccagacttggattcccttgcaaaatcaagtgcacactttgatgaaaggatgggcatcaaccaaaacaagctcctccgccctagaaggcctggatttcagtttattgaggagggaaaactttcaaggcaagctgagctgcagagaattaaggtctgtaaggatcaacttttaagattagttttcaaaatgtatttacttatcatatttccttttacttaccctaataatttgaccttctagaatcaatttggtgaagcacaagctaaagaacttaaagtaaaacaagctcaacttgcaaaggcaaaggcagaagtagtcatgaacccgaacttgattgaagttgctcctgggaggcctccaaagcaaaagcagaaggaagagattcctgaaattgagccatggtttgctgctacaccctttatctaattttatattccatcattaaaatataactactaatgtatgctcttacagggatgcaaaaattttaccttctacaacatacgacgatttctccatggagaaggttaatatggaaaaaatcactatatatgtagagcatccagagccactggagccaccagctgagcctgcaccaccaccgcctcagccacttaagctgactaagaaggagcagaagaaactcagaacacaaaggcgccttgctaaagagaaagacaggcaagaaatgatcaggcaaggcctcttggagccaccaaagcccaaggtcaagatgagcaatcttatgaaagtactaggagctgaagctacacaggatccaacacgtatggagttggaaatacggactgctgctgcagagcgtgagcaggctcatgtagatcgcaacattgctcgcaagctcactccatcagagcgccgtgaaaagaaagagaggaagctttttgaagatcctaacacattggagactatagtttgtgtgtacagaatcagagacctgtcacatccgcagacacgttttaaggtggatgtaaatgcacaagagaaccgtcttactggtgctgcagtcattgcggatgggatcagtgttgttgtcgttgaaggagggaagaagtcaatcaaaaggtacaataagctgatgctgaaccgtattgactgggctgctgcggttgatgatgatgatgatgctgatgaggaatcagacaagcctgtgaatagctgtgcattggtctggcaggggagtgtggcaaaaccctgctttaccaggttcagtgtacacaattgccgtagtgaggctgctgccaagaaggtgtttgcagatgcttcagttccacactactgggacctggctgtcaatttctcagaagattcatcttgagctgagcttctgttcagaacatggaggcgcctgctgttgaaacccctgcctagggattacgatgttcaattctcatgcagtaagtgatgagtagtagctaatttctcaccgtgggtaagtgtcctcttcaagttacgtacaagccttattacttgctctggaagcatttgtggactgagtaatacttcgtactgtcatgaacatacccttgtaagggactgctgatcttttcgttgcgggatttactcatgtgagctagaaactgaatgcatggaggaactgttgaaatttttgcagtataagcttccaactatatctggactgctcaggccttgaatattgttatgggaattgtgttaatgaaagtatgtatgcattttcgtagggttgcagtgctcttgagacggatttcatattttcatttcaatccaacaatatttgaccgattttttccatgattggaaatgttagtagttgcacgtttcagtttgcaactgctgctccggatgtttatccatactcgattcggcatctaatttagaattaaaacaacatattctgaatttattttaccaatgaggcggccagaattttgaagtttgacatatccaaagtagtgtaaaaccaaacttgtggcatttctgttttgtgaattatataagaagaaagattctcgaggtttttacctgtgtgccattaaaaaagatgacccctgtctctgtgccactaaaaagttcgagcctccctctatgccatcgtcgaactttatcgtgtctgtcctccacaccattccgtccgtttttgatcctaacggtgagtaacggcgcagccaaatgacgctcttgcccttagccatgtttcatctagccaaatggcgctgcggcatcatcatcagcatccgccgccgccgcctgagctgcagctcctcccggcatccaccacggcgccgttggccgccgcgtttttgtccaactccaccggttcctcctcccacgagcaacacgtgacgacgctgcgacgacgacggggcggcgccgcgacgacgacgacggggcggcgctgcgcgacgacgacgacggggtggtgctgcgcgacgacgacaacagcggcggcgctgcgacgatggcggcgacggcggcgttgcgatgacgacgatgatgggagcagcgctgcgacgacgatgacgaggcgttcctccgcatgccccctcctcctcctctccgcctcgacctcgccgctgtccttccgccgcgggcccagctccgcgtctctcagcgccgcgagcgccgccgccgcctcgtcgaatgcctccttccctccgcctacgccgccggccatcacggccgtcgcctcctcgggcgccgccgccacgggggtcgacttggccatggggttagctgctggtggtggtcgcggtcggccgtcgtgaggatcgaagggcatggacggagagaggggaatcgagggaggagagagagagagagagagcgactgaaagtgaaagggcaatagtgacatttttcctacttgggcccacatgtcagagctgccaaatggttaaacccaaacagaatagcgacggaatggtgtggaggacgcgataaagttcgacaatagcatagagagagactcaaactttttagtggcatagaggcaagggtcatcttttttaatagcacacaggtaaaaaccttaagattctctagcctcaacatgaatgtatctaagggtgtaaatggctaacccatgaaatccacttgtaggttaaaataagttaaaataaacggacttgtaggttaaaataagttaaaataaacgggtttgcggctgatccacttatacccctaaatgcatctagccagtggcaatttcgtttgcttcacaatttttgattttgttccaagcaagagtatgatcggaatgaagtgtcaacattttgtgtattcaaactgaatttatcaaggacgaaaaatgagccgcaaaaaattcatactaaaattacaccgcaaaagttaccaagtaatcagagtccaattccaatctgctgagtgctgaacgcaattcatttgaaaccgcatctaattctccaaaacccaaaatttttcagtagttgacacttgaacagtttgcacaatccatatccaagcctgcatcacgtgatcaccatttttctccatctcatacggtatggtgtggctcaggaagagatatggccaatacctctttcaaatttcgtcagagtgaacttcaccaaacatgaaggtgcaacacggcccttcattttcgatgctatatacatacccttgaccttaatacagaagatttctaggtgacaacattacttggctccattactgttctcatgatctgcccgacttttgtcaaataaactctttccaaaccaaagattggtgagccaagcagataatacctactcagaatgatttggatgcttcctcattaacagaaatctaaaatctaaatgtctcaagcagagtacatttgatggaatcctgatggttagcacaacatgacagcgataatgatacgattcaaagcgaagctagtaaccaaaacatggaaacagctgatgtagctatgaacgaccatgtgatgaatgccaagataactgaaagctcgtaacgaccacacgaaagctgcgggtacatcctacagaagtgcacgtctctctcaaaaagaatagtgacaccagcagaagcagaagctgctgcaaacgaaagaatcgctgtaacctgcaatacatccaaatataatgttctttaatgtccctcttgctaaattatgttagcacttcaagaaagaagggtcaaacaagtgatcaaacagggaaatgaaaaccttggcatactaccccatctagctacaagtgccacatggatattgacatggcaccggaaatgcagctgattactaatttacggtaatatttcaagaatgaaagggaacaccgaagttataatataatgaaagaagttatcgacagaaacctacacatatgttttgtgtatccattctaaaaaatgtattttactgcacaattctagaccattagttattttttactgaaagggtataaaattgatcgcaaactgacagaaaacaacccatattgccagtgtttcatctctgattccctaaaagatctaatacaatcgcaatttttttcatgtcatactctcatttatgtctgattccctatgtctgattccctatgtctggattggacatgattcatgtagttttcatgtcatattctcgtctagattgcacttcttttctctcatttagattgaattatgactggattggacatttaacaatatgaaaagttcaaactgttcccctaagcatgaaatttaagaattcttgaacaaaaacatatgtactactcccctgttatttttcctttttgatgacttcatttccaaattgaaaaggaaattcatgttgctttttacaaattgaaaagcaattactagagtaatatatgagaaatgaatcacttacccaatcaccaacaacaaacaggcttacaagcactgggttatgaagatctcttttagtttgtaatgaatagatatccagacaagcaagtccaaaactccaaagaagctgtagacccatggaagcaatcaagtagctgaaaatagggagatcacaatatcgtcaattatgtatatagattatatcacgtatgcactgttgagctcctgctcaagcaattctgaatagtagtaaacaattttcatactttgcccaacttggtctcaaaacattaagttaaaaatggcacccatacaataatcaaaggatgtaacatgttgaatgttgacacattcatacacaacatctaatggaaaaattctcataagatgttaagttaaactttaatagtcacaaagaagagaacagataagcacaccaaatcattgggcagtcctgcctttttggtttaagacagataaataaattgtttttggtcccttcctggcatggaactgaattatatcaggaaaaaggccagtaaagaaactgtgagaaaagatcaaaacatcataacatgatacccagaaagctacatgagccaataactggaataaatctactacttgtttctttttagatggaaagaatgcaaaaacactgccacatatcatgcccctcgattcaaatggaatattccagaatgaatgcatttattactcgtgaggaggtaatggtgctcaggaagagaggagagagacttaggacctttttattttttaattttattaagagacctttccaaaaagtatttctgaaaactgaaccttttagcgttgtcttgccacaccagccacggtggcgtggcagaacagcactgccacgccagcctcgcgtggcgtgacaaagttatttggccatgccaggcgggctggcgtggccaaaaggttcagatttggaaatacttttgggaaggtctatcaataaaattaaaaaataaaaaggtctaaaaaataaaaaaaaatccagagggtggggaaggttgatgataaccagtgggaagcttggaaatgtggaggcaagggaaggataggtgtgctagtgcaagttcagtgtggtggatatctgggcagttttcttgtgtcagacaagcattattgaatagtttgattgcagaataaatttatctactcaaacggaaacataccaagaaaacatacacgacaagacagtacagtttagctgaacaactatcgaagagcaacttaggcaagaacactcaccatgctgagtttgtataccagcaggcacacaccagctcatggggaatgcaactactgtacctctatccattgatatttcctgctcatttcagttactacatgcaaactaatccaaacttgtaccatttatgtacaccctatttgcagcaataaccaaaactaaggaagctgagtgagaccatgtactataaggccacttataaaggaagaagagcagaagcaggtttttattttggaagaatagaagcaattaacaaatttaacacagaagcctaccgagtgaaagtcctaaactagaatgtttgctgcaaattagcttcagcaatcggctcatacagagacgtaggtgtccaatgttatttcaagcattccaaaatagcgacttgagcttgaagcatttgcccaagaacccttgaaattgcacatttacgcaataggcgcgcgctggttgaaactcgaccaatccccatgaatttgcaacaaaatacaagaaacatttgacatcaagaaggctaagcctgacacattgcactacaatgaaagttagaactgacatttcagtagacaagaagcgaattagtaaagggggaaagaggaggctagagagagagacgtggaaaggcggtagtagtagggtaccagaaggcggtgtagttggagaagccgtaggcggaggccatggcgacgacggaggcgccggcgaagacgcattgcgacacccgcagcgacatcccgctccatgtccccgggctccccaccacatccttcatcccctcctcctccaactcttccgactgctggatgcgcgcgcggtgcggagggcggcgtgggggtgcagggcggcgccgccgcaccgtagccccttgcccgcggatctgcgcggcggcagcggcggaggaggaggaggtggagtggagtggtggttggagatgggaaaggcgacggagcagcagccagcaagcgaggaatgagttgttgttgctagggaagagagagacgatggcttctacacgttttttttcctttcttgtgttgaataaatgaaattaatcttaactttttagctattaccagtttaatcttagaaaagtactcgcatgagactacatatacatttgtcgacaaatttttccccaaaaatttaacagatataattatagtacaattatagtgtaattacactgtaacttatatgtaattacactgtaacttgcatgtaactacacataattttgaatcgttagatctattacaagatttgttttggtgaggaagaaaataaatcatagcacacacatatgtgaaataatttgttcccacgacctccattttaccgaaataacatgttacggagagatttttgaaagttacatacaagttatactatagttacagtataattacatgcaagttacagtgtaattacactacgattatactgtaattacatctgtcaaatttttggggaaaaatttgtcgacaaatatatagcaaaatcgataggtaaagggttttcttcctgtaatattgggatccctacatacattataattgaaaaagttaatcaaaattcatccttggttttgggccgaaagctcattctttttactttttagccctagcccagtccactgcctcctaccttcctccacttggccaaaatattgtgatatgacatgattaaaataatatacataattttttttgagaaataaaatacataattgtgcacgtaaataaaattctattcccatagtacgataagacaatacgaaataaaatatcaaaacatgaactaacagttaacgcgcataatttcataacgttataattttatcacaccatggggcaagaaataaagctaagtatcaaaatgtcatcgaaatcatataatcataaaattctacctcataatactgttgaaccaaaataaagcaaaattaacattagtatcaataaattaaatttctagctgaatttcttgttagttccatttagctacacatgatcttcattgcataagaaagtttataatgcaactttatggcatcaaataatggcttaaacggattaaaatgcatttatgtaaaggaaaaatcactaattcggcccgataataagggaaaagtaatttggcccgaagaccagtcacgacccagaggccagagctagcctgtgattgggcggcccttgaggcaagcatagcccattaaccaatcatggcccgtcagtgtagccgtccgattctgatggacggccacgatctctgatgggtggctgatgcggcgtatgagagtcatggtgttatggttacggataaggcggttgtagataaggcatacctcttatatttggggtcgcgaagtgtatgaatacggtatatcctcaagtatatgggaatgttacgttagttttaaggaattcggccaatgcgtaaggaaactaacccccaaataaagggtgttagagtcctattcagagaggatgcaaattatgtgatctcgcgggtagaagattctccccgagttctacttggaagccaaggcaattcggcatataaatacatggtgtccatgggatatgggatcatcgaatcatagaatagccaccaaccatagcagaggcaatccggaggactcgaagccaattcgccggttcgatcttgttgagacgttctcgacaggggtcaggtcggtaactcttcagtttatattgttctctattgtaatctctgtggtttccgtataattcatataaactggattagcactgttaccttgcgaggggcctgaactagtataatccttatctttgtgtgcttgatgtcgtttcgtgttgactcttgttacaatgtaccccaataccctcaaaacatggtctatgattataacccatcgacagtggcacgctaggtagggggacttggtgctcaaggtctcgctgagatggcttcaagctcaagaccttctaacaatgatagctaaaattgtcttggcctgggagatcctacccagccggcgtttgcatggactcaagtcgaatccttctgctttcccatcttcgccgcaactccaatcttgccttccctaataccagtcgggatcgagatcgccgccacgaggatgacggaaaataaccctcaaccgtctcctcctcctgtccaattagaaaagaaggcgctgatgacttcagcttctcggggaactcctaaggtggccaaacccccgaacatctgttaaggatcacgtgccaacaaggaaatcttcgcccaatcaccacacctggtgcttgatccgcaaggcgtctcaacactctctggtcgagtgtggggtgatacttaatgtgaaggctgaacttgatgcttgtaaagatcgagctatccagcacacatctccatacaaggcatggtgcccgatccacaaatcgaaaagttacccccttaccggtagggatggcagtcgggcacgacgggcacgagtagtgactacccatacccgtgcccgcgaggtaattcatgcccgcgggcatacccattattacatgacgggcaaggaacactacccatgcccgttgcccgcgggcgccatgtgcctgcgggcatgcccgtttactcgtcacaaactcacagttgaacatttcaaccacaaatctccacaagcagagagacattatcacaatttaaagaaatggtacagttgtaccaagttcaacaatacaagcattacatgttcatcaatactagatggtggtatttatactaatttgactgagggaccacatgtcagttggtttttgcgggtaaacgaacgaagcgggcatgggtagtgactacccatgtctgtgcctatatgcccgttgggtataggttttgatgcaataaaaaacccatgggtactaaatggggaacaaacccaactctattagggtttttacccacgggtaaacagacaaacgggttaaattgccatccctacttaccggctgtaagatcttctagagattactggatccatgatccatgtcccttgctatccgatccaccaacgccgagagcaaccttgagatgcatccgtggaagatatgcgaaatgggaactgcagatcgcctggtcggattcatcgacatcgatccttccgtccttcacaacttagatgaccaggaatcttcaggatccaactccccatgcgaagtgaatgtgatcgaaagagtcgtcgaggacatacacgaagagggcgagattcgttttggagatgaaccgcgagctcctgttccaccacgtgaaccagtcgagccggttcgaactcctgccaaacacttcaccgtgcgtggtcaactctctactgaggtaaactccgttcgacccagtaaccttcccggaggcggacaactaggtcagacatatatagtcgacaatagccaacctcaactctgcttttttgaccgcagccgaaccaaccccgcaaggtcctgctcgagatccccgacaacataccgatgacagagtaacggagaacgaagttgccgaggacgcccacggtccccaccctagtcgagacctggaccgtactcctcaaaatgcatcatcaagaaggcccatcaacctcatccccgtctagatgaccgcgatcgtcacaaccacttgaacgggaggaggcaggagctcgaggaggaggtctggcgaggagcagtggtaggctctcgctcatgtagtatttttgcagtatgaacacaactcagttggatagagtcatggtatgttaggattaggataaggagttctccatctatataaggagagatcctatcctagatcagttagcattagatcaagatttatcttagtgcccatcaaccctaccttgttggtgtgagggagagcatcgtgctatttaggttcagggccattctctattacttcttctattatgatccaatctattcctcttcacctcttttatcccatataatcctagcacgtgacactttactcttttcggtttcctagtcttctcagagatttgggtatgtctttagtactttactctctttgtaaggctatgagcttagtaataaagttatcttgtttatttaattgtgttcgcagttcatatattgctttgttaagtgtatgctctatgagtagtgggctgcagg

SEQ ID NO: 12496 - DNA, 6698 bp, Oryza sativa
tccccctttttttttaatttacttgtgggccccacatactggtttggtttttttcttactaggatgccacgacagcgaaactagacatctatactgactcaggactagttttacatagttcacgggtacacatttctggattgcagttaggggacctcggacagactcggcgtacaattgaggacgtcaagtgaacttattcctttccacgttgtacgatcttttctcagaaacaataattaattttttcctagagtgatggaaaatgttaaatgcatctgtaattctgtatgcacgagcaatacgtcttctttccccaccgaatatttcacaagcgttaaactatgtactcccacaataatgtatggggaatcatccagcatattttacatgtgtgggccaacagccgagatggaacaggtgcaacaaatagattagcatctgagaaattttagcacttataggattattttgctatagaaggcaagttccactgctgttctggtggaaaaggtacatgtgtgtttgcacagatttttttttattgataatggaagatttcatttggtcattggacgagtacacatatgatttcactctcggaaaccacctgcctcttagttacatccaaaatgcatgaccggtgcacatctcaacatggtgtaacatatgatatcttaaccaactttgcacaattaaataactcctaatgataaccttaattaattatcactcacttcattgtcctaaatcaatttccattagcatgttgatgccttttgtccattaggcaataattatcaggcatttgtgagttacatccaacatagtgtatcattcattcgccttgtcatgctattcaaatgaaaaccgcaccacagtatgcgacaaacataaaagtgtaaatcatggagcctttaggaatggagttaaatgccatcatatgtgtggcatatttacatgaatgccaccgtctattctgatactacctcctggttagttgataatacttattcttttggataggataaggacatggtcttgaaaaacaattttaactattaatttttattataacatatataaaaatattaataaatatatactttttgaagaattttttaaaaccaatctctatagatgatcataattctaagaaaagtattttagatgctatttatagttaaagtttttaaagtttgattataggctttgtccataaagataataattattaacttggagatagtagttagtagtgcgttatgtagctttccattaagatatatattagcattttaatattatgaatgtgttttcagtagaaactataatgacacaattttctagctaactttaaaactgtgaaggcgtagattccatctttttaccattagtttttgcaaattcttatggtttaacaacatgcaaattatatgcataaaagtatttcccatggtgaatctaaagaaaatctgatgatattatactatatgagtttttaaaagttaatggttaaagatgaaaatatttgacttcagatgaactagagtgtaagaaaatttgaaataaaggagtacacgaaaccaaaacacacattgaacaaggacggtccagtggactcttgcccgagaaaactccaaatgctgtacatagtggcttaatggtaatttacctcgtagcaaatggccacattggggttcagaaaaatgtcgtcagcaggcccctcgaccagctacaattgtatatcacttggcctctggccagattggtggagaaaggcaagttctcaggctgcagaggaagcagagctccaatctgttcatgccaatggctgctggcacctgggtgaaggtaatttctcttgcttactcatacatatgcaattgattgtgtactcccttgatctataccttttcataagaaaggtttggttcagttttgggggaatttttttggctgagatttgttcatgttgcaagagtatttggctatttgctgcttcgagtgatggttatggacatggattagttgggaattggggcttgtttctgaaggttgttcatatattttggggagggttgtggattgaccctgctaggatgaaactttgttctaacccaagaattttgacatttggggattttttttttctagagcagatcactaaggaatcagaacatgaggcttagaatttttgtttttaaggaattagacttcgaaaattgagtagcatgttcagaagctagggatttcagattataaaaggttggggtttaattagcgaagaagtttcaggttgtgatgctatgctgcggtgttgattgggtaacagtgacggattgatagccatggacatgaaaatgagttgggaacttgggttttatgttggtgatagtaactgtttgaagattatataaagggtcaaatatcttcggtgtatcttgttgattccagttttccaaggtttgttgacaatgaagattattcgggagggcgttgtcagaatccatttcagtttcagctctctggagttgaccaagggattttgattccaaatttccagggcgatagcaaaatgctgacttcaaatttatgtgtcaataacatttccagtcagttttgagaagtacaatttgtgttattcaggtgtttctgaaaactgtcgactgtcttcaatatcagatgcacaaagaaaccctggaaatgcagaaattcgggccattaggctcatgaacatatgcaaataaaaagcgccgccacatatagacatccacatattagatgtcacttaaactaattagtgaattcctggaaattttatagaaattacaatcctgtatagaacgcaagaatttcatagcaaatactaataatcttcgaacacaaattgctcagcgagagagtagtaattttctttgcagattgcagcatccagttttgtctaatttgattagtaattgacatcagttaattaattaattaatcacgcgcagctagagcagaagggagatgggccgggagcaagaagctcccacgccatcaccctcgtcggcggcacggcgtacgcgttcggcggcgagttcacgccgcgcgtgccggtggacaacgccatgtacgccttcgacctcaagtcgcagtgctggtcggcgctggacgcctccggcgacgtgccgccgccgcgcgtcggcgtcaccatggcgtccgtcggcgccaccgtctacatgttcggcggtcgcgaccaggagcacaaggagctgaacgagctctactcgtttgacacggcgaccaacagatggacgctgctgtcctccggcgccggcgacggcccgccgcaccggagctaccactccatggtggccgacgccgcggggggcgggaaggtgtacgtgttcggcgggtgcggcgacgccggccgcctcaacgacctgtgggcctacgacgtcgccgccgggcggtgggaggcgctgccgtcgccgggcgaggcgtgcaagccgcggggaggccccgggctggccgtcgccggcgggaaggtgtgggtggtgtacggcttctccggcgaggagctggacgacgtgcactgctacgacccgggcacgggcgcgtggtccacggtcgagaccaccggcggcggcggcggcggcgacaagccgtccccgcgcagcgtgttctgtgccgcggggatcgggaagcacgtggtggtgttcggcggcgaggtggacccgagcgacctggggcacctcggcgccggcaaattctccgccgaggcgttcgcgctggacacggagacgggcgcgtgggcgaggctggacgacgcgggcgagcaccacccggggccgaggggatggtgcgcgttctcggcgggggaggtggacggccggcgagggctgctggtgtacggcggcaactcgccgacgaacgatcgcctcggcgacatctacttcttcactccgccgctggcttaataattcctgaaccggcgagcgaccttgtcgacctccgtcatgcaggtgtccgcgtgcttcccttctgagcgttgggtagttgtgtggtttgtcactgtgtttgatgttggtgttggtatcatgttatcctgtgttgtgtagctgatgaaataaatgtgatgcattggtcattggtgctgcaagaggcttcaaatgcctgttttccaaacaaaatgtcgcctaagtaactaagttcatagggtacttaagggctgggctaagatagcttgaaattttgaagtattatttcatttcctttcggtcgttcaaatttggttagaatcagtataaatccaacgtaaatctatatctttacctacttggaaaacaaagtatgcctctaagccccctttgtttcatgggagtagctatatttatggcgttatatttttcatcaaaaatagtcggtatgtatttatattgtaagttcctaaattacatatttaattttagtgtatttataatgtagctctcatatttatatacataagtcgcaaaattacatatgtaagtcccaaataaatttacatatgtaatcagtatgtaattatagtgtaagtacgatgtaattagtatgaataatttatccactagtgatatagtttaatctccaagtataaaagcaaatactagcacaaatcttgaagataatctgttgagttgtgatacaaattcatttgcacttaataaatgctagcttctaccgtagtaaagcggaggcccgtcgccgggaggcttgggccggagcgtagcggacgaaatgacagtgggcttgctttccgttcccctattcctaatttgaagagctaatttgcgggattaacaagaggatggtagtggacgttcgacgcctcaagtcctcaacgcccgcatggattcaatgcaagtaacaaaaatggggtcctcctatctgttggactgggggccatatgtcatacaattagtgatatacctggcgccagtaatttttgagtggggtccagggcccccacaccttgtatggtaaatccgcccatgcgcacaaccattgctagtggactagattgctttctgtcgcctacgtataatatccttttaggtggccatcataacctagccgttgcgaaaacattcttcattagtgactgctttacgacaaccgccaacgaatatattgcattttctgtgaccttcggtcgctggcgtatgagattctcgccacttaaaacatgaaatggatgccaaggattaacggttatcctttttatagtagtgaaatgtagcctctactctatacaaactgtagagaatagcgtggattgagagcaaagtgtattttttttgaattgagagcaaagtgtataggggttatataatagagataattagttgcatatataccctagctttaaaattagaggtggcacttccccgaaaaaaaaaaaatagaggtggcacttctgagatctaaacaacctcacgaaacacgtggcttttgacatctcaaccaccccactaccctacagtctaaaatcccaaattgtgatcctgatacagataggctgctacccaacgaccgaaccattgtatcccggtactgatatggccgatccgatccattgtatcatgcgaccaccctccctcctccccaaccagatcgaccattatatccgtctctccctccaacctcctcgctagaccagagccttccgtcgtgtcagtgtgccacccaaactcaccatggcttctgacttcaaggcaatccccttgatcggtaagctatgtctgtcttttccaggttttttttttcttttgagctaaagagagaatttatattaatgactgatgactgactagggggttacactcctgacttgacaagtcaacgatccttattgccagttaagcaagcctattttttactatggccatgtttagttccaaagtttttcttcaaacttccaacttttccatcatatcaaaactttcctatacacgtaaacttccaacttttccatcacatcgtccaatttcaactaaacttttaattttagtgtgtactaaatacagcctatgtctttttcttgtgcacctgcacactctgcaagcactacactctgcaagtactttagaaatcagcattatccatgaggatccttatggactccttatcaagttaaaacaaccactaaaactagcacagtttttatggcacttttaacgttgcctataatactttgctatatagacatttttaggcatattttgttaaatctatcttgtagaggtatatttttggtacttcaaaatttttctcatatgtaaagtcattttctcaagacatctaaacctcggttgagtcactttctaaatattaatatgtgcatatatagaattaacacaacacatacatttacaagtaatgatataaggttcagataattagtgcattgaagataaaaataatatactcacgagtttaaggattggtaatacttcctccgtttcacaatgtaagtcattctagcattttccacattcatattgttgttaatgaatctagatagatatatatatttagattcattaacatcaatatgaatatgagaaatgctagaatgacttacattgtgaaacggagggagtagcaaggaaatatatttttttctattttcacattgctttgctataggtatggcaaaatttaatgcctgt

SEQ ID NO: 12497 - DNA, 3738 bp, Oryza sativa
ttatgaagaaaaactaaagattaaaatgacacctcagaatggatataggtgtgatttcttatagtaccattttaagttccaacattgatttttccgtgctccgttttgggtcgttcaaagcgtcctttctctatgagtaactttgttctcttgatcatcagaggataccaaagactgggcgaaaatattaccaacggtaaacctgacatgcaggaagcaattgatgtaagtttatttttctttctttatttttagtgacccattaacttgttactagttaatcgctgagaagaaaaaacgtcacagtattatgcgcctattgaacctgataaatatggagatcttgccaaaccaatggaaggaactaatttgtggtatatttccaacctttcatctttgtttattttcattttataccttggcgctatattatttggagccctttatggaggtaagaggtactgttatttaagttatgttttgtgttataaaatatatatttgcttatctttagtaataaaatgacagtaaagaggaaaacattaatgacaatatatagaaattaataattgccatacatccactagaagaaacaaaattaattcaggcaaccatgaaaagtgtctataatagaaattttacttgaaatatactagcaccattgttttcaaaactcaaaagaaaatcttaaaatttgaagtggttcatatgtttaaagaattacttaaaattacataacaaatgattgaaagtttgaaagtgaatagtgtctagtgacgattattatcaaaacgggtggagtagcaagtgaaaaatacttttttcttcatacttcaagatctattacctctaaatgaggaaagagaaatatcaatatgaaatgaatggcctaaaataatccgggagtactataacaaaagctcatgttatttaacatatgtgagagatattgcttgcttgactttcatataaaatggtaccacaattctacttattgatcacttactatgcattgataataattatgataatataattaatttagcttatagcacacctctatttggaagaatgaaggaaatgaatttctaatttacaatatattaataataacaatatgtatcatgttatgcaatatggctacaattgtgaattatttgttgttgcatatgttgcttcaatataatgtattgttgttactagaagcattttgaatagttgaattatagcattccatgttatatattttgatactactagttgaattactttgctattactgaagagctgttctgaacttaatttggtacccttcccttgagtacttttggttagaaatatttcaaattcaattaaccatatcatttactttgatgcaggccaaaatatccatcaaattttgatgcactactaaaaaactatatcagccttctaagaggttcacttttgaacttagtttagatcttagctatgcatctatgttatttatccttttttttttctgatggaaattttacttatagatctttccagaaagatcatgcaaggtatagccttggcattgggtgggccagttgatgcttttgaaggtagaaccgcaggagatcctttttgggtttgcaggttgattggttatcctgtatcaaccgatattctagaagagcatcgcactgacactggctggtaagcaaaatgtatctatgtatttatttggtagtatattgtgctagaatgtacttactagattcatctgacaccgtttttctcttatgtcacatccgttctgcgatcaattcagtggagctcacacagactatggttagtacttagtacatatctttcagaagttcctttcgaaatagacttttatatatggacaacacatacataaggtgctttgatgcattgtaaaaagtttcacgtgttttctgtatttctgtttatcaaactcatgaagatcatttttgtcatttgattatattacaggccttctgacattggttaaccaagatgatgacatatgtgcccttgaggtacttgtttcttcaccatccatatatcttataggaatacatgctttctttgtgtttgaatattactcaagttccactttttaccctggacttaaaactaatcgtttttactagaaacctagactaatatcatccttgaccctgtttagatattgtttctatcgaaaaattggtggttttactttatgtagactcttatttcgcacattatgtctaatactatataactatatagttgatcctcactaagtgtagttaatgctatatattttctatcatgtagttaatgctatatatcttctctctcattaaaccacattacctcaattgtttttaaccacttgaccattaacctatggtactatgactatatagtttatccccactaaatctagttaatgatgtttctcttctctctcattaagtcacattaccttaattgtttttagccattggattaatctatggtccaaattgtctcctttctttttcttcactcatgatgcttcaccttaggttttgccttaactcattgaatgatcagtatatattcaatctaaattatcataacgcacatcatctcaattgtttatagctcttttcagagattgattagagatgaagttatacaaagtatataaacttatacattttgctacaaaataaattaaacctatactttatttctatcattatagcataatatttccatagcaaagcacgggatttcatctagttggcataatggttgtgtacatcgatgtggattttagggactggattgttatcctttatcttaaaaatgttggggaaagtcatcttataggggaccaggcattgataggatcagaaatagtatttgtgtggatctggaaaatgtgtagtaaaaaacaattattttacggagcaaggagaaaatgggactacaagaaaattaatgggccacccaaaatggactttatcctatcttatacttactcatccatgtcgtgctctctgttttatgtgtccctcaaatttgttgaactaatctttttagtctccctattccttgtgatatttgttgtacacaattaacatttcaactaaacatgttcttctatcccattgtgcaattcacgaatgagatcttggaagccacttaatcttgcaccggaatttgatctcatagtagtaaccaaggtctagtttcatggccgcaaaccagaaaccataaattcggatccatgccatactttatataccgatcttcactaggagtttgtttactcgatgattctcatctttgaaccattgtgtttttctctattctaataaggaaaaagtatgaattacctcccctcaactattgcggtcggccgaattatacccccaaattgaaataccagacattataaaccctcaactattcatacaggacaaataaccctcctcaacactgttttgagcggttttgacttaagcttgcacatgtggtgccaacgtttcaatctagtcagcaaaaaaataaaaaaaaactccatggggcccacctgtcataccctccctcaatccaatccttccctagtggttctctctctcgcacacgcgctcgagcagcagctacagagcccatgaaggaggaggcggaccggatggctggtgacggaggcggagcatgcccgggcggcgggcaactgaggcggagctctttcagggactagcc

SEQ ID NO: 12498 - DNA, 4096 bp, Oryza sativa
acaggtgaccgccggcagaggcggagccatgcccggggagcgagcggcttgagccggagctcgcctgtccggcagaggaggcggaccgggtggccggcggtggaggcggagcacgcccggtcaacgagcgattgaggcagagctcgttctggaggttggcggcggaggcacagatcgcccgggtggcgagcggctgaggcttagctcgcctgggcggccggtgccggatcgggtggccggtagtgaaagcggagctggtgccacgcgtgatagagaacttacgctccagcgaggatgccctccccggggcccgccgctcgcccaacccctccgcgaccttctttcttcatccagatcaccgccttctccgcccggaccaccaccgccaccgcactggggagtgagtcggaagagaaggagaggggaaagggaggagcggcggtgccggccctcctcgctgctattcgcctcctgcacagctccatctcgtgcatcgccgccgtggacgcggccaccgacacccgtcactcgtacgtcacgtccgcagtcgcctcctgtcctccgatccccgccccgcccaccaacagcaaagagagagggatgaggtaggagtaattgacaagtgggcccatagttttttattactttttttatgattggattgccaaattggcgccacataggatcaaaatcgctccagattgagccaaggggggtaatttatccggtttcaatactttaggggtatcaaatgtccggttttgtgggtttgggggggtggtaattcggtcaaccacgatagttgaggggagtaattcatagtttttccttctaataataaagaagaggggaactaaaacagatcaaagatgagaacttgattttagtttctttttaattattttaaagatcagtattttttttcatggcagagcacatctgagctgtgcatggttatatagaatttctcactggatgatctagcatgagatgcttctacacttctgtaacattctaagcatgttctaagatgcataagtaattatgtaattaccatattacagttgctgcccactgttcatatttagccttaactgggtgaagcaaacaattttgatttgagtgaaatatctggtgaatatatttcaggtcaaaaaccaatcaggtgagtggatttatgccaaaccaatcccgggaaccttcgtctgcaacattggtgacatgctgaaggtctttttttttcttcgtttgcaccttcattgtcatctttttattgtcatcaaacttgtgacacttatcacatgtcatatttgggttaggtttggtcaaatggaatatatcaaccaacacttcatcgagttgttaacaattcccctcgttaccgtgtatctgttgcctttttctatgaggtatattacttgcttaatcccctagctcatcttaatactacacatcatttatgtgaagttgctctctcattgttctttctttctgaattcatgccacagtcaaacttcgatgctgccatagagcctgttgagttctgccgggagagaacaggtggtgtcgccaagtatgaaaaggttgtatacggggagcatttaattaaaaaagtcttgaataatttcatcaaataaatttgcggaacagaaaaaacaaacgtgtatgcactccaagatcatatcacatcatttatcaataatactgtttgtgaaattttattgtagcacttgttgcatttctataatttgctacattttaggggctatcttaacactaaagatagagttcctttatggttcaccgtactatgctatagtagtgggttgtactagtgatccaacgattcgttggcataataagcctggcctaaggtcatgcctgtaactcgcctggcatctgtttggttgctaccctgaggattctagcctgataaatcttgcctgagtgtactcgcctgagtcaggcgtacaaaatgggtggcctgagcatttcgctccacctgcctgagtaaaatcaccgctcttctatacagtagtgaaaacgagaccacttcttcctcctcctcactgctagcctagggttcttgcggagaccagttcccatcgattcttccatggctccagcagcggtgaccaaggaacttgcagatctggtggccagttgtttctttttccagtaaaagtcctgcatttggtgatctgttagagcgtagctctgaccgtgagagctagcaggtaagtagaaaaagaagagtactttgtccagatctgaagggaatcaaaatttctaactctctcctttcctctgtgcgcgtcagattgccaagcccccacaatctttgccacgattttctgcagcaaggtgagaacacaatcgcagtttttttttttacttttcccctctcttgctgctttgttattcaaggatccatagagagtatgcctattagaagtaaaactatgtcaaaatgtgtgctttttttcactagtttctttttttttcctttgtcgtgtgatgctcagatggatctagattctactcatcagtatattgtccatcaacgaactagaactttgggtgttttagctgttgtgttggcaattattcgctggcgacgtcgtataagaaatagacgacatccaaggaagtatggtccattggtggatagagatttggtcaggaaaacaagattagatgatttgtacaatgggagtgatacaacttgcatcagtcagcttcggatgaggaaagaagtgttctggaaacttgcctccaaattacgtgataatggcctactatgtgacacaatccatgtctcagtggaagaacaattagctatgttcctgcacacagttggccacaatttaagaaatcgtgtgattggattctatgtcataagatccagtgagacagtgagccggtacttcaatgaggtgttgaaagctttatgttgtcttgctaaagatatgatacaaattaggtcaatagagacccattcaaagatagttagtaatcctggcagattctacccatattttgaggtatctcacgtgaaatatacttattcaacattctaattaatgtaaccactttatgtttgtatagtaataatttcttctaacttaggattgcatcggggcattggatggcacacacatccctgcatttgtcccagagaatatagttaacaggtttagaggtcgcaagtcctatccaactcagaatgttcttgctgcggttgactttgatttgaggtttacctatgttcttgctggatgggagggttccgcacatgacttagtggttctcaaggctgctcttagaagatcaagtggaattcaaatacctgaaggtgtgcatgaagctttagtattttcaggtgcacaatattttgtgacaaggcaataaaaccattcatcttctgttgtaggcaaatactatttagccgatgcagggtatgcagcaagacctggtatactaccaccatttaggggtgttcgataccacctgaaagagtacgaaggcgggaaatcaccagaaacacctcaagaattattcaatcttcgacattcctcccttcgcacatctgttgagagagcatttggaaccttaaaaaaccgtttcaaagttcttgctagcaagcctttctttccatataaagtccaagtgaagatagtaatagcgtgttgtgtactgcataattggatccttgataatggtcctgataacatcatatatgatgaagctcgttggtatagtaagctacctagatcagctagagtagcgacagattatggcgaggagcaccaacagtgggtagaatttcgagaaaatctagctaatattatgtgggaggaacattaacagtggtgttgtatggcatggatattgttctatgactgttagctatttctaatgaattcttctttcagctcttcatattatagcattttctactttatgtttttttgttggatgccattattacctactgtgcattgctttgtagttcataacatggatataggaggaagcaacaaacatggcaagggaaaaagtaaggcacgcaaaggagttgggggatcaggtgtga

SEQ ID NO: 12499 - DNA, 7221 bp, Oryza sativa
cagacagtgatgattgcaaggaggtggcagcccttaatgcagcaactgcagcccttaatgcagcaactagtcaagtttcatcttctcataccagtggtctgaagccaaacaagaagagtttcaaaaagtgtgggaagccaaagaccttgcctcaatcacataatgataagggtaagcttaaggcaaagtcatcatctggattgcatgatgatgatgatattgatgtgctgatcactagtaccttggttggaatcaaagataaccttgccaaaccaatacagactgcagcccctcaagatccaaatgcccctctatgggacatgctcaagaagattgccttagaacctgaagataaaatgagagttggactacacctttgcaagccagaatttcaagctcatcgcagttttcttattagcatgggtcaagaatatcttgaacgttgggtttacaagttcttatctggtgatgatacaggcctctagtgagctataggtgcatattggttgcaaaagctaatcgtggttgatgagggtctatattttgctgcacccttttggtcatgcaattgccgcactatatatgtgtttagacaattgctaaatattaacatagatactatgatgatgcatgctgtgacatgctaatctgctagtagtgttgctttctaacttttggacaagttgataaccctagctttgtggcccttttcttttgtcttgtttaactcgtggcattactggctagaactgatctgtatgatggctgaaacttgatgttaaatatattcactatttccctgttgccatttgcatgtttaacaatatgtgatgcttttatcattaggaaatggaagatcgtttgacaattgtttggcaaaatcttggtagagggtactctcaccatctacatagtatacggtgagtgtatgctcaggcagaatataagccaaacactgcctaacccttatgtccactcaggcatgttctcagggcttcaaccaaacacctccttaaatttgtgtcatgcctggacaggtactttctgcaagcaagctcaggcagccctcagggatggaaaatactcaggcaggttgctcagggtagcaaccaaacaggcccaatgtgactagtatgacttcaggggtgttgtggggaaaaatatctagaaatagccatcccccaattccccttgtcgtggggagccccccaagctgtgccactgcgtgtcagcgggagcagcgtatcctcctccacctttgctgctgttggtatttcttaccgatcacagataaaatccgcaagcgcacggatataccgatatagcacttcccctacggagtattccaagggtatcgaatccaagggaacgtgtgtgatcagatcttcctctggttcattcaaggacaccaaggaaatgataggccaggatagagaggatttactggtgagaaacaatgtctagggaaagcttaactttaatcttaacgtaatacttcaggcactggcaatccgctattcccagatgtcgctatagtatgtacctggacagagaggacttaagtgctcttgagggctgtcaccacctctacacctacctcaatcgaactgtgggatacgcagcaaccactagaaattaattacccagacaccgcgtctacgcaattaataactactctagtgccaagagataattctcacaagatgtatgctatttaggaactaaccaagagataattctcacaagataaatctaaattactcaggaagaatattatattgaattcagagtaataaacagaataaaagaaatgagagaagattaccgacaactccggaattcttccgacgtcttctactctactctcttcctattctagtatacaatatagtacaatagagcctcttataattcagctcaagcttggaagtgtgtgtgagagtgaaggagtgaagctccttttatagggcagttatgacggttgtgagaaggggaaatgtccgaactgccccgcaaccgccatcaggagatcatctggagcgtccacgccaaaccctaggatcaacggtgatcaggggggttcggccgaaccatggggtacagccgaacctgggctaggccctcccggcctgtggactccctggactctcctctgtccatttctcggagtttcaggttgattttctggtattttgatgaagttcacaacccatccttgtatggatacgtaattctcctcactttagtctagatttcctcccaaccccagggtttatcacctgcatataaatatacaccaacgcttgtggaatttgtaaggttaagcacctatcactatgttggatgttttattatctggacttttatgcagatgttggcggtatagaatcgacatttaatagctgccaacaaaaccccccacacttagctctttgctcgtccctgagtaaaggttagtgtagaatgaattcctttaagatataaatcaggcatataaatcattcacaaccatacctgcacctgtgagctttaccagtggctatcttaccatcttgagtaattgataaatggaacgatctcgattccagtccttcttgcttcccctgtcaaactcatgtgattttttgatgaattttcacaaaccaactcctttccttatattgactctctctctctctcttatctctcatggatgtatattttctttttggatcctcaccaaggcaaaatgtgccagaatttacccctattctaaggctgatatgtggagctcggtagggacaaattgtgacatacctgcatcatatatattgcaaagccaaaaatacggactcaaaaagatcatcagtcatactcctagataaagggtctttatttgtggtagaaaatggaaaagtaaaatatttgtggaatggtggaataaagaaatgattatcccttttttttatactttctctccattttgttttcttggcatgaatatggaaggggcatggctatatttccttttcatcatgctcaatgttttgaaagcaagctttatttcctccccattttttaatagccatgcctttcctcccttttctcatttttcttttttccaagaaccttttttttaggagaaggaagcatagtctaatgtaggaagttatttgaatggaatttttgtgggaagccaacttccagtgtagaagcttagcttaattatatttggggaaaatgaaagtggaaatgaccccttgatcatgagagtatgaaaaatatctaacacgagtcacataaatttgacaaagctcattataatgtcaagtagtcatatgcataactaggggattccccgtgctttgttgcgggagttactaagtaatttttaatattatttttcgttacaattcagctatgagtaaaaaagaaaaaaaaatcaaatctcagagcttatcaatatttatcgtgaaacaaatgaaattcgcactttaatttagaacatgttgataagtgtatattaaatattataaaaaatgaaagagagatttgtaaaactattgtggaaatgatgtgagaggtggtgattgaatatgcttacatattaatttgtagaattaaatagattatagatgctcttgcatgcttgcatgaggttgaatatgtaattattgttagtgggtgatgatgtggcatggttgcatgttaagctttagagttagtgggttataactttatagaaagtatagataagatttatcaatgatatacttgcatatggccttggtaggtataaaatgaagtcaattggaggaatgagattttaaaacaattttattttgaaaacaaattcccaaaagtcaaaacaaaagttgcaagaattcctttcatctttaatcatctcacataaagcaatcacttagatgcataagggtccataaacatggatggttgttcacaagcacaagttcaactgtgaataatgaatatacaagatcaatcatatgaagaatttcattagttggaaatttttattttttcaattatgcttgaaccaattgttttctgaattttcagctctatactataccatggtggagatatacagataaaagatgtgctcacctgcttacatgtgaaaattaagagggattggggcagctttggttcagccgaaccaatctggtgcccattccctctgcaatttttagtagagttcagtgcttccaggtgttcagaaattttagcaattttcagagtatgcgcacgtcagaagctgagatatctcccccacacttattcaaaacctgaactttattaatcatgaaacaaaaacaaactcgacatgcattggggttaacaccaatgagccacattatttatagcaagttcttacatgattggaaaaataaaaagccagcacttactactattttattcatgtgagaggagacatctaattagcataatacttattctcctttcccgtttcttcaaatgcacacttgattttagcgcacaaaccgcgactaagggtatcaaaattattcctaagttcagcaagttctacccctagttccgtgttgcgatccctaagctctatgttctccttgcggagtttcttcacttgggcggcgagcttatgaaccgagggctccggtgatttcactttatcttcttggaattggccggctgcccttacaattggagggggcatcaagtgacgcttcaccttcataggtggagggcttctggattccgctgccccctccttctccgacgccgtcaaaggctgaagtaaacccttaccatacccaccgccgggagttcgcactccctgaatgcaaaaccggtactccttcggagtggatggagtagcggtgggtgtgatatatttgtggagcacttcatcccctgccttggtgaacagggtgcccacatattgctcggcgggaggcggagcgatcttctcatcatcctgaaaaaggcggcgtgccttcaagagaccgagctctcccgttgtcggccgtcgcgcaggcgaatccccccggattttggtcttcgtgacatggcgaggagagagggatcgtgctactgaacaggggaccgaacggggccgaggggggttcggccgaacccttggtttggccgaaccagggagctcgccgacgggctccagattcgcgcacgggagcccgacaccgtagcaaggggctgcgcccacagtgcattcaccccttccattgtatagtgttccactgggatctattgtttcgccggtgttggctctccgtcaagattgtaggtagagttggaggaggagccaatgtatgggatcaaggacttgccagccattggtgaattggaagtgatggagcaagggaattgagatgagatggagaggaggattgcaaaagtgggagagaggaggaagaacaggtgctctgggtctgatacgactaatctacctccgaaagctcatcacaacggactgcaaacgagcgggggagactgctattcaaagttggggctgatcgggtgccgcttttatttggctgaaccctggtgggtccgactggccgccaactttttcctaggcccactaaatcctaagctaagcacaaaaatgacaactttacagggttttaagcatgcattagatgagatcattatggttcataatcgattaatacaataacatccacttattcatctaaagtttcattgggctcaaggaaaatctttaagcgttgaccgtttaccttgaatatattacctgagtcgtagcggagtgtgattgccccgtgcgaagaggtgtctatgatgtcgaacggtccttcccatttactgcgcaatttttcgtggccgaaaagcttaaccctggagttgaacatcaatactttgtcttctggcttgaatttcttgatttttatccttttatcatgccagtgcttcgtcctttctttgtatatgttcgtgttgtgataagccttctctctccattcttcaagttcagcaatttgcatttttctccattctcctgctccttcaaagtccatattccagttcctaatggcccaatatgctctatactcgagttctacagggagtcggcatgatttcccgtagactatctgataggggcacattccaatgggtgtcttgtatgctgtccggtatgcccacagtgcgtctggcaatctatccttccatcctgttcccatattgttgaccgtcttttgcagaatattcttgatttgtttattcgatgtttctgtttgacccttggtttgtggatggtaaggaatggccacattgtgtttggctcccatatctcgtaggaggtctcggaaggttttgtcgatgaagtgagaacctctgtcacttatgaccatcctaggggtaccaaatcttgggaagatgatttctgtgaacatctttttggcatgcttcgcatccacggtgttgcacggcatagcctcaacccacttggagagatagtcgactgccaccagaatgtactcgcagttacgggacttagggaaaggttccattaagtctataccccagacatcgaatatttcgacttgcaaattgtatgtgaggggcattgcatcacgagtagtgattcctccttgcctctggcagcttgtgcatcttctgacgaattcttttgaatcttcatacattgttggcgagaagaagccactttgcgcaaatcttaccctgggtgccgaatgcaccataatggccaccatagggtgaggcatggcatcgctttatgatcttaagtccttcttcagtcggcacacatcttcttagtaagccatcggtgcagaccctgtataggtatggctcatcccatatatgacggtgactttcgtacttcaaatttcgttgattttcccctggtggtatgtatttggataccatgtaattcactatggttgcataccacgggttggagtcgcgaaccgtcatcagcatgtaatctctcaagaagtcatttatcggttgttcctacgtgtcagtgatctgcagcctagacagatgatctactacggaattttcaactccctttttatccttaatctctaagtcaaattcttgtagcagcaaaatccatcttaagagacgtggtttagcatctttcttagtgagcagttactttagagcaacattattagtataaactatcactttagctcccaccaagtaagatctaaacttgtcggtagc

SEQ ID NO: 12500 - DNA, 600 bp, Oryza sativa
tcctcaatcatgtcggagaagatagacatcatacacctttgaaaagatgcaggagcgttgcacaatccgaaggacattctctggtcctccgtatgaatgggatttgatgatacccggaatacccatcaaggaaacagaaaaacgaatgatttgccagccgttacaacctctcgcatcgcattattgagccgtcattgaggttccctagagggagtactctcagggtcaatagggatacgatgggtgcaaagtgcgggattgatccctctgagatcttgaagggaatagccaagaatagaacgatgcttttccaacactgttagaggacgttgaatctcgtcttcggagagcttgtcactgattatgacaggagcttctctatcattatgtaggaaagtatagcgtaggccttgaggtagaggtttaagctcaagcggaggtcgaggtggcggttccatgattggcagatcgagagtctcaccgggttccgcttcttccttgatgaagtcagggacttgatcttccaggagggcttcaggagactcgtgagggggaactgctgtaacctcctccgctcactcaatttctgtgagagggtcg

SEQ ID NO: 12501 - DNA, 1194 bp, Oryza sativa
taaaggcttggtgaaaatgtcggctaattggctttcggttctcacatgggtaaggcatatgtctcctttagtctcataatttctcaagaagtggtggcgaatgtctatgtgtttggttcgagagtgttgaacgggattattggctattttgatggcactcccattgtcacataggagtgggatcttggtgaagttgtagccaaagccttttagagtttgtttcatccaaaggagttgggcacaacaagaaccgacggcgacatattcggcttcagcggtggataatgcaatggaattttgcttcttggaggaccagaaacaagggaccgtccaagaaattggcaagtcccggttgtgctttttctatcaaccttacacctggcataatccgaatcggaatagcccaaaagctcaagtcacaacccttaggataccacaagccaagattaggagtatgaactaaatatcttagaattctcttgacggctatcaaatggcactctttaggctccgcttgaaagcgagcacacatgcaaacactaagcatgatatcgggacgagatgcacataagtaaagcaaagatcctatcatggagcgatataccttttggtccacacatttaccattatcgtcgaggtctaggtatccattagtaggcatgggcgtcttgataggtttggcatcctccatcccaaacttcttgagtatgtcttttacgtacttggtttgagagatgaaggtgccctctagtgcttgcttcacttgtagcccgaggaagaaggtcaactcgcccatcatagacatctcgaaccttttagtcatgatagtactaaaatcttcacaaaaagatgaattagtagaaccaaatattatgtcatcgacataaatttggcatatgaataaatcactcttaaattttttagtgaagagagtagtatccgcctttccaatttcaaaaccatttttcaaaagaaaatctcggagacattcataccaagctctaggggcttgtttgagcccgtagagcgccttgtggagcttgtacacatggtttggcaactttggatcctcgaaccctggtggttgctccacatagactaactccgagataggtccattgagaaaggcactcttgacatccatttggaataacctgaaatcatggtgagcggcataggctaaaagaattctaa

SEQ ID NO: 12502 - DNA, 1555 bp, Oryza sativa
ggttcttcctctcaacaatgccgttttggggaggatcatagggggcggagaactcgtgcttgattccttcttcatcaataaattcttccacttgagtgttcttgaattctcctccattgttgcttcgcaccctcttgatagtgagatcatagaggttttgggcttgctttgcgaagcgcttgaagacatcttgagcttcgcttttgtcatggagaaagtacaccccaagtgaagcgtgaaaaatcatcaacaatgacgaaaccatacttgttacctccaatgcttatgtaggccacggacccaaataaatccatatgaagaagctcgagcggtcttgttgtagtcatgatgttttttataggatgtggactcccaacttgcttcccggcttagcaagcactacacacacgatctttctcaaaagaaacattagatagaccaagaatgtgttcccttttagaagagatgccaaattcctcattccaacatgggctagcctacagtgccatagccaacccatagaggatttagcaatcaagcatgcctccggattcactctatctacatcgaaatcaacgagatagagatcactctttaacacacccttgaatgctatggaagagtcatctcgcctaaaaatggtcacatccacatcggtaaacaagcaattaaatcctaacttacacaattgagacaaggataataaattgtagcttaatgaattgacaaggaggacattagatagagattgattcttggaaatggcaatcttaccgagacccattacctttcctttaccatcatctccaaagacaatattttcacgacttccaccctcctcatcaagacttgtaaacatactcctctctcccgtcatatgattggtgcagccactgtccacaacccaacttgagccatcggaggagtatgcctacaaaagagatcaagcttgggatttaggaacccaaacttgtcgaagtttgggtcccttgatgttagtcaccaaagcctttggcacccacacacaagtgcggtactcatcattgtaattcccattaaaataagcaaccactttgccctctgaatttttggaaattacatatgaatcatagtaaagaccctctggccagaacttcctggcattataaccggaacttccggccagccccttcggcctatcagaagcccgaaacttcctgacaaaatgtccggaacttcctgtcttacagggcaggaacttccggtcattttgcccggaacttccgggtgtctgaccagtgaggggacaagtcacctcacttgcttgtggagcttttccttctcttacaaacatcaagcattctttcccatttatcatcacacgcttagacacaggacttccaccagaaaacctgagcccgtgtccatccttgttaggatgagcggtgatggtcttgtaaagggcatcttttgaatggtatgtcttcatacatccatatttcaccaatgtgcccaacctttcattttctttcttaagagcttgcatagcatcaacattagtagcatgagagttcaa

SEQ ID NO: 12503 - DNA, 4292 bp, Oryza sativa
ctagagaaccattagccaaattaagctcattagctagttgttcatttttagcacattctttagctaggctctccactaaggcaaggtttctttccttctcaagaataagtaattcttcttgcctttcgagagattgttctttactatccaaagctctcattaacttagccaaatgttgcatagcgggtttgctaaaactcttaagcacatcatctaattcattatcactttcctcatcactagaatcaacatcaagagaggtatgagagggcttttgagtcatcaccttgtggccttgggccatgaaacaagagtagtggtaggagtcgtcgtcgtcatcactcaagttgttgaagagacgctccttgcttgaagaggatgacttgaaggcgacagtagcaacaccaccttctccttcaaccttgtcttttggcttgggcttgggcttgacctcgagatcttcttcatctccggagtaccacacctctgccatgtgtgcctccgccacatgagcacgctccggcttcttcttgcctcccttagccttcgcttcatttgacttgagacaatcggcaatgaagtggccatattcgccacaattgaagcaagctctctttgattgcctctttcccttgtcatcatccttcctccctttgccatagccactcttgcgaagaaagtgcttgaatctcttgacaataaaagtcatttcttcatcttcactttcttcacaacttgactcttcttctagttttgccttcaaagctacttcttgatttttgatcatggtgggattcttcaccatttgcctcacttcacgagctgtctcttcttgcatctcataagacacaattcttccaagaatgtcacttggggtgagcctcttgaaagctttcctttcccatatcattgatacaagagtgggatttcttggaccaaaagcatggagaagtcttttgaccacaaagtgatttgtcatgtcctcactcccaagtcctttaatcttgttgacaaggatcatcatcctatcatacatctcttgtggtgtctccttgtcatccatcacaaatcttccaagcctttcttccaataattcaatcttggcctcacgaacggcgggtgatccctcatgagccaattgcaaagtatcccatatctccttggcctcctcaagcccatcaaccttgttgaactcctccggactcaaggcggagagaattggattggaagcttaagcattgcggtggatgagttgctcttgctccgaagtgagctccatgtcatcatggggtacatcaatacctatacaaacaactttccaaatacttggatgcaaaaagattagatgcaacttcatcttgtgcttccaagcggcgtaatgtgtcccatcaaattgaggagcacgcctagaaggcacggagacaaagttgtgagggggaatggtaagtttgctgtaatcaaaaggtatagtagctcccttgggtgatggagtttccttgctgctcgttccatcttcatttccattttccccgttctttccccctaaatccgacatcgtggatcactcaaagcagtgaagcttgaatcaagagcaccttgctctgataccaattgaacgcgctgatgaagtctagagggggggtgaataggctgtcccctgaaatcttaaaaacaaatcgcagcggtaaaatttcaaacagacctggaacttcctagtaaggaactccggaacttccggcctgccaggcccggaacttccggtgtgctaagacaggaacttccgggtaacaaaacagagatgaaattcaaattttgaaacaggagactaagccaatcttcacaagatggtgcacaggtattctaagcagaggatatatcacagaatcattcacagaaacatcacagaaagagacaagagcgattttttcccgaagttcgaatcttgcgatcctactctccgttgaggagctccaaagagctgggtctcaattaaccccttgcctcacttgtgcaaaaacccctgaggaaatccacagccttcaaccccaaacacccctaggcaaatttctagaattgagtgaccaccaagatcaaactcaacctacttctagaaatccaccacaagtgtgggttgctctacttggaaagcctctaaaatctcagcacaagaacttcaccaacttacctcgttccctttcggaggagaggaaatccttcacaaacttacccgggacatccacaatatgcaacggattctcgcgggcgacacctaaccatctaggagatcatctccaagagtaataagcaccgagatgacagcccacgagatattccaagtgctcacccaagatcctagtcttcacacatctccaaatcttcttctctccctctcaatctctctttctcacaagaattaggctctagattgagtggagaagacaagaaacacttgggagaggctagcaatagctctaggtttgaaaaatgaaagtggaatggccaaggaacgagctggaatcgagctgtatatgtatgacggctaggtaacgtcatctagccgttactcacaaatttgaactggaaactagacaggaagttccggacctgaaagaccggaacttccggactacacttaggaaaatctttttcacaagaccggaacttccggacctggaagacaggaagttccggacttgcatttttggacagatggagtatttgcaaaaatgactcctagggaaacttgacacttggttcacactaagagcacttgatatatctcagagcatcacctggaacccctcttaatagtatagtttttcctaaaaactcgatttcaaaagataaactatcctatgcccttctcgagttccggtccgctttgattttgtacttttttgggggtctccaagcatccatcttccacaccttagactaatgcacctgaaagtcactcaatgaactcattagtcccttaaccacatttgtcattaatcaccaaaacccactagggggattaatgcactttcacctacatcccgaagaagctcctcctggcccgcgtggcgtccatctcgatccactccccctctccccacgtaggacatgggcttgataggcggcggcgttgggcgggagccagagccggtgttagaggagaagcggaggagcgagaggagacgatgcggctgggggtggtggcggctagagtgggagaggaggaggcggaggtgagccatgcgatggcggggcgtggcggcggctggctttgggcaggccggcgccgccagccgacggggcgaggccgagcggcggggagttggcggcagcagtgtcgacgtggcctgctcgccggagcgctgcttcgccctcgcgtccctccgcgtcggcgtgcaacgagctgcacgaggatgcgaggaggtcggcgatggcgaactccctgggcgcatcgcggcggtggagggcggcgaccacatctgtcgcgccgtggcggcgctcatccgaccgtcctcccaccaccagcgccgccgcgctgccttccgccctcacccaagccacctctccgccatgtccgtcgccgccgctgcctcatcgagggaggggtgcgccgccgccgacaaggccgagcgccgtcactctccatccgcggcggcggcccgtgggaggaggacatggtggcgcggcgatgcgggagcaggaggcggcatctcccctgccggccgagcgctgccacttcccatgcactctcccctgccggtcgcgcgcctcccactctccctcggccgtcgtcgttcttctccccagcctgcttccgcctggccgctgttcttctcccctgccggtcgccggtcgccggtcgccggccgccggccgccggacctcttctcctctcctacctcaccatcctcgtcggcgccgcaccaagtcgtcgcctcatcgcccgtcatcgctccactagacaaggagcaaagtgaaagaaagagaggaaaggagagaagaggggaaagagagatgatgtggcatcctgacatgtgggacccacgtgggtcccacgctgactcagccgccacgtaggacaaatccggcgtcaaaaccactgagggacctcgggtgaccggttttgtatagttaagggaccccgcaatctagttttgtggttcgaggacgcttttttatctcgctgacaagttaagggaccttcagtgtacttttttccccaaaatttgactaaaattttctctttttttagttattactactccctctgttttaggttacaagatgttttgact

SEQ ID NO: 12504 - DNA, 1907 bp, Oryza sativa
ctgtggcccaaacgtccaactgcgcatggtgcatacctgcaagatggaaacactgctgtgaagcgtcgttctcaacttgttatcctctgtgaagaaatgaatgttaacgggcttcataagttcatatcagacaatcgcaaagacttaacatccatccgtgaggaaattcccgttgcacttaggggagcaactgatccatatggcttggtgttagcttctctagaagacttctattttggagacaatcttatattggatggtaaaaaggatggaaactttctgggtgtacggaggacgtgcctcatgttgatggaatcacttgctcagctgcaaactgatgctactactggtttcatatcaaaaggccaaatgcttactgctagtattaaggagagagcgaaaaagatagcgcttgagtggaaatccaagttggatagccttgactttgatgctagcaatgggaactgcctggaagcacatgcgtttcttcaactcctggctacctttgctatattttctgaatttgcggaagacgagctgtgtaagcttctcccatcagtcagtcgtcgtcgccagacacctgagctttgtagaatacttgggttgtcacagaacatgccaggtcagtgctatcatggattaatcatgcacctagttccgttatgtattgaccataggggttttctatttgtcattgtcactcagattgctagagagcttattcttaccacttcaacatttgttcatatatgaatagactatatcattggatttattttctagttagtggctgcagcgagaatatacctagaagtaatcaatattgcgacattgctgtttagatgatttatatggaaaatctgaaggctgctacttatgttttagtggctgcacatcttaaacccactatctagtatctgtattgttcttactggcaacaaaattcgagcagcttctaacgctgcgttcgaattatggactttcctctcacgcacgaaaaacgagggtggtttattagcgcataattaattaagtattagctaaaaatgaaaattagattaatatgatttttaaagcaatcttcctatatattttttttgaaaaaaaaaacataaagtttagcagtttgaaaagcatgcgtgcggaaacgaggtagtataagttgggaagggggaagaaagaacaccctaaggctgtgtttgatacttggggttgggaacccaactccaccgcacggaaaacggagcggtccattagcgtgtgattaattaagtattagttaatttttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagcctaagcatgctagtgcatggtctaaccagctcaattcaggactcaggagatcttaatgtcacaggatgttagttactaacttccgaataatatatgtaattgcatatagtatatattggattatagcaagctaatacgactttattcaatccctttttggttgaatttgtcctcccgtttgattatttactgggatgtgctgttgtgcatctcttttagaaaaaaaaatacacatatatgagtattatggttaatgttatgtagtggcaaaatgcattagaccttaaaagatgaatcaatcaagagttggcaccgacatggttttgaaatatataaccgtggaattgaacgattcaacttttatgctggcgctgatttacacatctatcaatttgcctaagattttaaactttctcaaagagttgtacagaagcaaggccctagttcgtgatatgttgttacagcttgtatagct

SEQ ID NO: 12505 - DNA, 573 bp, Oryza sativa
gaagcaaaatggagttaccttttttctcagatgcaaggtttacaaattccactgcaaagcttggatgggaacatgtatcctgtggttttctaacatgtgatttgttttcagtaaaattggtctaaactattttgtatttgttttctgctttccagttggtttccccgtctttaccctcatccattttaaaaattacaaatacaaaaagtttatatatgtttaaatttgtcgacattattttgacatccagaccctatggtgatgcaactaatgtttggttccaaatttcccatagcataaacgttgtactttgtagtcgtaagattcactttgatgttagattgtgagttgtgactagtagatggctgtgttctttcgagggtgttgggaacccttctctcctagcacacaaaatgaagcggcggattaacacataattaattaaatattagcttaaaaaaattgaaatagattaatatgatttttttaaaataaattttctctatttaaaaaaatatattatttattagtttggaaaggaaagcgagagagtagaagctaggaaagtgtccc

SEQ ID NO: 12506 - DNA, 12976 bp, Oryza sativa
ttgtaaatttgttttattttgaatttgatttgaaatttcagtttaagttctcaattgccatataatataccactttaatatttttttccaaattcaaaaaaattgcaatttaaacatatcttttgaagatagtatcagagacaaacagaaaagaaaaaaaataaagagtgagagagagaagaaaaagaagaagaaaaagaaaaaaatggttttttttttctctcgactattcactcttattctttacaaaatgacagtttcgtttgtaaatttaaagagtgtgagagagaagaaaaagaagaaaaaaagaagaagaaacagaaaaaaaaaagggagagatggggggtcgaaagaagaaaaaacggagaaaagaagaaaaatggatgaaatgggggatcgaaccctgctccatagggttagagtagaatcctactaccactatgctatcgttgagttgatgaagatgaatgcctccgtagaaatttaaatcatcaagacctcagcgccaaatatgatgactcaacaaattcatgccacctcggatttgagcttagcgccaacaaaagttggcgctgagacgttatagctcagcgccaaggtccatggcgctgagttcacggcctatttttggttgaagttttttgcagggactagtttcgaaataagtttttaaaaaagactaatttgttaaaaaaacggtggttgtggcggctccattttggggaattttttttgacttagattctaatttgctacatcaatgtctgaacccaacaaaccaacgtaggtgtccatcaattcatctagcaagaaaaatcatagcagcatacaagtggtaaaacatgttgaaggatacaaatatattacattgtgaatctatcaaatattaattaagagagccatcaatgcgagcagtgcttttgcatacgtagcaggtcgatgaccacatccaccaccctagaatccattgccacctctagattggtgcacccttcctctccactaccaccattccgccatggctccaccctcattccgccatggctctaccctttgaagccctgccactaccaccatcgctgaaaaaaaagtaaagggaatatagggactcacctacgctggctagtaatgatgacaatgatggacgaggcgttgctcggtcgatccggatggggcgggagctcggtaagaagagagcaacaccaaagttgttgtttctctttccaagatagcacacatgctaaatttaaagatagggttggtgcatctactagattagctgctgatgttattgctgttgatgagggacgaaatagataagcaagcagctaggaatgctctaagcccgtaagtgtcatgattagctggtaaagaagctgatgtgttatccgtgagtagaatgatgggttttttgtccggaaatcatacgttacaaactgttttagatcttggtctaaaaacaagctcaatcaaatttttgactaggaaatggtgcaaatcatatcaaaggttcagattgttcctcaggataatgaggacaaactctattggattcctacttcttcaagagcattacttcaaaaagcaattataagcaggtttctaatatttctcacttccagttcgtttccactgcaaggagcggataaaattttggatattctcggcacgcttttcaaactactaaacagtgtgtttcgtgcaaaaactttctgtatgaaagttgttctaaaatatcagattaatctattttcaagtttgtaataattaaaactcaattaatcacacgttattaccaccttgttttgtgtgaagcacttaatctttatctttatcttgtctcctctaacatcacctctttacagagtaatctccttttgaaaacttggtccactaaatacattccttctaaagttaaaacttttatttggagactaattagacaagctcttccaacggctgcaaatcttcactcaaaaattttggatattcctgatttttgctcccgttgcaatgatgctgaaaatgttcatcttttcttccgctgtgcttttgcaagacttacctggaaactttaagaactctcttttcacaatctcattattgactcaatgcaaaatgtttctaatattatagcatatttgcttgcaactaataattctgaaaacagccttcaaaaagttccaatccttctttggtttatttggaaagctagaaatgatcattatttcaagaaaaaagaatgggagcctttgcaagtttgtaatgtagcaagcgctatgtcaaagaattatatttcagccttgtctaatgagaatgataatgaaactattccaatcatagatgaattctgttgcttctgttaatttgttgccagtaactggatgtttccttgacgcttctgggaaggataatataacaaggtttggtcttttttctacatgactctataaatcatcatatcatctttgtgtaggccaaatcaactctttatgtgtcgccaattcaggcggaacttgcaacttttaagcttgataccttcatctgtgatttccttcaaattacaaatcctccctattttttcaagacaatcaagaactggtgctcttacttcaaaactctaataatatcaatcataaccatcactagagccttttgcctttgcttgcacaattacataacttttcaggtggagcttctttcaacgtcaaatggatccccagagatataaataaaagggtatcaaatagctgactactagtctaaaaaagccagagaatctaaatatgagttagcagctctaaattaccaaaatattagtcatgcttgtaataataatacttgtcctacaaagcaacttatgcaagctactccttggaaagacaattgtgtatctcttgtgcacattttccttctaatgtttaaataaaaaattactaagttgtaaaaacactgtttttagagcacatggcaaaccgcttttctgcagaccgaggagtaaaaagactatcactgacagatgggacccaccaaccattgtctctcactctctcccctcgcaccgcagcttctccaatccgtcactttccccatccctcccgcgaaaagcagacagacgcccacaacccaccaccacgtctagggttccgccgctcctccggccgccgccgccgccgccgccgacccccctcgatctcctccccgagccgccataggtggtggcgggggcgggggagctagcatccgtccgtcaacgcacatcgtcactgctgcttcctggtgagcatccatccgtttcgcatatcctctttctcatccctctctacccacccactttttcccctcgaattcgcgtcaaccctagcttctcttctagatctgaaagctgctgcttttctttcaatttgctattcttaatacgaataacagtttcgtttgttccccaaaaaaagtttgggatgaatccccatgtcccacgttagatccgcccctggttttatgtgcggtattgttgtttgtggtatgggtaccaacagctttcgttgttttcaccttttgcagaaatctgccaccatgtccgacatggagtccatggctacacttatggagtccacaggctccaagctgcagcagcttcagcgtgcatttgcagagctcgagagccagagcgctgtttccttgaacttaaagtggaagcaactggaggaccatttccatgggcttgagcagtcgctcaagaaaaagtttgatgatctgaaaaggcaggaagaggagttcgaggagacggttgcaaagtcagagcagatgctggagcaacaagaggctgttgtcgtggcaaaggaactgacttctcttgaaaaactgcagcagaaaagggatgccgcgttggctgtgatctttggcaagtccaagctgaacttgtctacgcctcttatcaacccaatcagcaaatccgtgaataacaatgctgtgtttaatggaaacatcggtggtagtctttctgttaagtggcccaaacctgcaactgcgcatggtgcatacctgcaagatgaaaacactgctgtgaagcctcgttctcaacttgttgtcctctgtgaagagatgaatgttaacgggcttcataagttcatatcagacaatcgcaaagacttaacatccatccgtgaggaaatccccgttgcacttaggggagcaactgatccatatggcttggtgttagcttctctagaagacttctattttggagacaatcttatattggatggcaaaaaggatggaaaccttctgggtgtacggaggacgtgcctcatgttgatggaatcacttgctcagctgcaaactgatgctactactggtttcatatcggaaggtcaagtgcttactgcaagtatcaaggagcgtgcaaaaaagattgctcttgagtggaaatccaagttggatagccttgactttgatgctagcaatgggaactgcctggaagcacatgcgtttcttcaactcctggctacctttggtatatttgctgaatttgcacaagatgagctgtgtaagctacttccctcagtcagtcgtcgtcgtcagacacctgagctttgtagaatacttggattgtcccagaacatgccaggtcagtgctatcatcgattaataatgcagcttgttccattgagcatcaataataaatggaattttctatttctctttgtcactcagatgtttagagaacacattctgaccacttcaataattgttcatatatctatatatctataccatgggatttattttctagttagtggctgcagcaagagatgcctacaagtaatcagaattgtagcattgctgtttagataatttgtatggaaaatctgcaggctgctacttataatttggcagccgcacaccgaacctcactatctagtatctgtattgtacttagtggcagcaaagtttccacagcttttaagctatgttatatgctcagttgaggtcttaatttaactgaatgtatttactaacttataaataacatatatgatcatatattctggagcataacaagctaagaggacgtcattcaattcgccgaccttgcccttgagcttgattacatactgggatgtgcttttgtgcatctattttagaaaaagaataatacgaatatctaagaaatatggttaatattattaggaggcaaatatgcattaaacaaaaaaagataaccattgaaagatttgccacccgcatggttttgaaacagtattaacctagacgctagtcagtggtcggtcaatgactagcggctgttgactagttagtaactagtcggtggttccaatatgtccaaaaataaaatattgctcaaaagtagctagccatttaacatgttttatagcatattttcagatcaagtactgactattgattattgagaaatataagactgacaatttgataagctgcatgaggtgaaggcgagagagcacgtggcggctcttgactgctccagacgtgtcatgggagggaataaccataggacctttcccacccctcttatcccacccgtttagcccaaattttcagtccatgccacttttctgtttcctagttgacctgtttaaccgactagtcacttgactaatattgatcaacttgaacgtactagaccgattttaaccaactaattcaccttttaccccctgacctaggtggattgttgctgactagtgactagtcaccgaggtccctttgctccatacttttaattttgcctttcttcttttccgcctttctgctgctgcatgttcttttcgtttttacaggtcagcacattttctcatgagatattttcttgatgttaggtgtcattggagttctggttgaaaatgggagaactattgatgcaattaatttggcttatgcatttgagctgactaatcagtttgaaccggtggaattactgaaagcctatctacaggaggtcaagagtgtgccacatttcaagactggaaagatatctctgcaagtacaggtgcacttttttcatttcaattttaaactgtatgataccctgtaaattttctttcacagaaccagggttcaagattgaagtgggaaacatagtaatcctggtctgctctgattttctttttttttaaaaaggcatggtttaatttagttccattttttccctcgaacatgcaggagggaatttagttgcgaaaattatcactaagaatttcaaaaccaaacactaaatcattgcaagacttcccttaaaaaaaatcaatatacacctgtaaaggctgagtgaaaatggagtcgaaatgaacaggattgcttgtagattgtagcaattctgttcgatggatcggttgccagttggtgacacatgcattcattctctaattgaatacgataaaagttcttttttcgtgaaaattacgacaatattgtgctggagtatttggactgaaagcaacttgttctctagtattctttcatgtggcaccatgacatcctgtcactacaatccacaaacggctcctcatgcttcatacctagtatagagattgttccagaatttccttggattgactagtttggatgggatttttcttagatccatgaaagtgaatcccgtgtagaactactagttacaccaactctgttaagaagctctgaaccacatgaaagtttatttttttcagctcgtggccctttgccaccataaacaaagttccagttcttttttctaacaacaggatagcttaacagtcttttaggagattatttagtacttgctctgtttttaactctaagctagtttcacctgtgcaactgtttgaactttctaattatgttgtgtgatccagcactccagctgatcgtgtttgaaaatttcctgatataaatggtaatgagacatttggccctttcagcaattgaattcagctactttgattcattaggttctatggctgtcaagtcgtatactgtaattgttcactcacttatttgatttatttatcctggaatagttaaagtacggggtttgatcatatcataaagttagcaaatcatttagccaccaatcagcttcaatgtagaagctgcagtgctgttctgaagaacttgaataataaagagctactttagcttgcaagatactattcagctatagttgcttgctaccttttctttcttgtgtggggtaacaaatattttctcttcttgctggtctgtacattttttaagcatatctgcgtgcattcctaattaattgtgattgtagtatatctgatgaattaccatattattcagaatgaaatgaatgaacgagagctgtctgccttgaaagctgctattaagtgtatcgaggagcacaaacttgatgagaaatatccgattgacctgcttcagaaaagagttatccagctagagaaagctaaggcagacaagaggagggctgttgaagctgcaaagccacagtctaagaggcctcgtgccaatggatccgtatatgcgccacatactagctttcctgacaaaagcttctaccaggctgctccgccgcagaggcattcctacccttacgagaggcagtatgtgtatggtgctgaggcccatcaccatcccacaatgataagctcagctccctatggcatctcacctgcccacacaacatattatggtaatggctatcaggttcagtaccaggtaccatatatccactgatggagagagcgtaatgtgctctttcctaactatgtactagcttttaacctgctgctactatgtgctgtagttgtatcaatccactagctagactgcctagcttaaattagttcgaccactcttgtgtgtgctgagtggccagtgtgaaaatctgttaatttccctcacgacttatgacataatttacttctaatgtctagttaaaataatttgcttttgtttaatatatagcctatggcatatatatgttggagttgagatagtcccagtactgcagaattctggaattatgtgctctgcttggtggaattatccactaattcctttctgttgcacttgaaacaaaattgttgtcccaaatctttttatttgatgatggtagatttttgtattttacgagttcaactgcaaagctttggatctactatttcaatgagtgtgcctggagtccaatcgactcaattaagtaactgttagttcatattgaggttactaatcaaatacagaaaattaatcatggtagaatatcagatgacccctggatagtatagtactatctcaccaatcatgtcatttaattcctttatttttttgttctgtacaacgccgccaaacattggcgttgagttcttatttggggtggcacgaatttgcttatttgctttgtcattggagctcagtatcatttagattggtgctgatcttcgttctttctaaaaccagggtttacttacattaagcaaagtatagcttagcgttagatggttttggctcccaactatagatttgaaccccaccctcatttctacaattagtttttttttcccaaaaataagggtcttgaaagggccataatgccaaaattttagcctatataagcctgatagattaggctccaatggatgatacatggtagtactaccttcgtccagtatcatatagatactgctagcatttaaattttgtcatataatataataactacttccacgtctactttttcatcttaaccaatcgcaaattcgcaactctctaatttaaaatcaccctcattccttaatttcttgaaaaagaagtgcagaagcatgtccaatattacttcacattctaagctaatcacaatcctctaatttaaaatcacccattctttaatttcttaaaaagaaagtgcataagtccctacagtataggacagagggagtacataaaaaaagggaagtgcacaactcctggacagaaggagtacatctaccacagagggtgtcgcatgttagagtgtgtttggtttggtgaatgatgttggatgggagatagaccgtctgattttttttttgttttgtttggataaagagcagggtggatggggcaacccaaaaagaaaatattcccttaatatccttaatatgctggatgagtagatccagctaatttggccaaataaagccatccatgttttaatttgggtgacttggcctattccaattggatgtggttggtttaattttctgttaacaagcttaaaatgttttttcctcctgaactatttatctaatttgtaatccgattatactattatactaattacaattaaatctctagttatattttgataaaaaaaattaacaaatgtgccatactaaattgtggcttatcccattcatgttatatctctctaaacaaataagaaattggaatcatcctatccatacaaaccaaataaaagttagatcatcgtatccaacagagcatggatgaccatatattatccatgtatggctttgaagcaaacgcaccctatgtgatgggatgtgatatagcacgaagaacatagaacattaagatactgagtaaatataccatgttgaaatcaattgccaattataccccttaaagaaaaggcaaataaacgaaaattgactaagacatctatatatatatataaagttttcgcaactaatgttgtcacgaagaaacaaagaaatacataattctatatagcttatccagagggggaaaccctaagataagtataataaaagggtggttccaaccgttctgtttcctcttcaaagaatagaaaaaagaatcttttttttaactaaatttgacgctgttcttaattatgatgaaatcattcttagctttttccgtggattatggacaactatattaattacaaagtaattacatcaaaccaccacagaaagaaagaaaaaactcaaagaactacaaatcattcacacatctatgtttcttatttgtaattgaccagccataccaaaaaggaaaaaaaaaaaacaaattcgacacactctgctctgtagagtgtagattgactgactcatgcatcaagccattagcatcaatgctgctacggcggcggccgcggcggcggtcacccaccgggcgagcggcgccggagcggcggcgcccttgtgggctttgacgtcgccggaatcgtccgacgagtcgtcgctgctgtcgtcggccgccgacttgtgcttcttggacggctcgggcgcgggcgcgggggcctcgacgaccttgtagagctccttgggcttgaggaacttggtgacggcgtagacggcgagcggctcggcgtcgccgacggtggcggtgacggcggagttgacgaccctggtgtcgagcgtgacggtctcgcccttattctggacgtcgtagctgtagtccttcttggactcgctggcggtggcgagcgtggtgaccatgccattgttggacttgaggagctgcagcgagaagtagtccgggacggcgtggtagaggaggatggcggtcttggccttggcggtgaggttcttgtaggagggcatgaaggcgccgacggcggcgtcgacgggccaaaagagggtgaggccgttgtccttggtctcgttgacggcgcgaaagacgtcggcgttggcggcgaggaggccggcgaaggacttgcagtacttcttggagaggagctcggtgaggttcaccggcgccggcggcgggacgggcgcctcggcctcggaggaggacagcacggagctcacctggagcacggagatgtcgtaggggatctccttcaccgacttcacgtacctcgacggcttcgcgctctcgtccgcgtcctccgagatgaagtcgatcttcccgcccttgtgcgacgtgatgttcacgtaccccgtcgtccccggcgccgaccccgtcgcctgcatgcaattttattttcattcatttcaattaattcatcatcgtggttattatttaattaatcatcgtgattattatttaattgtattacaaatggacggatcacgtggagcatgaaaataacaaaatttgtaaacactggctgtaaacttcattaattggttcaaaagcacaaattaaagagtagtagaaaattggattaattatctttgaacttcatcaacaccgaaatccgaaagcaaataatactgagggcatgcatttttgtgttcagactaagatggtattcttgtaattgtgaaatatgatctgtccatatgacaaaatagacgttgagtctccattgacaaataatatgatctgtccaggatggctcaattaattaatgagtatcatatttttttttccagagaaggatggggaacctaatcgtggatgatggatcctctgtgatttgtgttcatgatgagtgatgactgataagtgcgtatgcaagggcccacaaatcaatcatgcaattaggtatgggaaaaatagggagtgagcttgataatgttgagagcaactggatgcatgaaattccaatcctagctaaccaaccaactttgtcggtggaatcggtaccacgtgttttcttagtcatcttgggcccaccactgggcttagctgttcttcagtgacctggcacccaacggcatgcatgtgtggattttggaatttctagttgtatatgcatcgcgcgcatgacaaaactttgtcaaaaagttttatggcaacttgatggtgccattcaaacagctccattaattccacttaattgaattaagaacatccctactataattaatacggtgaaatatatactcccccaatttcttaatatacgaggcagttgatttttttaagagatgttctaccattggtcttatctcaaaaaaattatgaaatcaagaacattcctaccactgcgacttgatttaccaccaaatgttatttaagtgtgacttatattgttttatgtttaaacaaaaatgttaaaaaaacgaatggccaaatgtttatcaaaaagttaaggacatcatatattaaaaaaaggaggtagtatacgatgtaaaccgccaacaattttttttacaaaaaatattacaaaatgattctgaaccggcatgcttgcattgcataatgatgtaaactttcaagattacacttccaaacaaaatgaaagctgagcttagttacttgaataacccatgagtaatactttaagttaactagtgcataaatccacctattttttagatgatgagtgtctaaacccacacatatatatgatctgaacttacattaattaaatctataacaatatagacttgattcacacgtatactcctcgtcttggatttcgtgaccaaattaaaaggtcaatatctggctaaccagtttttgtaatcacgaagctatattgacatgtgggcttaactaagtttaaatgtacaattagcccacttgcatggagaaaaaccatataagtatagtgagcatgtagttgcacaacaattaactctgccatgtactgtgttatctctcaactaaacgttgaacctctcgattaatttagcaccatggcgaaaatttcgggtccacttgaatttctttaaatttattctaaacttgttgaaactggagtatttcaaattaattgattttttttaaaaaataaaatcttaatcagaaatactttgttcaagatggcaataagatctcgcttaacattttcccccaatgacaagagaaattaaagaaccctgtctatgaaaataacagcaccgaccctatcagaaggtggatttataatacagtacagtagtaaccaagaaaataaataattagctgtatgtacgtgatcagctagcttgcatgttcgataacacgtgggtactgtggtagtactagtacgtacctagctataattaattaatcaaacaattaaaaaactaataatgatagctaggtaattatactctcgttaattatg

SEQ ID NO: 12507 - DNA, 2073 bp, Oryza sativa
ccacccacaaccttgccgccgccattgccaccgcagctacagcctacagagaagctagctagctagctagagagagagaagaagaagaagcagtgtggcatgcagcgcgagtgagagcctgagaggaggggtatgtatgtaaatgtaaggcatggcagaaagaagggtggtgggtcgctgtggaggtgagatgcatggagagaaagggttggagtaatttacgcaactgccacgctccggtgccctgtcgctttcactcttatatttaattgctccgttccttcctcctgtgtttggtttttcttattggtcttaattaggggttcataattatttattattactgattgacttaattgggaatctcgaggtgtgctagctagatttatttggagggcaaaccgacagttcacttcttacttcagcatatatacaagcaactagccagggactttcatcttcagctatatatactatgtacttttggactagcttagggtatgccatccgcaacggttgaaacaccggtggagaaaccatctttcgtcggtcggtcgaattccacaatagtcccggatgcaataaaaaccagggctaaagatgatctttagttccggttaaaaagggtaacgggcatatttgatctttagtcccggttagtacaccaaccgggactaaagatcatctttagtcccagttcaaatgctgtcagggcatgtcagcccccccgggatctttagtcccggttggtagatctcggggatctttagccccggttggtaactaaagtcccacccctatatatatgtcttcttcctcctccagctgcccgagcaagcttcaaaatttcttaaaaaagaggggaggtcatgccaaaatttctagtgaatttattttggtgattacatacaaatcggaggtgcctaaaaggtttgcaacttcatcctccaatgttttttttgtcatattacatttgcagctatgttttgcacacttttttgtctccaaaatttagttgtaagttgacgagggagaaaatttgtgtggggaagaaagaatatatagaaatttagttgatttgctaaagaaggttttataaaatagttgagaaggaaaactatagtgaaagttaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactgtcattattgtaagaataattatttttgtacgattttttttcgactcatgtagatggatcggcaatggatgtacgctgaccggcggtccaaagagtttattgacggcgtgcactattttttgatagtagccgaagctaacaggcaaaggggtttatttgttgtccatgcaataagtgtaagaatcagaaggagtattctgcatccaggactattcatttccacttgtttgagtcggggttcatgccaagctataattgttggacatcccacagagagcaatgtgttgaaatagaagaagatgaagtggaagacgacaatattccggactttgctcagtacgttggatttgaaggaaatcaaacgggcgaggaggaaagggatgctgatggtaacgacgttgcggatgatcttggtcagatgttgcaggacgccaaggaggactgcgaaagtgaaaagggagcccataaattggacaagatgttagaggaccatagaacttcgttatacccaggttgcgagcaggggcacaaaaagttggataccactctggagttcttgcaatggaaggcaaaaaatggggttagtgacaaggcatttggcgatttattgaaactcgtcaagaacattcttccggagggaaacaaattgcccgagacaatgtacgaggctaagaagatagtctacccgctaggactggaagttcagaagattcacgcatgtccgaatgattgtatcctatatcgcgg

SEQ ID NO: 12508 - DNA, 1951 bp, Oryza sativa
tgccattttcttcagagtccaccttttcactttgtcctctgtacccgcgggaagggtgaatgtctcgagcattgtggtccacagcatctctttctccaaatctgggacaaagctctcatgatctccgcgtgcccttgttcttcgccaatacaccgtaatgacaggcacgttatcccgcacaacccaaccgctgtgacgtacatagttcttggtggcttctgccggggcactaggtcgtccatcttcttccacttccgttatgatgtgccgaccctcaagcttcttcgtggcacctcgttgcccacgtgccctcttctgtccaacggagggttgacttccactagcctcctcctcctggttcccctccacatccctttccacgtgcccctcctggttcccctccgcatccctctccacgttcccttcctcattcaaatactggtttgggtcctcgttcccctcttcttcgttccagtactggctgcttccctccgcgattgtatcgtacaatatctgttcctcatcgtgatcagccatctgttcatacaggaaacatctgctaagtcatgagacatttatgttttaacaatcttatatgctaacaatcatatgctaagtctaggtgacgtatattataggaccctagctagtcaataaattatatagtaagtctaattacaaatctaataatcttatattaaaactcaaataatcttatactaaaactcaaatagtgataaatgctaagtctaggtgacgtatattataggaccctagctagtcaataattatatactaagtctaattacaaatataataatcttatattaaaactcaaataatcttatactaaaactcaaatagtgataaatgctaagtctaggtgacgtatattataggaccctagctagtcaataattatatactaagtctaatgacaaatataataatcttatattaaaactcaaataatcttatatgctaagacaaaaatagccatgtatgctaagtgtaactgtcgtatattagaaccctacacaatcttacatgctaagtctaattacaaatctaataatcttatactaaaactcaaatagtgatatatatgctaagtctaggtgacatatattataggaccctagctagtcaataattatatactaagtctaattacaaatataataatcttatattaaaactccaataatcttatactaaaactcaaatagtcatgtattctaagtgtaactgtcgtatattagaacactacacaatcttatatgctaattaagtctaattacaaatctaataatcttaattgcattacaaatataacaatcatatatatataattatgtcacttgcctgggcgaattccttcgagggctagctctaccactccggcttgagggacaactccgacaacgtcttttctgcaagatacaaaaagatgtattaggataaacgtgatgtaacatatattgcatttgacgttcacgtttcgttcacgatatcgttcacgttcgcgttctcgttaaggtcacgtttcattcacctacgtttgttcgttcacgttcattaacctgcctataattgcatttcacgttcacgttcattggctcgttcacattcgttcgctcgttctcgttcacgttcattcaccttgttctcgttcacgttcgttcgctcgttatcattcacgttcgttcgctcgttcacgttctcggtgtgacggcagcgggacggcggtgtggcggcagcggagcggcggcggcgtgcggcgtcgtggcgtctcatggcacggcgtcgtcgtggcgcggcgtcgtgtcgtgacgaggtcggcgtcggcgtctgaaactcggcggccggcggcaaccgagagggagagagagagatcgagattagagagagagatccagaaggaggcggcggtcggcggctctcacaccgg

SEQ ID NO: 12509 - DNA, 3149 bp, Oryza sativa
aaccgggacttaaagatatttttccgctattttcaaattctttttaaacccggttagggttaagaaccgggactactgataagcgcactgaatattattttccattacatatgtgtttctaaaatagaagataatgcattacaattatttaaagtacaaagattaatgacaaatacttcgaaaaattattgttgtctgtaataaattaagtggataaaacgtaactcagcaaatatatgatttaaaattaataaaaattctaataatcatatatacttagcatatgaatgatattattaaattggtaaaacctctaattaacatatgtatatgcatccaccatgttttataattaataaaattggtaatcatcatatatattcttagcataggaattatattaaattaattgttaaaaactctaattaatatatgtaaatgccacatgcatgatttaaaaattttaaaaattcggatagtcatatataattagcatatgaatgatagtaacttaaattgtgaaaaactctaattaacatatgtaaatgccacatgcatgatttgaaacttttaaaaattctctagtcaattataattagcatatgaatgatagtaaattaaatgttaaaactctaattaacatatgaaattgccacctgcgtgatttaaaacttttaaaaattgtaagtatcgcatataactagcatatacatgatttaaacttgttaaaacttctaataatcgtgcgtaattaacatatgccatacatcaattgatttatatggataatcaatacactcaaatagtttacatcgtgtacacaataattacggcaatacatcggcggtgacggttgaccgcacgtactttctcctcactattgttccctcattgtgatcgctacgtgagtaaggggtgtcttcatttgataggaggatgctagggtcaatcgtcaccgtgaaagggggttgtccatccaactgatcgtaatcctcgtcagtcttgtcctcaactccgacgatttttcttttgcctgggagaaccacgtgacgcttaggctcgtcaggccctctgcccttctttcctttgctatacatgtccttcacgaaaaagacttgcgttacatcattggcaaggacaaaaggttcgtctgagtatccaacgttgttaaggtcaaccgttgtcatcccactgtcatcaatcattacgcctccaccagtcaacttaacccattggcaccagaacagagggaccttgagaggaccatagtcaagttcccatatgtcctcgatggcaccgtaatacgtgccagttgttccatcgtgtcccatggcatcgacacgaacagcgctgttttggttcgtgctcttcatgtcttgggctctcgtgtagaatgtgtacccattgatctcatatccctggaatgtcgcgatcgacctagacggtcccctcgccaggaaggcaagttgttggttgatcgactcgttacccatgagatgttgtcgtatccacgcggggaaagtatcaatgttcctagcgcgaactagagccaagtgctcctcgatgtaaggagctaccaatgaagattgttgcagaaccgtgaaatgggctttacggaataaattgttgtctaccgtcattattgctttccttccgagagttccctttccctgtagtctcccttcatggcgtgattcaggtaccccgattgggcgaagatcttcgataaattctacacaaaattcgatgacctcctctgtttcataacccttggcgatgcttgcctctggacgagcacggttacaaacatacttcttcagaacgcatgtacctctcgaaaggaaacatgttgtgtaggtacacaggcccgaaaatactgatctctttcacaaggtgacaaagtagatgcgtcattatattgaaaaatgaaggtggaaatatcaactcaaaactgacgagacattgcaccacatcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttttccttcgtgcttattattcgcttgatattcgtggggtatccagatggtacctttatactctccaagcattcaaacatactttccttctctgccttgctaagagtgtagctggctggactcaagtaatggcttcctttctcctttggttccaggtgaaggtcgccgcgttgttccatatgcttcagatcattacgtgcttccagtgtatctttcgactttccgtgtacacctaggaagccaagaaggtttacgcaaaggttcttagtgaggtgcatcacgtcgattgcgtggcgtacgtccaagaattcccaatagggtaactcccaaaatatagagttctttttccacatcgccgcgtgaccatcttcgctctctatagactggcttccaggcccctttccgaacactacttttagatctttaaccatagcaaacactgttttcccgttgcgatgtttaggcttcgtacggtggtcagccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagtgctcgtatgttaaactcctcctgtttgtcctcgtcgcacacggggacaccttccttcttccacaacatcttaagatctttgaccagtggccttaggtatacatcgatgtcgttaccaggttgcttggggccttgaataataatcggcatcattatgtacttcctcttcatgcataccagggggggaggttgtagatacacatcgtaacgggctaagtgctatggccgctgctcatctctccaaaaggattcatgccatctgtactcaaaccaaaccgtatgtttcgtacgtcctttccaggggtgca

SEQ ID NO: 12510 - DNA, 686 bp, Oryza sativa
aattgaacagaagttgcacatttatgatctctgccccacctttccccacaaacaaaacagagtcccttggatctacgataagctttcaatgaagccaatctgtcatccttggccttggatgcatcgattgcccttttatcttctgtcataaccacagtaggagtcctaggactatgattcactggactgaattgattagttctaggaacctgcctgatgctagaagaagattcagttcttttgctgctcacagtcttgataccctccaatatttcctcttgtaacaaagctatagaacaagctgagtctaaatcttggggcctttgcaacattactgctcccctgatctcatcccttaacccttcaatgaacttttggacaaagtatacaggagttaaggcactgtcataagccataagttggtgcattatgctgtcaaatttttccacatattctgagactgaactggattgttgtgcatgaaaccactgacggattagagcttcctgtctatcacgggtaaatctagcacacaccaattcacagagagtctgccaggtaatccccacaatttgttgcctaattgactgcaaccagaacgctgcattgcccccaaaattgagcgtagctaccttaacccagtgtataggatgaataccatatatgtcaaaatactgctcacaatt

SEQ ID NO: 12511 - DNA, 2592 bp, Oryza sativa
agcttccttcaacactaggatattctgctcagatctctctcacccacgctccgaactcgattaaccaggagaaggcaagttgccttttcgcgggattcaattccgaagaatagatcccaatccttccctggaattttacaaccaagccaagagaattttggggcgaaagggctctgataccagaaattgtcagcgtcaccagatggactcaacacaactaaggaaaatgaaaaggaaaagtggaagaactcgaacaactcaggaagaacagagatgtgtttaggcaatcttttactaggataatcttgctccaacccaacagggttgagccgccgccgccattcgccaccagattgccaaaagtcccttacaatttagaaacctcagttcttatactctctctcgctaccaactcccttccttcccctctcacaagacagatgccagctcatgccagcgatacaggttacatggcccattccggcccaacatatttacgattaggcctaatgactctggccggcctcaagtcttcttctcctccttcctgctcaccatccggcacaggcttcatcttcagcttggcgcttgcactcggctcctcctcgcctgacgccttgacactcacatcgcaaagctaattaggttattgatcaaacgaatgtatcagccaaaaaaatagagaaaaacattcactcctgaattcacgctagaatttcaaaatcaccgtccatgatccatgtgaatttctagcacgttgcacaagctgaattcaaaacaatttggtcctgtttgctgcatatgcaagggttattctgatttcatctgtatgactgtatggggcttcttttagatagtgaaaagaattccggcatttgctttaaagatgctatagccacttattacataattcacagcttataaaaaccaagaaatgactagacaataactaatgataccaacacaagacatttattcaagtctgtttgtaaatcttcattcgaagttggcaaatatctacatgatcgttgtctctaggttccggcacacagtatgtactgtcctcattacacctttatatttgtgctcagaactgaagccagtatgttacctgaatagtatctgcatataagatttcattggggatttgtcaaagaccatatcatttatgcatacaagatacacacagtggtgctcgggagggttatgatgggttagagctgagggagaaggatcccgaggtagtggcgaaggataggctcggggagctgatgcagatggggctgcatgagtataatcagcggcggcatgcagagaatttggaggagaaaaggagaaaggaggagaggtgagattgagataaaggaggaggacgacgatgaggaagcagcgcggttggatagtgctaagaatagggaagagggaagagagaagttttacaaggtgttgtttagtgatgaattagggatggaaatttcggttcacaattttggaaatttgaaccgaaatttcgggaatttcgtcccccatccggcaagcaattattttaagtgaaattttcagttttttttttcaaatatttgtgaatttgatcataatttcttcaaatttagtaaatatgtgctaaaatttcgtttgaaatatccgaaatttcggaatttcattgcccaccaaaattaccttactttttgaaagggaaaaccctagtgatgataaccgctgataagtttgtgtggagttttgtttgtgatccatttcatcttattgaatttattcatttgaagagtattcaacacttttgcacttcataatcaatcaaattgattactgatggatgtgatgggagttgcattgctacaaaggcattaggcatctgtctgcatgggaagatggtcctattgagttcatgacctgcaaatgttcaaggatatttgattcaataactgcttggatgccaccagatagtttggtattggcagattataaccatcaaacctttatgcggatacttctagcataatgactacatgaaattctagtgtgaaaggattgctgcaaagacttgacaaaagaaattagtgatgtaatgcatatgatcaaaataaattctatgagttctacaggtgagatgctgatgcagagttggggtttagtcaccatggcatggagaaaggaattcagaacccatatgaactgttgagaagatgcaattgcaggtctcaaagtaagcacatcaagactgttgatctttcaaccttttgtggtgtttgttatgtttagcagacatctttcgattgagaattggaacatcacagagggtggactaaagtcagagattaactacaaagcaatttacaatgcaacctgtggtgcccaattcacaatcacagaatatgtgttgcctgctgatcttggaacataaatggaactccaaataggatgtgtttcggtacaactagtaaggtttatgaatcttcaagcgaagtatttgacatttggttggggaaaatctatgttaatcccccaaaataaatgaaatgaaatcttttaattctgatatccagtttattttgtattttatgtatacatatt

SEQ ID NO: 12512 - DNA, 9070 bp, Oryza sativa
ttctatgagttctacaggtgagatgctgatgcagagttggggtttagtcaccatggcatggagaaaggaattcagaacccatatgaactgttgagaagatgcaattgcaggtctcaaagtaagcacatcaagactgttgatctttcaaccttttgtggtgtttgttatgtttagcagacatcttccgattgagaattggaacatcacagagggtggactaaagtcagagattaactacaaagcaatttacaatgcaacctgtggtgcccaattcacaatcacagaatatgtgttgcctgctgatcttggaacataaatggaactccaaataggatgtgtttcggtacaactagtaaggtttatgaatcttcaagcgaagtatttgacatttggttggggaaaatctatgttaatcccccaaaataaatgaaatgaaatcttttaattctgatatccagtttattttgtattttatgtatacatatttagtagtagctagtactaatcgcatcccctgacgataatggacgcatgctaaagcaaagctcgaaattcatggagtaatgaaatgtatatgaaatttaacagtctgagaaccaaatatctagcaaaggtcatgaatgtgccttttttttcccttgttgaatggcatggcaactttgggaattttgggaaatgatgatagaaagccactgaaaagaaagtgccaatcttcactaacataaaattctttattttccttttttgtagaacttgggaaacattggtaaatgaatattaatagaaagcaattgaagaaaaagtgctcatagttgcacaaagcaaatgttggagctatacatgtcctaaaatcacattctttgctttcgtggtggtttcatgccttgtacacacccaaccatcttgttgctaccttcccatcctgtaaaaatataatgatcaagatcatgattagtcatgaacatctgtctttgtgaacatccacttcttttttcttccctgtttttgtgttctttcagtaagaattgggagggagcaagaagacctttggacatgttgaagccgcgtttttcgagctccttgtattcttggcatagcgcacaactatcgcagaagaagtggacgcagcagtccaagcagggcgactgttgcaagttgtactgtgcccgcattgaggatcgtttggtacaagcatacagccattggcagcctattgtcgccagcaaaacatacaaggtcccgtgcatgcagcacgctggaaacagggagagtcagcatacaagattgatggttttctgtgcttgaaccaaagcgcgaagtgataagttaatatgcctacatgttgagcctttgtccacaatctcagcaatgcgaccgaacgtaatgcaggggcaccagcaagtcaagcagcctgtgtagttacaaaagaaatgaaatcatacatgaagaattggaaacccatgtataagaggtgcaagaacaattgagaaacagctttgcatacaggttccgctatctccaaagcagtcgaagagcttaactgaccactccccagacatgctgttagtattgctgattgagaatctgtgatataaggtaggaggattgactgagatctgtgtctcaaggtaatatacaagcgttatacctgtgtagtttgagcagttggtacctttgatcctgctgctatttatatggctgtggcattgcagtgccttgatgtagaacatgtcaaattcagagccagcagtttatgttattttgctggttttcgctttcctatcacacggggtgatgtacgcttagtgttgtgtttgtatgtgtctttgaactggtatttctgagaatccaacgttcaattggcatgttctgctttgaatcgttctatctgagaacactatgctcgatcagcatctggcagcatttggaccttccatggcttgttagtctttgatttcttgtctatcatatatattgggtggatgtgaaaaatggaagctgttcagtgttcacctttcctgacagcctgtgtttcacattggaaaagtctggaacaaaaccttcacaaagatggttgtctcctgatatcgactcttgaggaaaggggcaaaattgttcgtcaatcttctttacgtccaaattcaaagtgagtaggatgatcaccgcacaaagcacctgatgtaatcccaattaatagtagtatggaagatgcactgacaaagtttagcttaaaaaccacaaattgcccaagtaaaagtcaacgtctagtagaatctgttatagtctccgttaggtagaattaacaatactccaccatttttgggctgcagctaaacacccaaaccttcttgggaaccaaacaggactaaagtaaaaggatttttttttttcactcagttttttcacatgaatccacctgaggtttactcatgacatgacatctcatcacacaagctagtactctctctgtttcaccgtttcagattataagtcgttttgactttgatcaaaatcaaactattttaaatttaattaagtttgtagaaaaaaaactgtaatatttttaacccaaaataaatatattaagaaaatatacttaattattgatctaataaaactaatttggttttataaatattactatatttgtctacaaacttagttaaatttaaagtagtttgattttgattaaagtcaaaacgacttataatctaaaacggacgtagtagcagctgctactctactcataaccaaaagcaaaccacacaccacacaccacatcaccactggtcaaaaccctgtttggaaaacgcaggaacagaacagagcaaaggattcccgcggaaaaccacgatatcaaccatttcaacctgggacgtgcaggggacacacacacacagagctgatcagatcatcagagagccagtacagtacaagaagcagagagccttgacggcgagcttcatgccggcgtcgcagtggcccggcatgccgcagatgaagtagttgttccctcgccggagcgtcacctggtcgtacccggtccgcagcaccgccgtgtccttgttcctcggcaccttgcaccgccggtaccccttgccgccgaccaccgccacgtcgtggtactccttgttgtacttgaacactgcatagccatgagtcagtcatgtaccctatttcgttgagtttaaaattgagaaataactaattggttgtcagtttctaagaacttgtaaaggttgtgaaacctaacttctagttactaattccttttccgaattctgtattggataaaaaagagatttgcttcggtccaataaaaagtatatcgaggtaccgatacctcacggtattaaatcgtttctgatcgttgcatctagctgggtaggatgggtattgttagatccaacgatcggaaatgatttggttccgtgagatatcggtacctcgagatactttttattggaccggagcaagtcacggataaaaaactactctatatatttaggagagtttttaattctgaaagaagatgcaactatcagaagcttctcgaaacatacgtacaatcacacaccaatggatctatgcatgaagctttgacattaacttgtgcacttaccgagcacgtcgccggcgtagaaggtcttgccggcgagccaccagtcgaggttgcggccccacccggcggcgtcgcccacgtagtacgtcttgccgccggcctcggcggcggggacggcctccatcagcagcgccgccgccacaaggcacaggagcaccacgccgccgccgccgcttgcactgcctcttccccggcgagccgccgccaccgccattttctcgctcgctcaaatcaaacgagattacaaaggagatcaccagtttagcttttagcacagttttgcacggtgtgtgtgtgtcttctgactcgtgtggtggcgtatatatagcccgcgaaatcgacgcagtgcagcacgtgctggcacgtcgagagcacgcatagcggcagcagagatgaagcttcttccgtggaagcaggactcttcgatcccggaatacaagaatattaatcctgggaaaccaaaatttcaaacaaaaagaaacacagaaaatatttttaaaaaattaaaagagaaaacatttccgtgaatcaaaataaattttgaattgaaattgagcccagtgtgaaagtatggaaaactgaagatccgtttgaaacacagaattttacagggaacggctgaaatgttgtaaactgctcccttcgtctcagaataaagcaacctacaatcagatgggacatatcctagtatcgtcctataataccaaaaacgtgaactttcgatgctatataaccaattttgccaataataaatgagaaatggatatatttttcacaaggccctgggactaggagggaatttggccggcgacaacatcgatctgcttgtaatttaaatcatttttctcggagaatttgacttccataaaagcgtgaaaaattgatagtactctcgatcgcctcgccacgccaccgacgatcgaaggtgcgtgctcaagtcagacctgatttagtcctggatcaagttagtcgctgtcattagatttcttgtcagcgtctacgtgtttggcgccaatacactcgcggggtgttcagttgaccacgggatgcagtgatgatatgcctcgaatcgcgcgcgaaaaattgcaatttgttccgatcttggcgggaagttaggccattcacattagcttcttcttaggcgtgtgatcgaattagtacttcctccgtattttaatgtacgacggcgttgactttttaaccaacgtttgaccatttgtcttatttaatttttttatgcaaatataaaaatacttatatcatgcttaaagaacatttgatgataaatcaaatcacaataaaataaatgataattacataaatttttttaaataaaacgaaaggtcaaacgtttgttaaaaaatcaacggcgtcatacattaaaatacggagagagtactagttaatcgtcaagccgacccgatccgtagtcgacggtatagccagcgcccaaccgctgacaattggtagatacagatagataaacaaggagagatgtgttgctcctgcctgccatttcgtcgctgctggtgacatgtgggtggcacgtttgagtatatagctaggttatgtatttaaaaccaccatgaattaatatatagacctagcagtagcacaatggggattggatttaaataaccaattcaaaggtcttacgatgtaaatatatttattctccccaccgcaagtcgtttctataaatgatttttgtgggggtatggatcaattgttgtataagggaagcattttgtaaaaaaaaaaaagagtgcaaacgtttcgcttatatttattcgttcagcttattagcaaaaaaaaataatattcgtgaataaactgttatattggtgtctttaacgatttattaaaaataagtgctataaaattaagtcccagaaattaaattttgacatataaatataagataaggctggaatctcattttcccacggtgattggagcagatacattcaccattcgtgcaagtgcatcatgccctcagatgtgccaagtcctcttcaattctattatatcatcagtaggataagtggcaaagccaggaatttaagcctgtggggtcaattactagtggtttgtatttaagtgaggtcatgtatctaaattcttttggattcatacatgaaaattaaggtttataggattttttttttcaaaaagctatgggtcagccaaccccacagaagaggcctaaatccgccactgaggcagatctaattgctagcagatttaactatttgccgtttaatttgatgtttaactacatgtgtcaataatttatgagccttcatatacctacaatatatagattcagtggtaaatagttatttgctacatccacgacgggcgaatagtctcatatttaaatatatcctaattgcttgcgatatcgactgcctggatgataagatttgaggaaagagaataaaagagagataaaactgggacacatacgaccaatgttgtcagtatcccgatcgtaaaatggtatcttatggtaatttttttttacacgggatgaagatgaattgaggggaaaaaaggagatgaactaaaagtattgagaaaatcagcatatgtctcttttgttgagaggaagagtagggaagtaaagcagagtttggttctagattttcgatgggctcagttcacctactatccctctactttacgttgagtctgtctaacatcccttatgtccaatactagaaatccccccccccccactatacgaaaccgtgtagaataggttctatggcagtataaataaatggttccgttgacgtgacatcctaatcagtaaagaggaaataaaaaaattatggggcccacatgtcatcctcactccttccacttctctctatcttctctctcgcatgccatgagcagggcaagcggggcggtgtcgctgtgtcgagcgaagcagcggcgcacaaagctggcaggcggcgggcggagcgctgtggcgggggtggagtgtagaggacggcagcgaacgccatagaggaggatggcgcagcggacggaaacgcaatgggtaaagtaggctggaagaggacaacgacaacgcgcttggggtttcactgggagacgatgacaacgactccccctccttctctcccactctcccgctggcctcatttcccccttctcccgccggcgcgacaggtagcctctcccccttctctcgccagcacgggcggtgggctctcccttctctcaccggcgcggccagggcagtcggtgtcacgcccagaaatttagcccaaatttccagactattttgtgtattaaatccctgtccaggaccagccagggtacacaaaacgacaagtaataaacagttccaaacgtaaataaagcgtaaaatacttacaaaagaggcacttagtcctcacaccgaaacaaaagcagcagcagcggaaaaaaggcgatcctagcggggcttcagctccactccacaggcaaaactcaactggggtctgagccttggtcttctaacttcgtcttcagctcagaaacactacacttctgaaaagggggaataatagcaaggctgagtacaacccccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggtagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtctttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgatcccgtgtaattagcaaaacatgcatatttatttgcaaacagtaaaacatttgtaaattaggatcaacatgctcaaggggaatgtgtgacttgccttgcttcctcactttgatcttccgaactcttttcctcgcgaccgcggacttccgaaacgacggattctacacgctggcacgcaaaacgaggaaaaactctaataaagaccaaggaaacagtacataaaaactaaacaaacatgtagacctcaattttagatgaattttgcaagttgaatggctcaattcggagttcgaatgaattagatatgaattttagaagttttgagccatttaaatgaatttctataattatttacgaattattgcgcaattattatttatttttacaaaggaaatggatctccctttggtaaccaaggggcgcgggcgcttacactcgggccccacaggtcagtaagcaaagggcacaggcgcacggtgaactcggtccaccgcagcctcgggcgcacgtccaccatttgaacggcccagatcggcccgagctgatcggctgtcaaaggggagcggcggccaggggcactggcgcgacacaaagccggcccgtccgagccaaggcgcggcggcggcatgcagccaccggcggcagcagccggagacgcggaacgacggcgggcagccgaaggacagcggcccgcacaggggacggcgatgcacctcaagagtcggcagccggcaagaaagggtgacgggaaaaaaaaaggggagggaggagaggtcctctccgaaaacgccggccgacgcggaggaagatgacgacgacgacgattgcccgatgacggctagcgaggacggagggcgaacgaggtcgcccttgacctgcggaaggagaagagggagttagg

SEQ ID NO: 12513 - DNA, 683 bp, Oryza sativa
  unsure (1)..(683): unsure at all n locations
nnnnnnnnnnnnnnnnnnnnnnnnnnnnnnnnnnnnnnnnnnnnnctattttccgtccctcctctttgggctgacatatgtatacctaaaataagtctattttctgtccctcctcttcggctgacatatgtatagataaaaaagtctattttagatccctattctttcgttcatggcatataatatgtctatttttacttccctattttttttgtaccgggcctagctgccagcccatcgtgccgggccgagccaacgtgccggtggaggggcccaggcacggcccgatggtcgggccgggccggcacgggcccgacctccgtcgggccgtgccgtgcttgggccgggccaaaataccgtgccatgggccgggccgtcgggcctcgggccttttggccatctatacttcttcctcctccctccctccctctctctttctctgccctttctcttccctttcgactgcagctgcctgtgcgacgctggcaatcagccggagtggtgtggcaatgggcgagagggtgggcgttggagcggcagcggtgggaaaaccatggacggcatcatggccgtgccaagtatatacggtagggaaaaccactgtccaggagctgtactggcaatctggagctcaccggcgaggagaaggaaaccgtgcggaagctgatggggtaccgagctcg

SEQ ID NO: 12514 - DNA, 3061 bp, Oryza sativa
tagtatgctaatggctatttctcagcaagccttatggggaactgaatccaatagatcagtcaggttaaggggatgggtgcaaggacctgaactgcttatgctaatagatctaagatagtcacattcttttattgatctaggtgtgggaaagaagttgccaggaatctctcctttgcctaagccggtcactgttaaggttgcagatgggggaaccatgagttgtacacatgaaatcgttgattgcagctggtggatgcaaggacacaattttaaaaacactttcaaactattgcaattgggaagttatgatgtgattttgggtatggattggttagaaagattcagccccatgcaagtagactgggttaacaaatggatggatgttgaactatctggtaaaattgtgagattatttggcattactccacatacaacaacctgttgtcctattacctctgaccagttggaaggaatggctaaatgtggctcaatactttgcttagtgcaattagcttcagttttacagactaccactgatccaattccggcatcagtacagcaaatcattcaggaattttcatctgtctttgaagaaccaaagggcttacctcccaaaagagcctgtgaccacagcattcctctaattcctgatgctaagccagtgaatctgaggccttatagatacaaccctgcattgaaggatgagattgaagcccaagtggccgaaatgctacagtcaggggtaatacagcacagtcagagtgccttctcttcgccagccttgctagtacgaaagaaggatggaacttggaggttagtgattgactaccgacaactaaatgccattacagtcaagagcacatacccaatgccagtcattgatgaactattggatgagttatcaggagcaaaatggttctccaagcttgacttgagagctggttatcaccaaatcaggatgaaggcaggtgaagagtataaaacagcattccaaacccacactggacactatgagtataaggtaatgtcctttggtctcactggggctcctgctacatttcaaggagcaatgaatgccacattgcaatctgtgctcaggaagtttgctctagtgttctttgatgatatattaatctatagtcctgatcttgagtcccatttggatcacatcaaacaagtactatccctgttgcaaagacaccaatggcaagttaaattgtccaaatgctcatttgctcaacagcaattaacctacttgggtcatataattagtggagcaggagtatcaactgatcccagtaaggttcaggaggtggtggattgggccattcctactactcctaaaaagctcagagggtgccttggattggctggctattacagaaagtttgttaaggggtttggcattatcagtaaaccacttactcaactattaaggaagggggttccctacaaatggtctgccgagactgacaaggcattccagacacttaaacaagcactggtaacagctccagtgttagcccttcctgatttcaatcagccgtttacagtagaaacagatgcaagtgattcaggcattggagctgtactgtcacaagggggacacccaattgcttttattagcaaggctttgggtcctcgtaccaaaggactttcaacttatgagaaggaatgcttagcaatattgatggcagtagaacactggagatcttatttgcagattggggagttcactattcttactgaccacaacagccttatgcatctttcagatcaaaggttacatactccatggcaacacaaagcttttaccaaactgcttggattgtcatataagatatgttacagaaaagggagtactaatgcagctgctgatgcactttccaggaaattccaagatgaatctgagttaaacttggtttccagttgtactccaacctggttgttggatgttgctaagggttatgagactgatcaattttcattagatttgctcactgctctagctcttaaaccagatgcaaagcctgggtacaccttgcagtcaggaattataaagtacaagggacgaatctggattggtcagaacagcactatgcaaaatgcgttacttgcagcattccatgccagtcctattggagggcactcaagattcccggttacttatagcaaattgaagaaactttttgcatggcctggaatgaagcaacagactaaacaatttgttcaaacctgccaaatctgtctgcaagctaaaccagacagggcaaaataccctgggttactgcagcccttacctgtgccagaagggtcgtggcaagtggtgacactagattttattgaagggttgccaagatcttcatcttacaattgtatactggtggtggtggataaattttcaaaatatggccatttcttgcccttatcccaccctttcacagcaatagatgtggcaaaaacttttatgctgaacatttataaactacatggtcttccccagactataatctcagacagagataagatctttacaagccaattgtgggagcagctgtttactagatcaggaacacaactgcatctgagcactgcttatcaccctcagtcggatggccagactgagagggttaatcagtgcctggagatttatctcagatgttttacacatgcaactccttctaagtgggcagtgtggcttcatttagctgaattctggtataatactgcattccactcagcactgaatacatctccctttgaagttctatatggccacccacccaggtattttggaattcattcagaggattgtgctattcctgaactacaagtttggctcaaggagcgtagactgatgcattcattgattcagcagcaccttaaccgagcccagcaacacatgaaaaatatggctgacaagaaacgcagtttcagatcttttgaattgggtgactgggtttatattaagttacagccctatgttcagtcttctgtcgcagctagggctaatcataagcttgcattcagatattttggccctttccaagttattcagaag

SEQ ID NO: 12515 - DNA, 2449 bp, Oryza sativa
  unsure (1)..(2449): unsure at all n locations
nnnnnnnnnnnnnnnnnnnnnnnnnnnnnnnnnnnnnnttgtcaaggcgtcaggcgaggaggagccgagtgcaagcgccaagctgaagatgaagcctgtgccggatggtgagcaggaaggaggagaagaagacttgaggccggccagagtcattaggcctaatcgtaaatatgttgggccggaatgggccatgtaacctgtatcgctggcatgagctggcatctgtcttgtgagaggggaaggaagggagttggtagcgagagagagtataagaactgaggtttctaaattgtaagggacttttggcaatctggtggcgaatggcggcggcggctcaaccctgttgggttggagcaagattatcctagtaaaagattgcctaaacacatctctgttcttcctgagttgttcgagttcttccacttttccttttcattttccttagttgtgttgagtccatctggtgacgctgacagtgagcaacatgtgtgatagcatgtcgttccaggcgtcaatggcgccgggaacacaccagtgcacgcagtcattgaagatggtgaagtactctttcatccattccttacgacgcgtccatcccctgtacctgctcgggtgcgcgtccgcccgccgtatcatcgcctccgtcgtgtccatcagcatcattcttaccccgccgccgctcgccgccctgtttgcatgcctggaactcgctccacctacgaagctcagaacacacgtttactagaaagaacaagataattgatcactagatcaatggagaaaaatcaagaaattaacctgcagcgtgtggaagtcgagctcgaagccctgcagcgtcttctcgccacgccggtacggccgcgtccggacgcagttgccgtccttgttccactccccgccctcgtactgcgacggcgacacggtccgcagcacggcggtgacgccgccgccgtcgctgctcaccacggcgcggagcgcggcgcgggtggccatgcggagcgcgtaccgcagcgtgaggtcggtgacgttggggaggaggcagtggtggcacccgacgagccggccggcctcgtacagcatcgacggccggtagaaccagctcgacgccgacacgacggcgtagtcgaacgccgggacgtgcggcgcccacacggcggcgggctcgtcgaggtagaggttccacaggcccgtgtgcgccggcccgtcggcgtcgacgagctcgctccggaccaggaacggcgcccagaagttgaggacggtgaagttgtagccgccgccgtagtggtacaccgtgtgctcgctgctcggccagctcgtcgttggcttggcaacctgcaggccggccaataaaacgtcacaccctttgctgctggcccatttctgaccgtccgatcaagcgatcaatgattcagatcgaagctagtactgtagcaaatccggcacgttttttactttttaccctggtcaggagacagatgagggagttcatgtggttcttggcaagggaatccccaatgaaggccaaggtcttgcccctcatggcagagaggaagcgcaacgggtcgagacgggggagatcacaaccgtcgggacgccaccgccactgcacgaagccaaggtccagcttgccgtacttcatacagtcatagtgctcgtggatgaacgagcaggtgtcgttggtgtagtagggtgcatcagggtctggcacccattcgcctctaaatatgtcgcaggcctcgccgtcagccttccggccaccggaggaggtggagaaggaagagtaggacagccaggcggacagtgttcacggcataaccaccgggaaagggaagtatgtgtcggagacggcgatgacagcgacgagtaggaggatagagatggcgggaatcaagcacctgccgttgtagtactgcgtcttgacaagaaaattgcagagattattaagaagcgccatcgatcggcactaggagaaaactaagaatctatatttatgtgagaattgggtgtgaaacaccggtggagttaattcaggtgtatatataagaaggtgttcataatctcaatgtatcggaattttggttttttgggggtccactgctactggcctagtaatataatctccgcagcacacacagtctgtacgtagtatggcgtcgcacctcatggcaccgcgagtctctgttggcatccatgttacttcctcgcagcaaagctcacagatgattaaattgttggtaagttatgggatccgagggtctcgagcatgagcaaattctctcggcgcgcacatggacacatcacacatggttggtgtcctctacagaaagacccattttgtcttctatcgaaagacccattttcactttatgtctgtattgggtagaatctcccannnnnnnnnnnnnnnnnnnnnnnnnnnnnnnnnnnnnnnnnnnnnnnnnnnnnnnnn

SEQ ID NO: 12516 - DNA, 322 bp, Oryza sativa
ggttttgagagtcgtgctcatgacaattaaggactggttcgcgagctactgttgtggaacattaaccgtgccaaccacaagccagtgtgggcaacggctttaccttttgtatagcatggttcattgcggagcaccagactgagaagtggcggagataagcccacgggggtcgctggggagtccatgccttgtttataagggggtgattatgatccagaaaggtgcgctgtggtggattgtgttatgcaaggggtaatgtcacagctcctttccgaggtaccgtggtggtactgaggcaaatggtgacatgatgtggagctgt

SEQ ID NO: 12517 - DNA, 481 bp, Oryza sativa
ttctgagtaatgtgacacaaatcttttattcctatcttctcaacccccataggaagccccaagtaagtaaaaggtaaagtaccaactttacaattcagcatattagcaactctcaattcctcctccttactaacacccagaacatagacctcactcttttgatagttaatttgcatcccagacatttcctcaaaacaaaacaacagaaatttcagcaccctaatgttgtcctccccattcttgataaaatgagcagtatcattagcatattgcaaatgaattaaacccccaagcactagattagacaccaaaccttctgacaccccatttgtttttgcactttcaaggacagctgccaaagcatcatccaccagattgaataacagaggggacaaagggtcccccagcctaagccctctatgagccttaaagaaaggaccttgctccccatttatattgatactcatccttgccacctttt

SEQ ID NO: 12518 - DNA, 492 bp, Oryza sativa
tccgacgacggaggtagtcgccgtacaccatggccccggtgagcccctgggatcgcaggcccgcgaggcggtcgaggacggcgtcatagccatcccccaatctaccggcgcccgccagctggaggcctgcgccgggggctggctcggaagtcggagatgcgcttcgtcggcgaggggggtgtagaaccagtcgctcttccagtcatcccactttttacggaggacgcaggggatgtagcggttcaacaccggcccccgcggcaggaaatagcagccgccgaccaccgacggtggcgataccgactgcacggtaaagaaccaccggaacagccggagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcgaa

SEQ ID NO: 12519 - DNA, 512 bp, Oryza sativa
tcctgctatcccagtaagtttcttttatcataacaagcattcaaatcggcaataatcgttaaacctctaatctgcttctaaattgtcactgcaagtgttagctgatcttttctcttttgacatcagagactatcttgatgaagaagaagaagataccacaagcaaagccttggctcctttatctgatgatgtgaaaaaaactctaggaagcattttagatcggctagaagcatcatcgctagacagcttggtggttgattgtggctcaattagggctcggctacacaagattcaggctttaatcccagatgagttagccgatatccttactccagccgtttaccttgagcaacaccaattcaaactgcagaaagccaagttaagactagccgaacggcgagaacgtaaggacattgaggccactatccaagctagccgacaacttgtacatgaagagaagtccaagcttgatcaattatataaagggcccaatcaagtctaacattgatcgg

SEQ ID NO: 12520 - DNA, 1065 bp, Oryza sativa
aaccttacgaatggcaaagtatccaaataaatgatcaaaatgttgctttgagaatattgaacgacacagcatgacagtttaaaaactgtcatgctaataaacagaacaattcaaggtgaaagaggtacaagcaagagaaactgaccttagtccaccctctgtgctgttccaattctcaatcggaagatgtctgctatacgtaacagacaccataaaaggttgaaaagatcaacaaccttgatgtgcttacgttgaggtctgcaattgaaacttctcaacagttcatgggtcatgaattcctttgtccatggtgacaaaacaccaactctacatcagcatctcacctgaagaactcatagattttcttttgatcatatacattacatcactaatttcttttatcaagcctttgcagcagtcctttcacactagaattccatgtagtcattatgctagaagtatccgcataaaggtttgatggttataatctgacaaaatacaaactatctggtggcatccaagcagttattcaaccaaatatccttaaacatttgcaggtcatgaactcaataggtcaatcttcccttgcagacagatgcctaatgcctctgtagacatgtaagtatgcaacccccaggccccatcacatccaccagtaatcgctttgatcgattgtgaaacacagaggtgctgaatactcttcaaatgaatcaattcaataagcatatcttgcaaccaaggagatgaatagagtcacaaacaaaactctgcacaaacttatcagcggttatcatcattaaacagcaccttgtaaaaactcctcctctctctcctcttctcagcactatccaaccgcgctgcttcctcatcgtcctcctcctcttcctcctttatctcaatctcttctctccttctcttcttctcaaattatccgaacgccggcgctgattatactcatgcaggcccttctgcatcaacttcccgagcctatccttcgccgctaccaccggatcctttctcctaagctccgacccctcgtaacccttccggagcaccaccgtgtgt

SEQ ID NO: 12521 - DNA, 5188 bp, Oryza sativa
  unsure (1)..(5188): unsure at all n locations
nnnnnnnnnnnnnnnnnnnnnnnnnnnnnnnnnnnnnnnnnnnnnnnnnnnnnnnnnctctgttgacatgtaaggatggaacccccaggccccatcacatccaccagtaatcgctttgatcgattgtgaaacacagagggtgctgaatactcttcaaatgaatcaattcaataagcatatcttgcaaccaaggagatgaatagagtcacaaacaaaactctgcacaaacttatcagcggttatcatcattaaacagcaccttgtaaaacttcctcctctcctccctcttctcagcactatccaaccgcgctgcttcctcatcgtcctcctcctcttcctcctttatctcaatctctcctctcctcctcttcttctccaaattatccgaacgccgccgctgattatactcatgcagcccctcctgcatcagctccccgagcctatccttcgccgctaccaccggatccttctccctaagctccgacccctcgtaaccctcccggagcaccaccgtgtgtatcttgtacctgtttgagacgtagaagaggcacggatgccgatgcagcatcctcgccgtgtcctccggcaacccgaactccctcctgaaatgctccagcttcagaaccgacatctttttccacaatgtgagcgagaggagctcgtgcaccaccgccaccgctcgcttctcggcgtcggcgtccgtgcctatcgccgcccatctctccgagtacggcgagatgtacggcgtggaattgaattcctccatcttggcatgagacttggcccaggagggcggcagcgagcaggtgaaccgcgggcggaggagtcggcggcggaggcggccgccgcctcgacggaggagacggcgagggaagggacccaccggagaagctccagctcggcggcgttgcggcggtgcgggtaagggttgccagtccgaanaggtcggtccggcggggaggagcgnnagcaggtagtcgtcgggaggcccgagcgggccccgcagcgcggcgagctggacacctggaggcgncggccgcgggcgagcatgagcacccgcgcgaggcggtcggccatcgccggctcggacgccgcgacggccgcctcctcggcgtcgaccagcaccgccatccgcttggtgaacccgaagcaggcctcctccccgccatcgccatcgccgccggcgccgccgtggaagaggtcgaagcaggaagggtacttgcggagccagttggcggctcggccgaggaggtcgagcgtcttgaagcgggactggaggaggcggacgggggcggtgcgggacgggaagcggaggaggaggcgcttgatctggttgttcacgatccagcggcggttgcggcggagcgcggcctccagcgccgggtccttcggggaggaccaccgtgccatgcggcggcgctccggcgacggcggcggcggcgggagggaaggggtgtgagagtgtggtgagccgcgtcggagtgttggacggctgagattggcttgcgataatgggctgtaggattgtaaaaatgggccttgcatatttctttaatgggcctgtttgttggcaattggaataggttcactttagattcctcttcttgacgtcgagtttaaatcacgccctgaaccgcaataccagaaatcatgactcccaacttgcatcccgggttaaattaggtcctctagcagcatagatttgatttggtagatgaaagttataaatttgtactagtactaataattatctcaaccgtttaatttggtagatggaagttataaaaaatttagatgcattcatagcatgacatgtcagtgttagtactaagaatttacgtaaccatcgtttctcttattcgcgaaataagcaaaacggtatattcgcaaatgaaaagtaatttgtgaataaaacttttatatatgtgttcttaacgatctaaaagcaaatgctgaaaattaaacttcaatgaaaaaaaccttaaattcaactccaaatttatggttgaaaatttaaattttggctgataagtataaatataagtgaaaagttgagacccttagttagaaaaagttactccatgtttatatatatttttcctatttttttaggttatagttgacttgtagtattaagggggtgttcgggagagtttagtcccttttgatagggattaaagttttggtgggagagagatagtccctctctcccaaacagcccctaaacttgctcttatggaaagaggtagtacgtactgtacgaaccaagtgcaagtttgaagtttcccaacacgatggcaacatcaggcacggcgatgcgaggtggcgctaacgtccaccgtgccgaccggtttggagcctcctccccgcttgcaacgcaggggacgaggagttaggctctgttcgttctgggggacagaggagattgtgtcccgtcttccaagcgcacatttttcaaactattaaacggtgtattttttttaaaataaaattctatatgaaagttgatttaaaaaatcatattaatccatttttaaaatttaaaatagttaatactcaattaatcatgagctaatggcttacctcgttttgtgtatactcccaatctccttaatccccttctgctcaaacacacccttaggccaccagctacatgcaagaactgcaagctgcagttattaggggtatgtttagtttcaaagttttttttaaaactttcaactttccatcacatcaaatcttttatatatatagtaatttttcagtcacatcgtctctaattttaattaaattttaaactttggttgaaactaaacacactctagatgatgatgcgatgaattctgaaccgggggcctactaccgtctaccactagtctggtccttcccctcgagtaataaacgatccaggcgctgctgctatgctgctgcctgctgctcaatggccagggccagcctgatcctgcagatgatgagtgtggtagagagacagagagaaagccagctaggctatgcatggcagaaagtagtataggagtatgtgcctctaggcacaagtacgtactgtactcctacaggtacagtagagtaactggacggatagatggacgggatcgtcactgtcctcaccctcgtagattgcaccccaaggcacaaaactagggctttgcgtcaaaatggccagagacccgtgccgcggtggtccacgaaagaatctgagagcgcatgtacgtatgagtatcatcttaaggatatgaatgtgttcaaagattatacgttatgttttttaaaagtgtgtttaggcccattattagaattagattttttttataggacggagggagtaattggtaactaagctaggcctaagttactaatactctccctaaataactcaaaccctagcttcccaaggagttttcaaggaaaaaacaaaatagcacaatacccttaattaatgtgaattagttgggtgcccgcgcaattgcacggctagcaccctataaaattatctattttttacatatgattttatttaaaaatatcattattatgtttctaattttatagtttttaaaagtcatgtcaatcgctacacctcactcctttgtcacccctttatttgcttactcgatctaccactacttctattcattctctttacaactttaaaaattagaccttgtagattttagagttcattgtccggtcaaacgtcgtcaatgtactcatttaccacccgttcgctgcctcatctctttattgttattgggattttaaaaaccgaacataattattgtgtgtgttcttttttactttctaagagtcccaccaaaccgtcagcagcttcgtcactacagtcctctacggctctaccgctgcctcccatccttattatcattgagattttttaaaaccgaacatgtttatcattggctttttttttttactttctttaagtcccgccaaccgccataactatgttgtttaacgggctcgtcatttctcctcttaatcatcattgggattctatttttcaatagcctttattttttatgatgaaattttatttatttataaaatgtattcctaattgaaatattatttttctttttctaatttcaggatttagtttattttttgtttcaaattttaattaatattctatatggactattatttttaatattcattatttttttatttcaaatttcagttgtttcaaaattgtattcctacgtgaactctcttttttatttttctaattttggattatattttattcatttaataacaaataagtgagtctggtattgggtttttaataaactctctttcaaatattgctactgtaatttcaaaatttgagttatttttaaagtgtatttcacgagaactcttatttatttttataatcgcggattaattatatttaattgtgaatttaattaatctcgtggtgggttattacatggactcttattttttattttgaatttcagttatttttaaatcgtattttgatttggctcttcttttctttttcttggattaaacccgcgcgattgcgctcatacaaaattactcaaatgattttggtgagctaatattatttcttttccaaacgtatacgcaaagagtggatttttttttaaaaaataataccccaacccgtagatatataccctacccagaatgttaggaggaacaacgaacggtgctattttcaattggattgctgctagcactttagctttgtaattttcgagcgccagccacatcatgtgctgttatgccttgagaattgtcgtccaattgtccatgctgccagtgccaggcaccacaacgtcaacggtgaagggatgacttagccctatcggtagcttttcgaccaatgctacaaatacataaaacgggaaggaaggggactttaaatttgttttattttctccggttacgattttttttccaacctctgtaaggtaaggaactcgttctaataaataccttttcttaaaatgcctctacatacggacctgaaccaataaatcttttttcacctttcaataaataagattatattatgtattattcccacccatcaaaatagccatcttctccaatctaannnnnnnnnnnnnnnnnnnnnnnnnnnnnnnnnnnnnnnnnnnnnnnnnnnnnnnnnnnn

SEQ ID NO: 12522 - DNA, 9648 bp, Oryza sativa
attttttaaaaccgaacatgtttatcattggctttttttttttactttctttaagtcccgccaaccgccataactatgttgtttaacgggctcgtcatttctcctcttaatcatcattgggattctatttttcaatagcctttattttttatgatgaaattttatttatttataaaatgtattcctaattgaaatattatttttctttttctaatttcaggatttagtttattttttgtttcaaattttaattaatattctatatggactattatttttaatattcattatttttttatttcaaatttcagttgtttcaaaattgtattcctacgtgaactctcttttttatttttctaattttggattttattttatttatttttattataaattagttaatcttgtattgggtttttatataaactcttctttcaatattgcttactttaatttcaaattttagttatttttaaattgtatttctacttgaactcttattctatttttcttaatttcggattttattttatttttattctgaattttaattaatctcgtgttgggttattacatggactcttattttttattttgaatttcagttatttttaaatcgtattttgatttggctcttcttttctttttcttggattaaacccgcgcgattgcgctcatacaaaattactcaaatgattttggtgagctaatattatttcttttccaaacgtatacgcaaagagtggatttttttttaaaaaataatacaccaaaccgtagatatataccctacccagaatgttaggaggaacaacgaacggtgctattttcaattggattgctgctagcactttagctttgtaattttcgagcgccagccacatcatgtgctgttatgccttgagaattgtcgtccaattgtccatgctgccagtgccaggcaccacaacgtcaacggtgaagggatgacttagcactatcggtagctttctcgaccaatgctacaaatacataaagcgggagggaaggggacttctaatttgttttatcttctccgtttacgatttctcttcaaacttctgtatgtaatgtactcgatctgattaattacttttcttgatatgactctacatacggactgtatctataaatcttttttctactttctataaataagattatattatgtattaatctccaccatcaaaatagagatcttctacaatctaacgattaatatctttttctttttcttcgattaatatgggaatttctaacgctcacagcgaacgtggtgtcttctttcaaagctgttttaataatataatagatagatgttgtattgaatgatgggtaggtgaggggtattgaagtaataaaatttctcgttttgcagattggtggaacttcgtaggcaagaagtttgaagttggagttggtttattttaagacaaatttgaactttagaagttgatttattttgggattttaggatttaaattttatcccaaaagcatgttattttagagtaatttttatcacatcaatcacctcgaattcaaagttttctttattctactctcaactatcatctcactcccaaccccatatcatttatcataatcatttttgttaaaatttagattttactatcttcgtcccaaaataagtacagctgtgggtatccatgtcaaacgtttgaccgtccgtcttattttaaaaattaaaaaattaattgcacataaagtactattcacattttatcatctaataacaataaaaatactaatcataaaaaatttcaaataagtaggatggtaaatcgtttgatatgaacagtataaaactaactaaacaacctcaaatgataattattgtaggacggaggtggtacatattgaaacggagggagtaaattttatactcctgcgtagtaatagtactagtagttgtaatcttttactcactttgtccaaaaaaaacttaagctaggtgaagatgggatccatcattctatccaaatttcttgtaatataatagattgcatttccacctagattggtttattttatggaggagaagtgtacactatgactgtttgtttatgataagatgcataatttaccttaattattgttagcacgattttcaaactattaaataatgtgtcttgcaccaaaactttttgtaaatgatgctctaaaatataaataaattcatttttaagtttgtaataattagtatttaatttattattcacccatagcttatctcgtattatgtgcatcaaaaaatcttttatcttaacctataacaaacgaggccgtcattccatctagaccccatttgttataggtggagtgacagccttgctttattcggcaatagtttaatctcgtattgtgtgagttaaagaaaatatttatcttgacctacaacaacgaggttgtgtttaggctgtgtttagttccacgctaaaattaaaagtttgaagaaattggaacaatggtacggaaaagttgaaagtttgtgtggaggaaagttcgatgtgacagaaaagttggaaatttgaagaaaaaagttggaatctaaacagggtcttagaactgctggttcacatctcctatttctcgttttttgtgcacacgatttttaaactgttaaacagtgtgtttttttgccaaaattttctatacgaaagttattttaaaaaaatctgtgcatgctaggtaggcatggtttagttcctaactttttcttcaaacttccaacttttccatcacattaaaactttcctatacaccaaacttttagcttttccatcatatcattcaattttaatcaaactttcaattttaacgtgaactatataacacaccctcctattgttgcgaacacagccagttggagtggcgggctcgctctactcctagatccaccagattcgcatcaaaatactctgatgcctagtataccagtagatactcccaggtatacttacactgtttctcggtactcccatttactggggtagtactcgtagcacgaagtaccagtacactctactcctattcgtacctcttactcgtaaagctgtagcctgtaggagtatttatttttctccgtccacgcaacgcattgcattgcaggctacagtacgagaagcaaaaaaaaaaaaaagctttcagagccaaagtcgtgacaacataatctcaaaagggaaaaaaaacaaaagaaacaacggggaaaggaaatgaatcgccatcaatgcaacgcaacgcaacacaacgcaatgcacccccccccccccgccctctccccgggccagtttcgccgtgcccaaatcatgacctcgcgcacgcacacgaacccgcaaacacaaacacacgcgcgcacgcatcgcttcgcactcgcaggcgcagcgcgcaggcggtgatccatccatcatcccaatacatccagcgcgtcgtcaccgcgggaagccagcgtgcggcaacggcaagcggatcggagctcccccgtccatccatggcaaccacctgccgcggccgggctgctgcgcgcctgcgcctgcgcctgcgtgcagcgatgctcctgtcgtcctgtggctctgctgctatcgtcatttccgcagtaattgcggggctgtccagtgtccatcgcttcccgcgaaaagtgggaagcaaatgcggtggcagctctgccatctctgggcgctagctgctgctctgccttgcctgcctagcttccgtttctcctcgcacgcatcagcagcagcagcagcagcagcagcaggtcgcatgcgccacacatttcccgtaacttgatacagccactaggggtacgctggtcgcagtcgcagagcaactagctggcccgcgcgggcagcagagtgcagaagaagaggtgggggtggaggggttcacggcttgatagcgaaaagaaaacaatgcccactttcctctttcaaactccacgcactctctcggtttctcgtgacacaaactatggatgatcggataacgtaactttcccttgccttggtggccgacatatcggcccgatagtggtgaggcttacagtacatatttcacggtgaatagtcacgtcagacgatccttttccgataatagagcatcaacggagttgtttgaaatgcttgatccagagattaatttttagtctttatcacatcggatgtttggacactaatttaaagtattaaatatagactaataatagaactaattgtataaatgatagctaattcgtgagacaaattttttaagcctaattaatctataattagcacatatttactgtagcatcacataggctaattagagattaattaggctcaatagattcgtctcacgaattagtccagggttatggaatgggttttatcattagtacgtttaatacttctaattagtatcaagcatccgattggacattgactaaaaattggttataaagaaaaaaaatcagtcatgtccgtttggcgcacacactctctctaaattcaatgcatggttattttatctccaactacctgggtggcccgcgcgattgcacggttagcacataaaaaaatcatatattttttagtatgattttacttaaaatttattaaatagctaactcgttgtcttcaaactttgaaataccaaatgttatcatccccgtgtttctaattatatagtttttaaaagtcacagtcgctaccccttacttctgacatctcctttatttatttgctcgatctaccactatttatattcattcttcttggaacctttaaaaattggatcttatagtttttagagtttattgccttgttgggtttctttttataatttctagaagtcccatcaaatgttgctattatactcctttatggcccgttgacggagctcgtggcccctcaccgggagaccgcacaggcccccctttgccggttcggccgggggctcagggtgagatctcaagctctcgctgtagatgacggaaagatcgccacctctcaagagaacatgaaacacaagcgatgtatacaggttcgggccgctgagaagcgtaataccctactcctgtgttttggtggatctgtgtatggaggagctacaaagtgtgagccgacctctccctcgttctaggctctgaatctggaaagaatcaaccaacccctttctctatgggcaaggtcctccttttatacttcaaggggataccacatgcacccctccctttccaaactggacttttcttcttttcataaatggacggagatttgcacggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccaagcgtcggctcagcaacgtgcatgtttgcccttcttcacacaacatcttgcttgtaatggttaggatgaagcctggcatatatcgatcggggctaacgtgtcatctctgggatgtaacacgctagctccagccgggaacgagtgcctagaagctctcgtcttgacaggatggggcgaagcatgcgtctgaccgcctgtcgccacctaacccgcgatttgaccggtctgtgactggtcacagaccggataatcgagtgcactgcaccgcacttcgtgcggcgtgacacgcttagccgaggcgcaataaatgcggttaggtgagccctgctgtgctcacctaacccatacacgtggagtagaaaacgcgaggggtcagggcgcctcggccctcgggggcgaggctggagtggtccgacccccccctcggggagaccaagaggtgggcgcacacatcaccctcgggcccgacgtcccccgagggtgccaggccacgtgggcgattgtgtctgcctcaagcctcgagtcatgatactcccagtcccatgtcaccgacagtagcccccggcgttatgccagggcgatcgcccttcttatgggaagcggccgggcgtgacgccactcctaaagcctggtgacaggtgggaccggtctccatggttgggcaaaaacccaacggtctcaaaccatgcacaccggtaatggtaatttggctgtcaataatgggcggtctcttcaagactgccacatcacctgagcggcgcacgaatctgggcgagccgatttgcctcgcctggagatacggtaatgtcgcttcggtcggcgagcgtaattaacgcgcgcacgatacgatctatctcgactgccgcaaccgcatatccatctcacgcgccgcaagcgggcgaatgggattagtggaagcgtgggcgcgagaaacgagggggcgaaataatgggcgcgagaaacgaggagccgggcacagcgttggcaagggtataaaggcactgaggatgagatttgtctccttcctttcgccatcatttcccttgccttcgccgcttgcgtcctaactccttcttccctgcgcccttctttcgccacacgcgctcgctctgaggatctggctgcgctcactgcatgtttgcaatgaggacaccgttggggcgtgtcctcattgatggaggagcagccctcaatatcctttcccccgcagcctttgatgccatcaaggccccggggatgatgctccggccgtcccagccaatcatcggcgtgacgccggggcacacttggccgctaggtcatatcgacctcccggtcacctttggtggacccgccaatttccgcacggagcgggtgaacttcgatgtggcggacctcagtctgccctacaatgcggtcctggggaggcccgcgttggtgaagttcatggcggctgtccactacgcctacctccagatgaagatgccgggccccgacggccccatctctgtccatggcgacctcaaagtcgcgcttgcttgtatggagcagcgtgcggaccgcctcgccgtcgtgtccaagcccgagggcggcgacgagaggcttgacacatccgcccccgccgccccgaagcagcggatagtcacgtccgatgaggtcccggtcaaggaggtcacactgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccacccggagtggctggcgaacccggtggtcgttcccaaggcgaacggcaagcttcggatgtgcatcgactacaccgaccttaacaaggcatgtcctaaggatccttaccccttgcctcgcatagatcagattgtcgactccacagcagggtgcgaccttttgtgttttctagatgcatattctggttaccatcagattcgcatggctagggaagatgaggaaaaaactgcgttcattactcccataggaacttattgttatacgacaatgccctttgggttaaagaatgcaggtcctacttttcaacgtactactcgaatttctttgggtagccaattaggacgtaatgttgaggcttatgtcgatgacttggttgtaaaaacgcgcaaccaggaaacgttgctttcagatttagcggaaacttttgagagcctccgctccgcccgcataaaactgaaccccgataagtgtgtgtttggtgtacctgcgggcaagcttctcgggttcttggtctctgcccgaggcatcgaggccaaccccgagaagatacgagctatagagcggatgcgcccccccagtaaacttagggatgtgcaatgtgtcaccggttgcatggccgccctaagtcggttcatatcgaaactgggagagaaggcgctacccttatttaagctcctcaagcgctccgggccgtttacttggacggaggaagctgaacgcgccctcactcagttgaaagcatatctcagctctcctccggttctagtcgccccggagccaaacgagcccctgctactctacttagcggcgaccccccaagtagttagtgcagcgttggttgtggagcgcgatgagggcaatcctcattccgcgcacccccaccctgtgctaacttggcccgggagcgagcagggaggagaggccccgagccgaacggtggcctaaggcccctggcgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggagggagcagggagaagaggcccccgagccgaacggtggcctaaggcccctgacgaccagggttggccctttgcccgcttgtccgacgacgccaggagcccccgacccccaggacggccccgaggccactgcgggaaggccgcccctgtcgtcctccgaccccgaggtcatcggcacagaagacgagtgcgccccgaggggccacttggacgaggagcgccccggggatatggcccttagcgaaggggatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacccctctcagctgcctcacaccgcccactgggtgatgcagttcgacggttctctgtctctccagggcgccggtgcgggggtcatgttgacctctccgaacggagacgtcctcagatacttggtccgtctcgactttcgagcgaccaataatatggcagagtacgagggactccttgccggactcagagtggcagctggactggggatccgccgtctcttggtgttaggcgactcccagctagtcgttaaccaagtctgtaaggagtaccggtgctctgacccgcaaatggacgcttacgtacgccaagtgcggtgtatggagcgccattttgacgggatagagcttcggcatgtgcccagacgggataacatgattaccgacgaactctcacggctcgcgtcctcgcgagcccagaccccaccgggcacctttgaagaaaggcttacccagccgtcggcgcgacccgaccccctaggggagacggatgtgcctgaccggcccccgaggtccgtcggagtccaggcctcgggacccgaagggagcgctgcaagctcccttagattgattgc

SEQ ID NO: 12523 - DNA, 2725 bp, Oryza sativa
tgccagagtacgaggggctccttgccggactcagagtggcagggggactggggatccgccgtctcttggtgttaggcgactcccagctagtcgttaaccaagtctgtaaggagtaccggtgctctgacccgcaaatggacgcttacgtacgccaagtgcggtgtatggagcgccattttgacgggatagagcttcggcatgtgcccagacgggataacatgattaccgacgaactctcacggctcgcgtcctcgcgagcccagaccccaccgggcacctttgaagaaaggcttacccagccgtcggcgcgacccgaccccctaggggagacggatgtgcctgaccggcccccgaggtccgtcggagtccaggcctcgggacccgaagggagcgctgcaagctcccttagattgattgcttggatctccgagatccaagcatacctcacagataagactctacctgaggaccgcgaagggagtgaacgcgtccaacgcatttccaaacgctacgtgctggtagaagggatcctctatcggcgcgcggctaatggaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtagcccgaggcttatccggtcgtcaagatcgataagcactctgcacttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcatggatcgaggagttaccagcggtgctctgggcgaaccgaaccacaccaagccgagcaaccggggaaacgcctttcttcctcgtctacggcgcggaagcggttctcccatccgagctcaccctgaggtctcctcgggctaccatgtactgcgaggttgatcaagatcagcttcgtagagatgacctcgactacttggaagaacgaaggcggcgtgcggccctccgagctgcacgctaccagcagagcctgcggcgttaccatcagcgccacgtccgggcccgatcactctgcgttgacgacctcgtcttacgccgcgttcaaacgcgtgctggattgagcaagctctcaccaatgtgggagggtccgtatcgagtgatcggtatcccccggccgggctccatacggctggccacgggcgacggcacagagttgcctaacccttggaacatcgagcaccttcgtcgcttctacccctgagggggggtcgggtgtcaggtttcgggctcgggtcaaccccgcaccccccctcgggtgtgcagggttgaccgggggctgccacacatgcacattctcatttctctcatttcagtatttcaataaaagcagtttcaatttcctaagggctgtatctgtgccgtttttttttcctttttgaagaattttgacttgaaataaggtcactcgtgctcaaccttgccctcgggggctcggttcggtcagctaaaatcgccaaacggggcccagaaccgagccgtgcccggggcgtggtgaactccgggggggaatcggcaaaaacccacaatcgggtcacccataaccctcggtcaccacgttcccggcctggccagtctcgacatgcggatctccccaggcactagtcccgacccgcgcttttcgaggactgggacttgggcacgggcccttaaatcaagctaagacacaaaaagaggatcacggcacagatcatcctcatctcattcgcatagcaaaataaaattaacacaaagaattttttcatcatttttgattgcagattgtaagttgatttatacaaaaaacaggcccgagggccttagaagaaagaaaaagaagaaaattgaagattggcgggggcctgggggctcaatccgatgcgcccgggtcgccggcctcgtcttccacgtcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttgaagagcccaggccatcttcgtgaggtgcggagcgaggccttccaggttggtggagtgcgtccttgtctggcctttccagaggcccgcttgctggccggcgcgatcca

SEQ ID NO: 12524 - DNA, 908 bp, Oryza sativa
  unsure (1)..(908): unsure at all n locations
nnnnnnnnnnnnnnnnnnnnnnnnnnnnnnnnnnaaggcggaggaaagtggtatcagagccatctcgactgtagggtaagccaagtggataaaacctaaggacatattttataaataaaactatttgcgaaagttcctctttttctccttcccctaatgctatttgcaaaaggtttactcttttcttccttcttcaaatttcaattagtactagttggtcagatttgtgaagaaaaagatatcgtcagttgtttgccgaagctccggaagactgcaggattcgctagcgaagtgtaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggttgcgcacagtcgaga

SEQ ID NO: 12525 - DNA, 1534 bp, Oryza sativa
  unsure (1)..(1534): unsure at all n locations
cgaaagtgagcataatcggatgaagaactgcaagaagaaggattgtcaccatcccagtatttccaggtggtaaccaaagacagcgcactgagccacttcagatcaccggatcttctgttgtgcatcaagagttcctgccccaagaagatgaacacaatgcagacagcaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaatttcgacactgagaaagactccaatggtgatagcaactatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgctgtacctgtgaggcctcatgttaattctaacccatagtagaaacaatgtaccgatgttaagcaccttccctttttgtttaagacagtgccttgtattcatgaaatatgggagaaatttgtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaatcaagtgattaaccaaagagacatttgtttggactaagagtttcagatgtgtctttttcggatcgaaggcaatgacagtcagtatagcttttggcgaaacacttcaaggtttcactgaaaggtagcagaccaaaggaccacatcgtcaccagaagcatccacaactctcggagagaagagtacttggttggcaaagtttaaaaggtgattgatagaagataccagcaaaggtgtttattaccgggcaaggaagtaggtcgaaaggtgattgataagagaaatttgaaaagaacacatcagggttgaatgtgtaaaggaatactttgaatgctaaatgatgacaaacatggtatcctagtaatgacaagctagtgttgacgcatgacatgaagtggtaacttgtatgaggttgactccaaagatatgagttataagaagttctggaactgaagccccatcttccaatgccgcagcccagtcgaagtcagctagaggtgcaaccagggaaaagtcaggtgaagagaagattccatctgcaacaggagattgagccaagcagtccagagtggagaagttttgctaggcaagtttgttataaaagatgcgannnnnnnnnnnnnnnnnnnnnnnnnnnnnnnnnnnnnnnnnnnnnnnnnnnnnnnnnnn

SEQ ID NO: 12526 - DNA, 3341 bp, Oryza sativa
gagttccggttcgccgccgccgtcgctccggacttcctccccactcggcgtcacctccatcggcttcgccgtgttcccgtcgacctcgtccgcgccttcgcttcgcccgccgaccgccggagctccgtcgtcctcgccgtcccgaaccgcgccgccgccttcttccgcttcggccgccgttcccgtcgtcgccgtcgaccggggtgagccgaagaccgttccgttcgcttcccccttccctcctctctctcgggtgccgctccgccgcgccggtggtcgccggcggtgaccatcggggcgcgggcgcgttcccctcccgtcggccgtgccggcgaggccgccttcgggcgcgccctcgcggctgccaagtgggcccggccgtcagccgcccgcgcccgcgggtgcggctgacgcgtgggacccacggcgccgaccgccgcaaaacgcgtgctcccggtccaccgtggaccgagaggctgacgcgtgggccccactcccgtggacccggtccgcgcgccctctccctcggctgacgcaataaatgcgtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagtcgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcgtggtatccctagtttaaatttaggtagatgcttcgcaatttaattaggtaacattaggtggttttataactttagacttgggaaatattcatatcacctggacactgtggaattgttggattattgtggaattggcttcacaccgccccctctattcaaaatcccctaaaatggttttaggctgggctcggggtgcatggttttgatggtagcacctcggccatataaggaccggtcttcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacctgcttaacaactaaaatatggaatggttggcctgggttggcttaggacgagctgggacccagggtcgggttgccagttcggtctgaatcatcgtaggccttgggttaaggcaggttcgtgtgggttcacggccttgattaataatattgtttagttctaggatcgtgtttacaaaatagcttgagcaactaaatgtctttaaatgctgtttactgcaaccctaacccctctatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctctgtgtgtgctgggccttcgtcgcccatgtaataaattaactatttacgcttccgcttgttaaactctgaattgtatcaacttttggtgtaccttgcctcctgggacaaggattaatgcacgcacgtaaggaatgcccgttgggttatttccggtcgtgacaggaatcctgcgcctcgatcatcacagtggtggcgatgagggcagccccccgctcctcctccacctctcgtgcgatctccgccagtgccgtcttgcgggcctcaagatctgagacgtgccggcggtgtgccttgcggcccgcttctaccatggcctccaccgagcgccgcccctcctcgacacgcgcccatgcggcgtcgagctccgcacgctccgcctgcagggcctcacttgggcgctgaacccatctagcaccgcggtgtttgcggcggccaaggcctgcagaaggggctcggcgctcagcggggcgacagaagacgaggggaagagctgccttgaagaagacgccgcgcggctcggcccgccaatggacgcgccggcctcatcgcgggccacccccggacctgtttggtcctgggcgtcgcctgaaggggtgggcccaagcgaggcgtccgcggcctcgtcgtgaactgcctcggaagccgccatcgcctcagcccggcgaacccgggcggcctcctcccgagcggcttcttcggcctggcgaacccgggcggcctcctcccgagcggcttcctcggcttggcgggcccgggcggcctcctcccgagcggtatcctctgcatggcgagcccgagcggcttcccgggcggcctcttcagcttcccgtaggcggtctgcggcctctcgccggtcagattcccgcctccgtgcctctgcggccgccggatcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgacccccttgaaggggaaattaggtttccccgggatggttctgtctcccccatcttgcgcagc

SEQ ID NO: 12527 - DNA, 751 bp, Oryza sativa
cacacccatgctgcacaggcccaaccatcctgaacaaccatacccggctgtacagatctaactccaaaccaggagctaagcaaattattaccaggtataacatctataattattgtgagaggtgtgagactaatcacgaaaaacattgctcaacccgcccataaccgcgggcacggctattcgaatagttttactctgatcagaggtgtaccactgtacccacaagacacagctccacatcatgtcaccatttgcctcagtaccaccacggtacctcggaaaggagctgtgacattaccccttgcataacacaatccaccacagcgcaccttcgtggatcataatcacccccttataaacaaggcatggactccccagcgacccccgtgggcttatctccgccacttctcagtctggtgctccgcaatgaaccatgctatacaaaaggtaaagccgttgcccacactggcttgtggttggcacggttaatgttccacaacagtagctcgcgaaccagtccttaattgtcatgagcacgactctcaaaaccatgtgctcacaacccaccattatcaagttttagttggcaagtaattaattaaccaatcacgattgaccatcgtgagataccattaaatataaccataagtgatagtgaaacattagttatcccaattatgtgctaatgtttctaagcatggctaagcaatcatatctaatatctagctgaaccaatatataaagcccagct

SEQ ID NO: 12528 - DNA, 1189 bp, Oryza sativa
accctcagtcggatggccagactgagagggttaatcagtgcctggagatttatctcagatgttttacacatgcaactccttctaagtgggcagtgtggcttcatttagctgaattctggtataatactgcattccactcagcactgaatacatctccctttgaagttctatatggccacccacccaggtattttggaattcattcagaggattgtgctattcctgaactacaagtttggctcaaggagcgtagactgatgcattcattgattcagcagcaccttaaccgagcccagcaacacatgaaaaatatggctgacaagaaacgcagtttcagatcttttgaattgggtgactgggtttatattaagttacagccctatgttcagtcttctgtcgcagctagggctaatcataagcttgcattcagatattttggccctttccaagttattcagaagtttggctctgtggcatacaagctccaacttcccactactagttctatccaccctgtgttccatgtgtcccagcttaaggcagccaagggtttccaaggagcattgcactccactctgccttcttctgatgatgctttccagtatcctatcatgctcctggataaccggctgattaagaaaggtaacaccaccgtttcccaggttttaatacagtggtctgatactgcagttgaagatgccacctgggaggaccttgaggatctccgggcgcgttttcctgaagctttggcttgggggcaagccactttccaaggggaagggattgtcaaggcgtcaggcgaggaggagccgagtgcaagcgccaagctgaagatgaagcctgtgccggatggtgagcaggaaggaggagaagaagacttgaggccggccagagtcattaggcctaatcgtaaatatgttgggccggaatgggccatgtaacctgtatcgctggcatgagctggcatctgtcttgtgagaggggaaggaagggagttggtagcgagagagagtataagaactgaggtttctaaattgtaagggacttttggcaatctggtggcgaatggcggcggcggctcaaccctgttgggttggagcaagattatcctagcaaaagattgcctaaacacatctctgttcttcctgagttgttcgaagttcttcccttttccttttcaatttcctta

SEQ ID NO: 12529 - DNA, 1326 bp, Oryza sativa
ttccaaaagggaaaaggggaggagatcccgaagattgtttcccccaatcaattcggccggagaaggaaagacgcggccgaatttggaaagcggcggcggagcggctcggctagggttttgggcggcggcggcggcgcgaggaggaagacgggcctgacagacaggccccacctgtcagcggctgaaagagagaggagagcggcggctcggcggactgggccggcttgggccgagaagagagagaaaaggttttgggccgactttcggcccaaagccaaaagagacttttaaaaacccttttcaatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttaaacttttaaaatcatttctaattattccttttaaacaacaatttataatttaaggattttaaacaagaaaagctcttaacaattataattagatcattaatgatcaaataattactgaactgttctttgtattatttaagaattgagctctgaaaaatccgagaaaatttcagagagtataattaaccatggagaatttaataaaaattaaatccatccatgctttatatttaggaaattttatttcccacatttaacttcacttgtaaattaaagatcatttaatataaattctaataataatttattaaatagtttataaatcctgaaacgaaaatcaggatgtgacactgctcgaaggcgaactcacaaggaaaatcgccaataaggaaccacaaacactcgtgcacttgcttcgcatcattgacggtttcgcaaggggcgaagaggattccaagcgacggcaagccatacaagctgagtacgataaagcttctattgccgctgctcaagctcaagcacaagttcaagttgccgaaccacctcccctcgcggttcgccagcctcaaacggcgatccaaggacagccgccaaggcaaggtcaagctcccatgacctggagaaagttcagaaccgaccgcgcgggcaaggctgtgatggccgtcgaagaagtgcaagccctccgcaaggagttcgacgcccagcaagcgagcaaccatcaacagcccgttcgtaaaaaggtccgaaaagacctttactgtgccttccacggacgctcttcgcataccacagagcaatgccgaaacatcaggcaacgtggcaacgcgcaagatctagaccacagcaaggagca

SEQ ID NO: 12530 - DNA, 7968 bp, Oryza sativa
aagtaaaaattagacatattatatgccatgaacgaaagaatagggatctaaaatagacttttttatctatacatatgtcagccgaagaggagggacagaaaatagacttattttaggtatacatatgtcagcccaaagaggagggacggaaaatagacttattttagctatacatatgaaatagtccaaagaggagggacgaaaaatagacttattttaaaaaaggcccgatgggccacccatgccttcgggccggcacggcacggcccgacaactggtgggccgtgcctgggcgggaggtgcagcccatgggccggcacgccccggcacgaagtgcctatcgggccgtgccggcccgattgctgctgggccgtgctcggccgtgcctgggccgggccatgccgggcgggccctttggccatctataggaaaaaggggatgagagagaatgacacgtgggttccacatatttttttaatgacaaataggtcccacatatttttttaattctaatgacacaaatgtgtcacgtcaacgccacgtaggacgaagaccgggtcaacattgccacgtaggcatcacgtcagtgaaatcaccctccaaaattaccgagggagttagattgcatcggttttaatagttaggggttgagatattcggttttgtggtttaagagagtcaaaatgagcttattcctccacacgtccacacggggcaatcttgttaattgggccattgtttctttggaaaaaaaaagattgggccggtcggtgctggacctgctggtccattttgtcactagagctcgacaaacacctaataaaatattgcggattttagatcatcggatgctttaagattcatgcagtacgacataaacctaaccacatccctcacaccagtgtcgcacgagaatcgggatcaagcgctactcactcgatgtccccccccctcttctcaagtcagtagcggtgaggtaccccgccccaccagcccccatcctcgttagctcctaaccactaggagaggcggatctaggatattggatcaatggtgtcatcgttaaatcataacaattatcgtagtttctaacaaagtaataatatacatgaaaagtaataagaataatgataagtagtagagttaataggtggaataatgtagatgaacttgcataataattcaaataaccagcagttaaacatccagtgatcgcatggtactaaaactaagttaccatcctgaaaaaccacaaactatatactagatcatactagatacatatatgcaaaataaatagcaccacaagtattttttttctacacaaacataatattacaaatgaatattaaaaaccttagaccaggtgtccgtacactatccaaccggcaccaaagaacaacacttaacagctcggagccttagagcccccaaaatctctagaaataaaatacctaaaccaaataaattaatagaagtttttaaacattatttaggtgacatgttatataaatgtaagtggaaaagaaatttgtttgcaaactgaatgggaagttggaaaaattcattgagatgttgggatatgcgttattgattagacacaacatgttcgcctgctcactgccaacagcccaacaggcaatagctagccggctgggttgtattagctaactttagccgaagcaatttaagcaaatgatgggctttcatggctgcttccatggacgtggtggtgtcaaaggataaatctcactggtgtcatccatcatataaaatctatagtttttgccgttgcaaccacagccgtccggcactgtacgctactgttttactgtttcactgttgcattacgccaggagccgttcgattgtttgcttgactggatccagccgttcgttttttccttctttgcagccgctaccagctcccagatattcctctggtcgttcgcatctacgccgccgccgccgccgctgccgcggcttctaggttttccattccccatccgctcccgcgacttccttcgcgtctccaccgtcgccgctccaccgtgggttcttcaccgctcgcctttcccctcaccagatcgatatatccctttcacccgcgcagtctccatcgccgccgtttctttgtctctctaccccgtcgagccgaaatcgctgccatcgctgatttccacacaatcttctgctacggtcgtcctcagccatcggcccgctattctatcaaggcctgctggcgtacatcttcattggctggacacaccgtccccaacgggatcgacgggtgcccacggctgcaggtctgcccgccccttcaccgctaggtgcgtatgtttcgtctccggtccatctctctcctctctgacttctgagtgcttgactagcttaccatgttgttgctgtagtttgaacataggccaagctatgtttcgtcctcagccataggccatctgctcgggggtaatggtgggtgcccagttggtgaggttccattgcatcattttgtgagttacttggttagggtgttggtgtttatcttgctttcacatggttctgaaatattgcttatcatgttttatttatcttgattatactgtgttgcttttgtctttgtcattcttcagttaagaatggttgctgcttagctgctaatctatagtttattttaggctcaaggggattcactgatattaaatctatgcttacattagctatctgcttattatgctatgtttcatgccgtgtttatctgtacttccggaacaatttaaccatgtttttacaactaacacttgttctcttcgccgctcctattttgcacccagatcctcacggctcactgttcgacagagcgaaccgtgcgagcccgccttgacgggttcaaaagccgtcttcgggccaaggatgatgaattaggccgcaaaaatttggagatggaggcccttgcgaacacccttaaggaggcgaaggccgaaaacaagcggctccaatcggaacgggagaaagggaaggaagctagggccgaagtcgatctcttaaaggccgaactggagaaagagaaggcccactccgccgtgctcatagattattacaacctcaccgagccgaagatggaggctcttcggcaggaggttcgcaaggccgaagcaagcgctacggaggagtcgcggcggttttcgcgggagatggtgaaaaccacctagtccgcgcggacagcgtgccaaacgctccgcctcgccattactgatatgggcgcaaaagtgcagggtgtcccctccgaagatgcctcagccttcgacttctccgaatggacccaacaggctggtggttcggtttcggactgcgccaccgcatacggcgactgctgtgcgcgcgtgtcagcggcctttaccatgggcctcctgcagcagttcggctgcgagcacatcgccgagttccccaagtacgcgaagggggattgggaaatcagcgcgcaagacatttcgcccgcacttcgtgcgtagcgaaaacaattctggcagaaggatggccgctccgccgctaaggcgcgccttttggagcagctggtgaaagcagaggcggcggacctttgtgaagaggaaggcgcggcggccggagggggtggaagcgatgcccaggaccacccagaggtgtgaggccctccgcccttctcttagattttcatagttttcttttggtgttcgctagatgtggcgaaccattgtatattcggcaatctgccgcaaacccttttattgtaaccgaaacaggtggccgttgggcgtttttaaaatttgtataacagacctacttttcgccatttactgtcggtccaagtctttgacatattattatttcgctcatttcgcattatgccatacctcccccttcttccgcctattcctaccatgtaagctgtgttttgcttttttctgcactgtctatgtcacatcctgattttcgtttcaggatttataaattatttaataaattattaatagaatttatattaaatgttctttaatttacaagtgaagttaaatgtgggaaataaaatttcctaaatctaaagcatggatggatttaatttttattaaattctccatgattaattatactctctgaaattttctcgaatttttcggagctcaattcctaaatgatacaaagaacagttcagtaattatttgatcaataatgatctaattataattattaagagcttttcttgtttaagaatccttaaattataaattgttgtttaaaaggaattattagaaatgattttaaaagcctaaaagagaagatctaattttaatttgttaaatctcaatataaaattgggctaaataaaattttgttaaatactttgcttaattctataattcctagatttttctgggatttatttgagctaaggaagtatttttaataaatggaattgcatttcatgaataatttaaattgaaaaaggttttaaaagtcttcttttggctttgggccgaaagccggcccaaaaccgctctctctctcctcctcggcccagtccggcccagtctgccgagccgccgctctcctctctctctcgctgtcgctgacaggtggggcccgcctgtcggacccgtcgtcttcctcgcgtcggccgccgcccgaaaccctagccgagccacgccgccgccgctttccaaattcggtcgatcctttccttctccggccgaattgattgaggggaaacaatctccgggatctcctccaccttttcccttttggaatcatcctctacttcggtttggaaatcgatggattcgagtttgttttggattcgttcttcccgaagtttccttcgccgtcgccggtcgccgtgggccttcgccgccgccttccaacccctatataaggatccccgagctctcctctacccgtcgcctcctttgccttagcctgccgtcgcgtctagcgccgcctccgcgtagcctagtcgccgccgtcgttgccgtcggttcagccgcgtcgcgccgccgttgcagccgtcgtcgtcggtcgccgtcgccaccatcgggttcgcaaggtcgtcgccgtccccgtccaccgcttcgccgccgccgaagaccgccggagcgccgtcgccgtcgtcaagccgaagagcgccgccgcttcttcttcgtcgccgtcgccgtccgttcctcttccgccgctcctttggtcaccggtgagttcgccgtgtcgtccgcttcatcccggtgctttccgttctcgtcgtcgcgccgccgttcgccggcgagcatgtgcgtccgagccgccgagccgccgccgccggtggtgacgtcatcactggcgttatcgtcccttctcccgtgagccggtcgtggaccgatcgatctcggccgtccgttttggatcaagtcgatctcggccgtccgttcgcgtgaaccgtcgcccgtgcgcccggtccaccgaaaccctagtccgctgacgcaataatcctcttttccttttcaaaaataattcattattgcgtcataattcaattaaaatccatataaaggttttaatccgatttaatctttaaaaattcataactaattcatttgaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattgtaatctacatgtttgtttactttttatgtactgtttatttggtttttattagtctttttcttcgttttgcgtgttagcttgtcgtttccgtcgttgcgaaggttcgcaagtgcgccggaagtattcaagaagattaattgaagaccgattattgcaaggcaagtcacacagatcctaaacacaatcctttgagcatgttgatcctatatttaaattctctatatatttcaactgtgcatttattttcgaatgtcactgggtggtgtgaacctattcctttgttatggcctgtttgcattgattactttattccttgataccttgggttattataacttgactagctgggctttatatattggttcagctagatattagatatgattgcttagccatgcttagaaacattagcacataattgggataactaatgtttcactatcacttatggttatatttaatggtatctcacgatggtcaatcgtgattggttaattaattacttgccaactaaaacttgataatggtgggttgtgagcacatggttttgagagtcgtgctcatgacaattaaggactggttcgcgagctactgttgtggaacattaaccgtgccaaccacaagccagtgtgggcaacggcttaaccttttgtatagcatggttcattgcggagcaccagactgagaagtggcggagataagcccacgggggtcgctggggagtccatgccttgtttataagggggtgattatgatccagaaaggtgcgctgtggtgaattgtgttatgcaaggggtaatgtcacagctcctttccgaggtaccgtggtggtactttccagtatcgcgaggcaaatggacatgatgttgagctgtgtcttgtgggtacagtggtacacctctgatcagagtaaaactattcgaatagccgtgcccgcggttatgggcgggttgaacaatgtttttcgtgattagtctcacacctctcacaatatttatagatgttataccgggtaataatttgcttagctcctggtttggagttagatctgttcagccgggtatggttgttcagaatggttgggcctatgcagcatgggtgtgctgttcagtgttgattaaaatttctgattaattactccactgttttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgtagttttcttcatgttgaggactaagtgcctcttaagtaagtatatattcgctttagttattgatgaatctgtatattaaattgtcagtttgtgtacctcggctgattcctggacgaggattttatgcacaaataagttcggaaattactagtgaatttccgggcgtgacagtctaccagggggttcgccgaaagtcgtgcattcggcctcctttcgggagctggcgaagtcaaaccgagaaatttgtggcgttgaagggtctgccgaaggtgcgatgtccatttcgtcctacttatcgcgaaatggagataaacggtcgcagctataaggttttcaaggttgccgattggctgcgggcgcaccccgggcgaaccttagaagattacgatcttgttcattcaagacgtttggaggatatggctcgcttttggcgaaaccatcagaagactaaacgtcaggaaacgatctttcagcgtcgttatagtttagtctgtgtttcgccccctactcctcttaaggttgtgtatgatattagtagtgatgacgaacctagttcgcctgacccttccttagggagggatagtgattatgggggcgaagatgtatttttacttgtaaggtgaattgtatcgtgtgaaccttctattctttcgaagttaataaaaatgtgttttatttccttttcgctatttttcgcatcgtcacattttgtgcttttgttaggtcggaacatgccggcccctttgcgtatattagcgaaataggtgtactgacttt

SEQ ID NO: 12531 - DNA, 4916 bp, Oryza sativa
  unsure (1)..(4916): unsure at all n locations
cttcttccttaggacgagatgaccaggcatcagctccgtcggtcgaacttttttgttgtaagttgccgaagtgcttgtggcgtacttgtgcatgtgctcgagcgcttcgactcttaccccttccaagagttcgagcgatacttcgcggccctcttcgcccccagagaacatcacccttggtgagttagcccctagctctactggggtcattgcctcatcgccataaagaagcataaacgggctaaacttggttggtcttgtgggggtcgtccgaagggcccagagaaccgatagcaattcctctggccatttgcctttcgctgccccctcgagtcttttctttagtgcttttagaatcttgccatttgtacgttcggccgccccatttgactgcgggtgcgcgaccgacgcgaacctgatttccaggttaagcccttcgcacatttctctgaacttatcagagtcaaactgcttgccgttgtcagtaatgaactctttcggcactccaaaccgacaaataatgtttttttccaaacaaacttctgtactgctgccgaagtgattgccccaaggggttcggcttcgatccaccgagagaaatactctatggccacaattacgaacttgtacccgtttcgcgctaccgggaacgggccaatgatgtccagcccccacctggcgaagggccagattggcgcaatgggttgcaagttataatggggcgcagattggcttcggccatgacgttggcagctttcgcactttttaatttgctcagcacagactttcaacacagttgaccagtaaaccccttgtctaaataccttggaggccaccattcttgcagcttggtgcgcgccacatagcccctggtgtatttccctcgccatttcctcaccttcggcgaaagagatgcaacggagtagaggttgaagcgtcccggagcgataaagttggcctgagaccaacttatactttgtggctctgatttgcaagcgctttgcttctgcttcgtcgtccggaagccaaccagcttcaagatatttaacaaacggggttcgccagtcatttgggtcttcgcccagtttcacttggtcgattgccaagactgtcaaactgtccacaggcaaacttggtgtgtgcagtacttcaaaaaatatgccaggcaaatgcggtccgccacaagcagcagattttgccaaggcgtctgcttcctcattctggcccctaggcaagtgttcaactgttatgccgatgaagtacctttccatggttctgacagcctccaaatattttttcattccttcttcttttgcctcaaaggttttgtcaacttggcctgccaccaacttaggatcggttcggattagcaagcgccgaactcccagtgttttcgccttccttaggcccagaagaatggcttcgtactctgctgcgttgttggttgtattaaactgcagtcttgcggcgtaccggactggtacgccattcggcgaagtgagtattgccacaatgcctgcccctttgtgcgaccacgaaccgtcggagcacatcacccagggttgttcgacgggctcgggttcggaagcgaacacaggtgtccattcggctacgaagtcagctagtacttgagacttgacagtcgtgcgtgcaacaaaatgcaagtcgaacggggatagctctgccgcccatttgctaagcctacctgagatttccttgcctcggaggatttcgcccaaggggtactgcgaaggcactattaccttgtgggcctggaagtagtgcttgagcttgcgcgaagccatcaccagggcgtaagcgagcttttccatttcgatgtatcttgtcttcgccccttacagtgcttcggagacaaaataaaccggtttctggccggactctgtttcttggacgagggcagcactgaccgccaccggcgaagctactaagtatagcagcagttcacttcctggtgttgggcttacgagggctggtgggctctgcaagtattgctttaactcggcgaatgctgcttggcattctggtgtccaactgaactttcctgcgccccggagggtcttgaagaatggcagacctctttcggccgcttttgagaggaaacggctaagtgccgcaattcggcctgcaagcttttgtacttcatgtacacttgacgttggcttcatttgctgaatggcatcgattttctcggggttcgcctctatgcctctttcggaaactaggaaacccagcaatttgcccgcgcgaacgccgaagacacacttctcaggattcagttttatgcccgctgcgcgcaagttgtcgaaggtctcctgcaggtcggacacatgatcgaaagccctacggcttttcacgacaatatcgtcgacataagcttctacatttcgccccagctggttgcaaaggactttgtataccagtctggcaaaggttgctccggcattccttaggccgaaaggcatcctgaggtgacagaaagtgccgaacggggtgatgaaggctgtcttcgggatgtcaggcggattcatatggatctagtgatagccggaatatgcgtccaggaaactcatgagttcgcagccagctgttgaatccacgagctgatcgatccgcggcaaagggaaatcgtcctttggacatgctttgttcaggtccgtgaaatctatacacatgcgccatttgccgtttgacttccgcaccagtactgggttcgccagccactctgggtggtcaatctcttgaataaccccatccctgagtagtttttggacttcggcttttgccgcctcttgacgatcggcgaacatcttatgcaacttctgctttcttggcttggcatccggcttgactgccaggtgatgcatgatgaggtctgccgaaacaccccccacttcatcggggctccaagcgaaaatatcaatgttctttttgagcaccgctaggatgccctcagcttcttgttcacccatgccgtcccccagtgatacgagctttgcggggtcggcatggtcaatctgcacttttactattttgtcatgcggggtgggctttggcacgtgtttcggccggctgtgcaattcggcttcgacattgtgcacaaccctgttgattatggctagatcgccttttgacgccgccgaagactgaagccccttgaccactatcactcccgctgggccaagcatcttgagcttgagatagttgtggtgggaaatggctttgaacttgttcagggtcgcacggccgaggatggcattgtaattgtacgggatgtcaacgacgtcgaacagtacttgctcttcgcgtctgttttctcccaagccgaaagctatcagcaaaagtgcttggccaagaacttgaactgcctctccgccgaacccccggagcgacgctggtgctggtgtaagagcttgggttggcaaccccatcttagcatatgcttcggcgaagataacgtcggccgaactccctccatcgaccaggattcgccggacttcaaagccggctatctcagctgagaataccagcggatcttgatgcgggaacatgactccttcggcatcttccggcccgaaagagatcagctggttcacatactgtggcgccccctcacccgccgaagtgatgctgtggaccgctcggatctgcatctttttctgccttttggataattggcctggcgggtcagccctcgtaatcacttgcattacccttcgctgcgcgtcttgacgttgttcgaccgggggtgtttgttcttgggctgcttcgtgaggtgcttctatagttgctccttgctgtggtctagtatcttgcgcgttgccacgttgcctgatgtttcggcattgctctgtggtatgcgaagagcgtccgtggaaggcacagtaaaggtcttttcggacctttttacgaaccggctgttgatggttgctcgcttgctgggcgtcgaactccttgcggagggcttgcacttcttcgacggccatcacagccttgcccgcgcggtcggttctgaactttctccaggtcatgggagcttgaccttgccttggcggctgtccttggatcgccgtttgaggctggcgaaccgcgaggggaggtggttcggcaacttgaacttgtgcttgagcttgagcagcggcaatagaagctttatcgtactcagcttgtatggcttgccgtcgcttggaatcctcttcgccccttgcgaaaccgtcaatgatgcgaagcaagtgcacgagtgtttgtggttccttattggcgattttccttgtgagttcgccttcgagcagtgtcacatcctgattttcgtttcaggatttataaactatttaataaattattattagaatttatattaaatgatctttaatttacaagtgaagttaaatgtgggaaataaaatttcctaaatataaagcatggatggatttaatttttattaaattctccatggttaattatactctctgaaattttctcggatttttcagagctcaattcttaaataatacaaagaacagttcagtaattatttgatcattaatgatctaattataatgttaagagcttttcttgtttaaaatccttaaattataaattgttgtttaaaaggaataattagaaatgattttaaaagttttaaaagagaagatttaattttaattggttaaatctcaaaataaaattgggttagagaaaatagatttttttttgactaaatcaccggggggggagagaatccccacctgaatatattgagccaaatgatctaaccaagggcaagctttacctacgcaagcgcaggggccctggaggataggagaacagaannnnnnnnnnnnnnnnnnnnnnnnnnnnnnnnnnnnnnnnnnnnnnnnnnnnnnnnnnnnnnnnnn

SEQ ID NO: 12532 - DNA, 5207 bp, Oryza sativa
tattattagaatttatattaaatgatctttaatttacaagtgaagttaaatgtgggaaataaaatttcctaaatataaagcatggatggatttaatttttattaaattctccatggttaattatactctctgaaattttctcggatttttcagagctcaattcttaaataatacaaagaacagttcagtaattatttgatcattaatgatctaattataattgttaagagcttttcttgtttaaaatccttaaattataaattgttgtttaaaaggaataattagaaatgattttaaaagtttaaaagagaagatctaattttaatttgctaaatctcaatataaaattgggctagataaaattttgttaaatactttgcttaattctataattcctagatttttctgggatttatttgagctaaggaagtatttttaataaatggaattgcatttcatgaataatttaaattgaaaagggtttttaaaagtctcttttggctttgggccgaaagtcggcccaaaaccttttctctctcttctcggcccaagccggcccagtccgccgagccgccgctctcctctctctctcagccgctgacaggtggggcctgtctgtcaggcccgtcttcctcctcgcgccgccggcgccggccgaaaccctagccgagccgctccgccgccgctttccaaattcggccgcgtctttccttctccggccgaattgtttgagggcaaatgatccttgagatctcctcttccttttctcttttggaatcatcgcctaattcggtttggaaacttgtggattcgaggtcgaatcggattcctctctttcctccgaatccccgacctttccttctcgccgccggtcgccgtgggcctccgtcgccgctcgctagcccctttataaggacccccggtgtctcctctacccgccgccacctttgccttagcccgccgtcgtgtctagcgccgcctccgcgtagccttagtcgccgccgtcgttgccgtcggttcagccgcgctgcgccgccgttgcagccgccgtcgtcggtcgccgtcgccgccatcgggttcgcaaggtcgtcgccgtcctcgtccgctccttcgccgccaccgaagaccgccggagcaccgccgtcatcgtcgacccgaagaccgccgccgccttttcctcgtcgccggcgccgtccgttgctccttcgccggtgctttggtcatcggtgagttcgccgcgccgcgctcttcgtcctggagctctccgttcgcgaccgcgcgctgtcgttcgccggcgagcgtgcgccgtccgagccgtccaagccggcgccggtaggtgacgtcatcgccgacgtcatcgggaccggtcgtcgtgagcccgtcgtggaccgatcgatctcagccgtccgttttggatagggttgatctcggccgttcatttccgtgaaccgctgccgtgcacccggtccaccgcaaaccatagcccgctgacgcaataatccttcttttccttttcaaaaataattcattattgcgtcataattcaattaaaatccatataaaggttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaaatatgatctacatgtttgtttactttttatgtactgtttatttggtttttattagtctttttcttcgttttacgtgttagcttgtcgtttccgtcgttgtgaaggttcgcgagtgcgccggaagtattcaagaagattaattgaagaccgattattgcaaggcaagtcacacagatcttaaacacaatcctttgagcatgttgatcctatatttaaattctctatttatttcaactgtgcatttattttcgaatgtcactgggtggtgttaacctattctttgttatggcccttttgatcttgattactttattccttgataccttgggagattataacttgactggttgagctttatatattggttcagctagatattagatatgattgcttagccatgcttagaaacattagcacactattgggataacttatgactcattattatttaatgatggtttaaagatagttcacgatggttaatcgtgattggttaattaattacttgtcaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcattgtagacatgatgttgaggctgtgtcttgtgggtacagtggtacacctctggccagagtaaaactattcgaatagccgtgcccgcggttatgggcgagttgaacaatgtttttcgtgattagtctcacacctctcacaatatttatagatgttataccgggtaataatttgcttagctcctggtttggagttagatctgttcagccgggtatggttgttcagaatggttgggcctatgcagcatgggtgtgctgttcagtgttgattaaaatttctgattaattactccactgttttatttctcttaaatgttttgctaaatgctgcttttgcaaatgagcctatattatgccatcctttggtatccttgtgcacttgcatatttgctgtgtggcttgctgagtatgtcatatgctcaccttgcaataataaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatatatcggtttagttattatgatggatttgtatattaaattgtcagtttgtgtacctcggttgattcctggacgaggattttatgcacaaataagttcggaaattactagtgaatttccgggcgtgacaagcagaccagccgaagcagcatttatgactgatgcctcggttatgtcttgaacttggcaccaggcttgcgagaagcgacgcatgtattctcttatcgactctcccggcctttggcgaatgccgagcagatgttgctgcgtcttcggctcctcgtaagtgcctcgaaagttaagaacaaaaacatcgcgcaattgctcccatgagtaaatgctattggctggcaaattgaaataccaagaacgggcaatgccgtcaagagcgagatgaattacctttgccttggtattttcgtcaccatgagccgcttcaatcgcggactcgtagatggataggaactccttcgggtcagtttcgcccgagtagcgtgggacgggagggaatttgaactggggcggaattgggcggttcttgattcccccactcagcggcagacccttttcgcctcccgctctgcctgcggtgccttgctgtgggtacggcgtggcgaaaggtgaaattacggcttgcgcatgattttgagccatggcgttcggctgcccggctccgactggtgatgcttgctgagccgccatggatggatcgaaaactggctgcgaccacgccatggcgacatgagttggtgcttggcttgttccgaagcctggtgttggtgcttgcggccgaacggtttgcgcctgagcggtattggtaaagtcgcactgaggtacctgattccatggcgaagtcctcagattcggctggttcggcggcaaccaactgagcgcaccttgacttgaattcccctctggacgagttgagggagttgtattcgaaatgttgtggggctgattgatttgctggaggaaagcttggaattgtgcctgcagagccaaagccccttctgctacggcttgcgacagctggccaagtggctgaggctatacttgggtcgcggcttggggcactgttgccactgtcggctgtccgacaaagtacattggtgcctgcaagacttgcggcggagcgggcttgggctgcacttgcggatagacttgaggtgggacaaaacctgccgaatactggaggatcggtgccgaagcaaccttggatcgccttgccgcttcgtacgtttgttgctgttcttgcatttggcgaagcatgtcttggagtcgtgccatgttttgccgcatgccctccatatcggcttcggcttgtgtttcagggtcggagttgacttggacttgtatggcagggagcgcagcttgggccgctgctggctgcgacggagcagcttgggggaccagcagctgacttgtcgaaaggatctccgccctggtctgaagtgccctcgccactgcggtcgccttcgccacgtcattcacactcggcgcctgctcagaggtggcaggggccgaaggcagcagtgatggtgtcggcgtcgaagcggacggtgccgtcgccgaagcagacggtgcccctccaacctcggcgaccgacgccgaaggctccgctccttcttcggcggccatgcccactccggtgtcgctttcctttcgccttgtaaccttctccttcgcgaccttcttcggtggcattcgctcttagtggtttcgctcggaggtccccacggtcggcgccagctgttgtcgaaacgacaaccgcatacgtcgaaagacgtggttactcaacagtggttgggaaagaaacgaagtgtattaaatttttaattttacttgggatccccccattacatggccctaggggactatttatagccccattacatgttcttactaatagggtttaggttatacgggggaatttacatggttgcccttatgaaagagacgtttacagggtt

SEQ ID NO: 12533 - DNA, 3712 bp, Oryza sativa
ggggaatttacatggttgcccttatgaaagagacgtttacagggttacataatgtcaaggggacttatgggtccttgatgggccgtcaggcgaccgccggccctatagccctaagcttgatgggccaaaaaggcttcttcggcccttgcgggggcgaactggacatggcgaagccgtccttcttcgctggatgccagggcgaactggctatggcgaagtcatccttcttcgtcaggtactcacgcgacccttcgcctcgcctcatccttggttcatagccttcgccacgggtttcggcaaatttggtcgaagggcctcatgccatccgccaacaagtatagttagcaactattgtatgaattggctattagattgtctataaatgaattggagccaatagtggggctatactattaaacctgctcttagattaaacaagaatctattggtgtcaggtgacaccacacctaacacagttgatccgcccctcaccacaagtttgctttgctcccgtcattaacgatggctcatcatcctcctctattctcatggcttcgacgtcgccatgagcgcctcaccgcctgctcatgtccacgacccaacaccgagccgccgcctcccatgaccatccttctaaatccagcgatcttccctctcttccccctcccccacccttacggccttacccctagccataatcgaggaccctaaacactagctccattactgtttgtagggggtcaccagaactaaaggagaaggggtcaactgtagaataagagcttgggtcatcagagcacggaactcaaagcaaatcattaggtaagaaaaatacaagattttaaacttaattttctatcgaatacattttagtttttttttacgcacggggaggacaatccacaaggttacgctttgcctcacgggagatgtgcatagcatattatctactaccacacggattaaggtcccggggttaaagtcagaggtaaaacagtaccgtgactttggggtattttcagttgtctggttcacacgaaatggacgagatcgatcactatagtaattgcgcacagtatttttcactgttttgtactgttgctacagtgaaaactgcaaatcactgttttctaccatagtagtagactcattttatcgtgcacctctgcttttttcctaaggcagaggatccagatctctaccacacatatgggtgtattcgctactggaggttcccagccgggaacagtgcgtgcgaaaaacggagcggtccattagcgtgtgattaataaagtgttagctaattttttttaaaaaaggatcaatatgattttttaagcaactttcatatagaaacttttttaaaaaaaacaccgtttattagtttgaaaagcgtgcgcgcggaaaacgagatggaaaagattaggaaccagcagtgccgaacacacccatactctactacttcgtccatcccataatatagcaacctagaaccggatgggtcactttatagtacaacgaatttagacatgacatgaagcatgtccagattcgctatactatgaagtatctcgtcttatactagattgctatattataggacggagggagcactacacatgctggagaagaaataaataaacataattcgaaattaatcagacgcatatacagtagtaagaccatattgaccgggaacctaaacaatagggcgctaatcgtgattcacctgatctgcaatggccgaaatgcgcatcatcgatcaacaacgccctctgcaaaggtcaccaaaatgataggaatctacactccacggacgacgatcgtcgcccgtgcattgcaacattgcgaactcagctggagtacgagggtccgttggcacggctctaactttcaactccaacttatctagagtcggagctgtaccaaacgatccatattttctgtttttggagtgaagttagtagagctactcctaaaaaataaactacaggtgtagagctgggttttttctgctccacagctccactccaacccaaaagatccactaccctttaatttttaacacattcacataaaaatgtcactgaattatcccaagctcaacctcctcccttccccccccccccccccaaaacttaactcccacatgtgggcaaaggcagcgggccgatggtgacgctcctgcggtgacggcgggcgatgcgagcagcgacggcgcacgggtggggtgcgcgggcagcggtgctccggcggggcggtcggcgcaagcgaggacgacgtgtgagcggcgcacagcctgtgacgggcggcacgctgacaagggcggatgggtggtgcaggggaagtagcgcgaggccggcgtgcgtggagacgatgcttgggcggcgcacggccggcagcagggattcctttttttcaatattttttagatcgggagctaaaagcttgtcaaacacttttggatgggtctccaactctaataggagctagctccaactgaaatagcaatttagagctaggagttgaagtttatagccctaccaaacacggcccaagacttcttgagagagagtcggcagtgaggacaccatcgatttgtcccggagcgctctcgcgcggatgacaaatcgacaaggcaacgaagggttgcagttgtagtagcagtaaacagcagcagccaccggccaccagtaatcgtcgtcccatacgccgagctgtaaatactttccccaagcccacctgccgctccccatgttaccctcctctccctcccgcagtcgcaggccagccaaaagcaaagccattgcctgccgaccaccgccgtctgggccccgaaacactgcatgttcgtggtcgtaccgtcgtacgcagccccccaccacgtggatgccggaaagccggtgacggcggcgtagcagcagcacacacaccgccggtcgcgccgcggatctaggctcgcgctcgcgtggcatgcattgcaaacggaaagatcgagagcagggtttcatttaccgccggggccgcggttaccgcgccccggcggtaagcacggttaccgcacggtaaccgcggtaaccgcgacaaaccgtacaaaatttatcaaaaattcaaattatttttcaaatttatttgaatttgacgcggttaccgcggtttaccccttaccgtacccccgcggtaagcgcggtaaccgcggtaaccgcgcggtttaccgcggtaaatgaaaccctgtcgagagagcgtttggacttttggcgtgcgaaaagcccccagcaaaacagggagattttgccggctgccctcgtgccccgtgcaaccgaaattttgaacagctctgcgacgacgagggacgcctttttactactatagtacaagtacctgagtatatatacaagtttttactttttactactactactacatggcgaattgaactgctgcacgagtgcacgacaatctgtagggtagagagatgggggagtccatgtgccgcaagagctgtggtgaatacaaacctggaacgatccatcatccatgtgcggtgcccgcaagctgtggatacgaaccgcgcatgtgcggtgccctctccaggagtagaatggagtaccagaactagtagctagtggaggtgcactggaaaaagggcatcagcatgtgccgccgatctagtggacgtaaactacggagtactattacttatagtatatga

SEQ ID NO: 12534 - DNA, 4583 bp, Oryza sativa
cgagggacgcctttttactactatagtacaagtacctgagtatatatacaagtttttactttttactactactactacatggcgaattgaactgctgcacgagtgcacgacaatctgtagggtagagagatgggggagtccatgtgccgcaagagctgtggtgaatacaaacctggaacgatccatcatccatgtgcggtgcccgcaagctgtggatacgaaccgcgcatgtgcggtgccctctccaggagtagaatggagtaccagaactagtagctagtggaggtgcactggaaaaagggcatcagcatgtgccgccgatctagtggacgtaaactacggagtactattacttatagtatatgacccactcaccgatttaatctagacttggagtagcatctcaccacctcgtcgtgttatttttttgttaagaacagttacaatagcagactattagccagctataaacatattttaatgagataaaatatgagagaagagtagtgggctacagacctgtaatcagctgtagcacggactctaaaacgcaatgtgtatatgacagatgggatcatatattaataaaataataaacaactattgtatgatttatctattaaattgactatagataaattgtagttagtagtaggctataatattaaacttgctcttacatctcctcgggttcgtttgattcccggtattagagcaggtacaatagcaggctataagccagctgtaaacatattttaaaaagataaaggaagagagagaagagcagcgggctacagatttgtagccagctgtagcacggactccaagactgtgttatggtaggtgggatcagatattaatagtatagtaaacaactattatatgaattgactataaatgaattggagctagcaatgggctatgctattaaactggctcttagagtaggtacaatagcaggctataagccagctgcaaacatattttaaggagataaatgaggagagagaaggacagcgagctacagatttatagctagctgtagcacggactccaagacacggtgtgtgtatgacaggtgggaccaggtattaatagtgtagtatgtaactattgtataaatgaactattagattagctatagatgaattggagctagcagttagctatactattgaacttgctcttagtcgttacctcgaaactcgaattgcccgcccaaagctacccaaaaggagtatcgtactggtccaccacggccggtgaaaacctctactactacctgtactggaactattaatgcagagtggttttttgatgtttttcatctgttcccgccaccaccaacaccagcacgacgcaataatggacagagcgagagcggtgcgtttccaatgcccactatgccagtgctacgggccagctgcgcgcctgcgcccatcgaccggttcacgcgtccactgtggcgcgtcacatgccccaaccccaaccccatcaccaaacaccgcacctgcacgcacaaatctttactcctccacggctccacaccaatctcgccgtcctcccctcctcctcctcctctatataaacaccaccctaagtccctaacccacccaaacaccaccgcacccaccaatggcgtcctccaccaagatccccttcctcctcctcgccgtcctcctcctcctttccatcgccttcccatcggtaacctcacaatctctctaacctctccttcaacctgattactatatatcttgaatcttgggttaatcttgacgttcttgttcgttcttgtttctcgcgtgcaggaggtgatggcaggagggcgcgggcgcggcggcggcggcggcggaggggtggccggcggcgggaacctgaggccgtgggagtgctcgcccaagtgcgcggggaggtgctccaacacgcagtacaagaaggcgtgcctgacgttctgcaacaagtgctgcgccaagtgcctgtgcgtgccgcccggcacctacggcaacaagggcgcctgcccctgctacaacaactggaagaccaaggaaggcggccccaagtgcccctaagatgcatgcctttttttctttcttcttttttttttgtttttttaccgtatgattaatacctcctactagttctactacattggtgtgtcactgcctcactgacactggtttagctcatggatccggttgattagttaattggtggtgggttttattgctagatctgggcttataagtattagtttatcctgttctagtaaggttgttggttgggggaatgtgtgcgagagaggagagtgaggattcgtcaaagctggtcaaaaacttggatcccctctccctgtagtgattgattgatttgctactactggagtgtgctttgccggaatcatttggtgctctgctcacccagcattgaaatttgagacaatgcttagtatacttaagtactggagtagtataatttcattcgcaagctttgttgtgatcttgttgcgtgcaccccccgcgtgttgagctcatctcaagagatcgaatggctgtctgcttaccgatcagtatcttttctgtgctgtgtacatcgatgtagccggattttaattcattttctaaaaagaaaatcagtatcttttctttcttctttttctttccttcaattaaggtacggctgattccatgagttttgtgcatatgggctgaccgaaactaagttggaataagttcatttgatatctcttaacttgataccaaatccgatttacgccctaaaccgaaaaccagatacaaccacccccttaacttataaaaccagtgcaaacgaagttcttcggtactattatctctagttttggcttacgcggtacatacgtgactaatttaacttgatctttgttacacgtggctttttcgtgacagttttatttggaaaaaaacaaaattgaaaactaaataattgacacaaaatatggtcagtcaaactaagataaagaaaaataatggtacccacatgttggtggtcctattttctccacccatggcgaggggacagcgcggcgagccgctgcccatggcgaggatgccgtcgaggtcggggggtggcgcgtaggacggcggagacggggctcgaggacgacgagcaagttggagagtgctgagaaggatggggacagagtggagagcattgtcctcgagggagtcgaaatagatgaaggggaggaaggaggtggagtggacgaagtggcagaggctgcgctgagaggggtccggcggctagaagggggagtgtggcatgctgtgggagcagggaaagaggggcctgtatgatgcggcggcagctgacatggcgagggacggtggtgcgaagacagaggagactgggaagaagaagatgaggtgtgcatcctcgaacatgttgccatcgtcatcgtcaaagcagggggggaagtaggagtggcgcccaagacagtagtggagctcggtggagaaggcgtgatgatgacggcggaaggagttgggagcgccgaagctgtggagatcggcgtcggcagcggatttccgccaccgcgccgcgccgctctgctcaccctactcccttgggagaggataagatacatagaagtggggatgaggtggaggaagtaggtccactgatacgtgggttctactatttttcaatcttattatttgactgacatgcgtgctcacatattttgtttatttgttaaattgttagattttgcttcatgtgccacgtcagataaagatagagtcaaagcgccacctcagctgaaaccaccgtccaccgtccaaaccgccttcggagttagtttacaccggttttgaccgctgtatttggttttttggttgaaggataaaaattggattcgtcaaaaagtaagggacctcatatctatcctacatgggccgacaaaaactacgaccaatcttagcaacttttgggcctctcggcagtaggccattggctgtctctgttcacgtctttctagccttctggccgaacgcttggaaaccaactctttgatggtccatcatatggagacacaggccgcggcccacggctcatcccagcttgcaggaataagttcacttggtgcccctcaaaagtgattgaaatctaatctgtgaccctaaaccacaaaaccggatatcttgaccccccaaactatggaaaccggtgcaatttgactccctcagcggttttggagggcggtttcgctaacgtggcggtattgaccgggtctcctttacacgtggcgttgacgtggcgttaaggtggcatttagattaaaaaatatatgtgggacccatttgtcaatgacacagaaaatagattgtgggacccacgtgtcccttctctctcccctccctcagttccctctctctcctcgccgttccctctctctctcccgcggcaggcggagatggtggcgaggggcggaggcgcggcggcacctgggctgagctccactgcgacgaagacggaggagaccacagcggcggtggcgggaggcacacgtggcggggtacggcgagctcggcccggcagtgaga

SEQ ID NO: 12535 - DNA, 1165 bp, Oryza sativa
agtcaaatggcaccggttttcatagtttgggggtcaagatatccggttttgtggtttagggtcacggattagattccaatcacttttgagggtcacaaagtgaacttattcccagcttgcacgattcctacgaggaataagttcacctaccgtccctcaactttatgtcgagtctgtaaaacatcccttatgtccaataccagaaatctccccccctaaactatacgaaatcatgtagaataggtcctatggcagtataatagatggttttactaacgtggcatcctaatccgcaaagagggaataaaaaaattgtgggggtccatatgtaagtgatagaagaaaaatgtggggtccgcatgtcagccaatcgtctttcttttcttccagcccgggacagctggcaggagaggggggcgtcggcgggagaggcagccggccgcatcagcgggagaaaggggagaggtcgccggccgtgccggcgggagaagggagagaggaggccggccgcgctggccgcgcctgtgagaataggaggagaggcggccggccgcatcgactggagaaatgggagaggccgccggccgcgccggcaggagaagggggataggaggccgactgtaacgccccgattttcgttcgggattaaaaatcatttgataatgcatttcctagaaattaaataaaaagttaagcaatttattcaagtgaattaatagaggaaattaaaatttcctttaaaaattattggccgggaatattttgtaatattctttgtgccctaatgtactctccataattttccgtgaattttcggagctcgagaaatagtttaaagtcacgaagatcatttaatcaattaaataaaaagaaaaccaaataatttccctctcctcccttcgggcttggcccaaaatcccctcccccttcccgggccgcgcgcctcctccatctgtaggccggctcaggccttgagggaagtctgctttgcctccccagtttccctcctctctctccagccgacgtgtgggacccatgggccccgcctgtcatccccaacctccctccatcccagccagcagccgctcgtggccgccattgccgcccacgatgccgccgttttcgcgtcctcccgttcacgcgctcgcatccgaactgagagcaa

SEQ ID NO: 12536 - DNA, 470 bp, Oryza sativa
agttgtgttatgcagagggtattgtcacagcctctattcgggtactttccagtatcgcgacgcattgtagacatgatgttgaggctgtgtcttgtgggtacagtggtacacctctggccagagtaaaactattcgaatagccgtgcccgcggttatgggcgagttgaacaatgtttttcgtgattagtctcacacctctcacaatatttatagatgttataccgggtaataatttgcttagctcctggtttggagttagatctgttcagccgggtatggttgttcagaatggttgggcctatgcagcatgggtgtgctgttcagtgttgattaaaatttctgattaattactccactgttttatttctcttaaatgttttgctaaatgctgcttttgcaaatgagcctatattatgccatcctttggtatccttgtgcacttgcatatttgctgtgtggcttgctgagta

SEQ ID NO: 12537 - DNA, 2819 bp, Oryza sativa
tcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaaaggggttggttgattcttcccaaattcagagccttgaacgagggagaggtcggctcacactttgtagctccttcatacacagatccaccaaaacacaggagtagggtattacgcttctcagcggcccgaacctgtatacatcgcccgtgtctcgcgtttcttcctggcggacgatctttccacataccgagagagcttgagatttcaccctgagcccccggccgaaccggcaaaggggggcctgtgcggtctcccggtgaggagcgaggacttctgcttaggctgtttcctaagcagaaggtcgtaggtttcacgttgcaaacggtgggagaaaccaccatcgcaatttgccctccccgggcaacgcacggcgggcggtcggactggtcaaaagtgagggcaacttccgaccaccgcgcccggcgcgtcgcctcatgagtaggggcagcggccagaagctctcgcttcatggccttgaggctccgggcgaaaaacgtgcgcacacgctcctccatcgacagtggctatggtagccccaggctcttggaaacctaggtcattatcgccatcatcgatgtcctcggcgggggccttctgcttggcctcacttcgccgacggccggaaggaaccgccggggacttgccttcccggcgctcctgcctcctctcctcctcccacttccttgtccgctcagccaagcttttgactgcgcgacagtccgcaaggtcatggagggaggtgttgtggacggtcaccacttgccggtagggcgctccctgctgggaacgctggcctccttctttttgtcgctcgcaggcctcccctttcgggtggcccgtgaagcgccctcgacggcgaggacatgaccctcgtagtcggaacggactgacctcttcttcctcctcctgtcacgccgccctgactgagcggcggatccgggggcggccgaagctgccactccggaaccggaggggttccaagtccaggcctcctccttgcgagccactcggtccgcgagctgaaaaagctctgcggtagtctggggctctttggaggcgatcttttcgagcatgcggttgtgccgcacaccccccctgaacgcgtagattactgcgtgtgcagggatgcatggtatggtattgcggacttgacaaaaccgctgaatgtacgattgaagcgactcatcgtcccttcgctgtacagcgtgcaagtccgcttcctcaccggggcgcggatacgtgccttggaagttcatggtgaactgctggcacaaatcctcccaggagtggacagacgcgggtggcaagttcattagccaaccccgtgcttgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcaccacgaaggctctacagccaacaccaccaaccgggggcacggagggctgattcccacgtccgtgtcgaggtgacactctagacgaggaagcgccttccattgcgtgggcagcacttcggtcattacgccggcgctcgaggctggcgcgggcgccctgctccctacgcagatcttctcgggtcgaaggagtcgatgagggagtggctactgaacggcgaacagcggctgctgctcgtcgtgcccttcgtcttgacgacgcggagccagtggtagcagcaccagaggtcttggtggcggaggaccgcccaccagcatctaggcgctgccgcgccgtcatgaccaatttggccacgtcgtccagccatcgttgggctggagattccgggtcagggacgacaggcgggtggcgtaagagcgcgcccgcagcttggagcgcgccctggggcgtgctgccgtcgccgtagacgaggaggcgacgctccccatctcgccgttctcctccatcgcccgcgatcggtgaagccgcggatctttcgaccctttcgagcgcctccccctgcttaggactttggcgaggagggggcggtggagtacgagctcgacggcgtggattcggctccccgtcgtcgccactcacactgggagagaggtcgggtgcctttgcttgctcagccatgaggctgatcaagaaaaacttgacgcacccggaaaagtgcgagagctcagaaaacactcgctgagccccctacctggcgcgccagatgacggagctcgtggcccctcaccgggagaccgcacaggcccccctttgccggttcggccgggggctcagggtgagatctcaagctctcgctgtagatgacggaaagatcgccacctctcaagagaacatgaaacacaagcgatgtatacaggttcgggccgctgagaagcgtaataccctactcctgtgttttggtggatctgtgtatggaggagctacaaagtgtgagccgacctctccctcgttctaggctctgaatctggaaagaatcaaccaacccctttctctatgggcaaggtcctccttttatactcaaggggataccacatgcacccctccctttccaaactggactttttttcttttcataaatggacggagatttgc

SEQ ID NO: 12538 - DNA, 2221 bp, Oryza sativa
ggagaccaagaggtgggcgcacacatcaccctcgggcccgacgtcccccgagggtgccaggccacgtgggcgattgtgtctgcctcaagcctcgagtcatgatactcccggtcccatgtcaccgacacccgtccattgtcttttctctttattgtcattgggattttgaaaatcgaacataattatcgttcgggttcatttttttactttctagaagtcctaccaaaccgtcgacagctttgccattgtactcctctatgactcgctcgctgcctcccttcttattatcattgagattttaaaatcgaacatgattatcatcgtttttttcactttgtagaagttttgaacctttaaaaattggtttattgtcttgttgggtttcatttttttataacttttgaagtatcgtcacacgatgccactatactcctatacgacccattcgcctcttagtctttattatcattgggattctaaaaatcaaacataactattgttggaattcattttttattttctagaagtcccgccaactgtacggctatgtaactatactcctatacaccccgcccgctgcttctcctttttattgtcattgagatttttaaaattgaatatgattatcaatggggtttattttttctactttcaagaagtcccggcaaccgcattgcccgtttgcttcacggccttcctgtcgtccctccttttaatcgtcatttggattctatttggtgttttatgaacagcttttatatgttttctcaaccgccaccactctacatttttataggccaattacttataattctatttggtgtattattaacaatttttatatgtcgtatcaaccaccacctctctattcttttataggactgttacttaatttatgtcgtcatgtgttttacatggtcttttctttcaatagtatttattttttatcaccaattttagttatttataaattatatttctaattaaatcttttttctttttctaatttcagaatttattttttttccaaattttaattaataccgtatagtgttcttttaatatttttatagcaaaatttgctacaggacactcaaaaaacgcgtaattagctgagggacaccgagaaaatgtttaactgctccaggacactacaaattttgtgaaatttgccgtaggacaccgagcttattattttatcatttcccggctgaaagtggcgagtattttttcaaaatgcctaaattgccccgcgtcccaatctatactctggagctttggagctgatgatggcatcaacctgctctttcggggagatgaagttgtgcgcagggttggtgagatccggcacgaggaggttgtgggcacacaccatgtctgcctcatcgaaggagcccatctcgatgagcacaaaggcgagcgcaaaggcgatgtgcaggcagcacggggccatccatgctgctctcctgaggtgattcgtcgccttttgctgatccgcgcgcgcgaagtaccattgcgcaaggatggtgtggtacctcccgaggagctgcttggtggcgagcccgtctccgcctgtgtcctgcagcgcggcgatcgccccgtcggcctcctcggtgaatgcggcgtcacagtccgaccagtcccagttgctcgccggccgctcgccgctggcaccggccatgggaggaggaggaggaggaggaggagcgcgtcacgacgttgcagcccgccgcgaggcagacgaccgacaccaaagaagcgcgcgcgtgaggtgtttgtcgaaatgccgatgtggcgggacgcgacgacttaggatatacgcgagacttaggatataccgacaccaaaggagcgcgcgcgtgaggtatttgtatggtatggggatcgttggaactaggatatacgcgagacttaggtaaaagagacagacgagaatttttatacaggtttgggcccctgaattatcaggtaataaccctacatccttgtcagggttatggaaaccacataccatgtcggtagggcccaccacatactatgtcttatacggaaactgacctcgagggagttccggataaggaaagacaaccaaagttctacatggaaacgacaaagactgctcgaattgtatccatattggtttccctagttctacttggacaaggggacacatatgggtataaataaaaggcatgcaagcttgagtggggacacaatcaac

SEQ ID NO: 12539 - DNA, 1286 bp, Oryza sativa
gaatccgcatccggcgagatcagagacaacactatatctctcctgacagtagccataggcaccgtaggggagtagccatgcctatctctaaagtcgatatccggcgtcttgtcttggcgtatgttcgcttgtatgttgtggcttctgttgttccgtgtcccttctcctcctagggggccttgtatttatacccataggtatccccttgtccaagtagaattagagaaaccaatatggatacaatccgagtagtccttttcgtttctacgtagaactctattcatccttccttatgcggaactcctcctatatccgaaggttgttttcgtataagacatggtatgtggtgggtcctaccgagatttagtcaactactattaggtatgtggtatccataaccctgacaaataggacaataggttttcatcaaagtctcgcttgggaaacatattagttttttttattgattttagacaattatattaagtgatactctttctgtctcaaaataagtacaattttgtactattcatattcaacgtttgaccgttcatcttatttgatttttttataattagtatttttttgttattagatgttaaaatatgaatagtactttattgctattagatgataaaatgtaagattttaataagaatataagtgcaacgtaagtactccatccgtcctaaaatataaaaactttttaccttctagaatttgactcaaaatataacttctcttcccaaagaatcataaccttccatcattcaatttttccacctatcttcaatttcaaactatataattataactttttcttatttaattctacctattttcttaatacccgtgtctacattcttgtatttagagatggaggtagtagaagattataaatataagaaaacgtaagaatgattgtttgaatataccacgggagaaaaatgttgaaatcggttgagcgagatagactcaataaaattttgcaagaggttgaatctcgtactaacttttctctaaaatatctatattgtccattcaataagaattacaaaataaaaagatataattcaatcatttatttcaaaagccatcctagtatttttcttcttatagaattgaaatgccccaagttttctatatgtttcttacaaattgtgtgtgtgtggggggggggggggcattatttcctactccagatcgtactatatccatacctaagctgtcggcaacgatggttgctaatgccggctgtcggaggattttaattgtctagaaaaggg

SEQ ID NO: 12540 - DNA, 7712 bp, Oryza sativa
ttcctaaaagaatatttcaactataggattaaatcatatttttttctataaaatccctataaaataggcaataatatagagattttaaagaaaagttagctataattatctttaagtttatttcccacatttaatttctactgactaattaaatgaccatttacatatttttcctgtgatttacaactgttggttttacgctcactattatgccaaaatcttactacttcatgtgtttctatttctcaagtattttttttcatcgcgttttaaacgagcctttcactgctctccatacacagcacccgtgagcaaccggctactcctactctataattaatgagggtagagtatctgaagtgtccccccccccccgcacttttgtcctgttcgcggtcacgcctctacgtagtactacctaggtgtaggtatgtttgaggaggagtggattggggagattgggaatatacgtaaaacgaggtgagtcattagcgtatgattaattgagtattaaatattttaaattttaaaaatagattaatatgactttttaaagtaactttactatagaaaatttttataaaaaacgtttagtagtttggaaagcgtgcgcacggaaaacgaggtgctttctcaccctatatcacacacacgaacgcagctttactgtatagaccctctagtcaaagagcaactgaagttgcaacaccaacctccgaccctggaccaaacaacaatatggctaccacatcactagagggatgatgaagatgaaccatcaaaaaacctgcacaggctgcagggtcccctactccacaatccacaacgctcagttcaaggttcctccaggctttttcccctgtcacggcctctctcgtcgtcgtcgcttgcgtagctctgtaggagtacgcaagcacactcgaatactacaccaccaccatcggttgattgacatttgaccctgattgacgcctctgcgactgcactgatcgatcgatctctgacatgcaccgatcgacacgtccggatcatgatatcttttccctctcttcttgcatcgtctgatgaatccacaatattcatatccttgctataaagcgcggttgcaagcgtacgctgctgtcgctgtcgccattgttcttcatcttcgtcgtcgtcgtcgtcgtcgtcgtcctcgccgcttgcagtcgctgctgccgccgccgtcgccgccgatgcaccaccatccgtcacacgtctttactactaggtactgtagtgttgtagcagtgcgtgtcgtcttgcgacgagctttgtgttggaccacgacgccatgcttggctgtaagctctagcttggcatcgcgctaaccccttttttgttggcttgcgcggcggcgtcacgcccgtggcggtgctactgttcagctgcagggcggaggagcagcagctgggtggcatcggcacagctggataccacatcggagatggcgccatcttccctcctcatcatcttcttcctcctcccgacctcccgctcctccgcactagtaactcacgccactgtctcttccactgttgcattccaagaactgctcctttgtttgattcttgctgcattttgttttttgttttttttttgaaaaggtccgaatccgagctccaagtcgtcgagcaacctcaccgccggaggacaccttccgccgttcgccgtcgccgccgccgccgccgccggggtgagtttggttctttcttcttgctgattgattgattcttcggctgatgcaatgcgaccagcagcagcatggcgtaccggtggtgggcatggcggcgcaccaggggatggcggcggcaacggcggcggaccggttctgcctgccaaggatggcggcggcggcggcggccgcctcgcaggtggagaactggggcgactccggcgtcatcgtcagcagcccgttcaccgacgacacctccaccgacctcgacgacagcgccgacaagcaccacctccacgctctagtggtgccactgccaccagctacctcctctcgccgccgtctttcttggctggctccactcgtgtaatgcggtttctcgtgctactcccagggcggcggcgatggcggcgacgacgccggcgagcagcgaggcgcggattcctccgccgtgtccaaggaaagaagaggggatcagaaggtgcagtcattttgtgtcagaggggaaacggaatctgatctcatgagtgatcaatttggttgtgttcattctgaatatgatttgtccccgaatttgtgtgcagatgcagcggaggcttgcgcagaatcgcgaggcggcgcggaagagccggatgaggaagaaggtgatcgtctgaacctatacattatcgatcattcattcgattaatgggacaattacaatatctgttaaatatactagagcattaattgcttcggaatcaatgttgactgctgctgccgttgctgcaatgttctggaagtagatgctctgctgttacttgcatctttgttttgtggttattgatgatgactaaagacattgcgaattgctgtttgtcgtaggcatacattcaccagttggagagcagcaggtccaagctgatgcaccttgagcaggagctccaaagggcaagacagcaggtgagccctgcattgttcagcatacttatcaaatcgccttgcagaatctaatgtttgaagtctgaacagctcagtaacaaatacgcaaatgcaattgacgactatcctttacagggaatcttcattgcaactggaggctccggcgatcacgggcactcgatcggaggaaatggtggtgttttccacttgcttgatttctctgatctgtcatggcatctgcgcaaacatcgcaattctgattctgtgttgtgttgtgtttgcttctgcaggtacgttggcgttcgaccttgagtacgcgcggtggctggacgagcaccagcggcacatcaacgacctgcgggtggcgctgaacgcgcagatgagcgacgacgagctgtgcgagctcgtcgacgccgtgatgatgcactacgaccaggtgttccgcctcaagagcttcgccaccaagtccgacgtgttccacgtcctctccggcatgtggatgagccccgccgagcgcttcttcatgtggctcggcggcttccgctcgtcggagctcctcaaggttttgacacgatcgagtgatcacccacccaattcagcaacaagcaaagaatctgaagctaccattgaccgccattgttgatgatgttgtttgtgcaggttcttgccagccatcttgagccgctgacggatcagcagctgatgggcatctgcaacctgcagcagtcgtcgcagcaggccgaggacgcgctgtcgcaggggatggaggcgctgcagcagacgctgggggacacgttggtgtcggcggccgccaccgtggtcagcggcggcggcggcgccgacaacgtcaccaactacatgggacagatggccatcgccatggccaagctcaccacgctggagaacttcctccgtcaggtaattgaagcttcggaaaaacatcgacggcgaggcgaactgaattgctcattaccacagcgtgatgcgatgattgattgtgtgtaggctgatctgctgaggcatcagacgctgcagcagatgcaccggatcctgaccacgaggcaagcggcgcgggcgctgctcgtcatcagcgactacttctcgcggctccgggcgctgagctcgctgtggctggcgcggccgagggactagactgactaaagaggatcaatatcatttgcctgagttctgagttctgacgatggatggaggtgaacctgttttttgattgctgaatcctgagagagcgttaactgcgatcggcattgtaaaatcagttgctttggtgatgaagcagtagtagtaggagaatattttagattgggctcttgggcctgtaacgtgttgtagtgttagcgtagtaagaactaatccgcgtacaatgtcaaaaggagaagttttattacaggcctatttccaatctcggatgccgtcaaggaccaggtcattgcatctgatcggtgctacctgcgactttagcaggtttgtgcataagcccgttacttgaccgaaacagcggagtagctcagagaagacccttacgtcctctttgtctggatttatgaagacgaccgtctcgtcggtgtacatggatgtgcagaagcggacggctctacctcgcatcttgctaatcaccagtggatagtgggtcgccctaacgtagcctcttgccatggctgatcgcttctcccgggatcccatttgggatgatctttgaggtggaggtggataggaggcccgttatctagttctgcctcttatttttttggaaccctctattttgaaggtgaggaggtatatagccccatctcatcaagtcgaaagctttggagatgtctagtttaaagagcaggattggtcttctactcatgtggtgtttcctcaccatattcctgacgtacattaagttgtcgtaaatgcttcgatcggggatgtaagagctttggtttgttgagatcagctagtgcatgagcggccgtagcctgatggccagaactctggagaagattttggcaaagccatgaaccaggcttattggtttatagtcctagattccctcagccccatccttttttagaatgaggatcacgtttgctgagtttagcaggtttacgtgcgtgctcctagcgtcatgcaaggcgttgaaggccgccacgatgttgtccttgatgatgtcccaacatgacttgaagtatttcccagtgaagccatctgggcctggtgccttgtcaaccaacatttcatttatcgccttgcgaatccctgattatgtgaatggggtcattaaaactagacatttctatcagggcggtcctcatggaagaccagttgagatcttgcgttcttggctccaattggcccattacttgctagaggtgcttggcaacggaaagttccttttatgtgtgttgtattgcccatctgttgtgcttacgcaatcgatagatgtggttttttttttccttttgtgtgcattcattttggggtgaaagaattacatgtttacgtctccttctttgatgttggttacatgcgcggcatgtttcttcctttctcattctatgaccgtgaggccgagtagccttcactttaaggccgtgcgaaacctatactttgatgggcaaatcgtacatataattaaaaaaaaggaatttaaaaagtagcagaaaataacatcttcacaaagtgtgtttagattatttaacatcttggcacacttctattgacttagatgatcccatatgtaatcctcacaaatatcaattaaattaaactaaggtagcccacatacatgcgtgggtatatttaatattgcttaaattttctattacaaatgtttataagttggtgatatttttctaaatattttttacttcattttaaacatgtttcgttagtaatttgtttgggcattggttatgatctttttgctaactacccttggaacatataaattttaaactaaaaatgtttgaaaccgtgtagtgttgaatttatgagaaaatagtgtagtaataatagagttggttcctatctctagataccatatgttatttttttggaatatttagcatatcttatttgtgagttttaaaactttaaataacaaattgtcttgtatactatagatgtcttcacataatttaggatatattaatgaatttttaggattgtttcatccacttaaaggtagcaatgtatttatttctaattagagtgagatgattagttatgtatagagatatatgatgggttagatagtgagtggatgccagtcgctctcgattggacaaggagtagtataaacttgcaccaacataaggagaagtatcatgacttaatttcgttaacaatagaagcaatatcattctgttgccagctatgttctagatatcacatataggaagtaaaaacagtaacaagcaatttctatgtgatttgtatgaaatttctagttccaaagggttctagggtcagatttgcaccaacatttaaattcagccaggtcacacctcaaaacccagtacacgaaacatatacaagcaagtaacactttaagtacatgcttaccaaggcatcaatatgcttccatttgccgtatgttcttactctgcttccatttgccgtatgttcttactcttcacttcgtctgattcttctaatttccttttccttttcattttggaacctttgattctcctaatttcatccccccagttaagcttcgctgccaaagcagtcttgttaaaagcatggataatcttagagtccctagcaggatcaaaaatatatgtagtcctctccaaatgtaccccgtcgacaagctattagcttcccatgactgatgattcgctcattgtcaatagtacgtctccccaaagccatcttctcgaaatccatggcatctccacagtaactttcaaatggatgcagaatcctggtcccttcaaagtcacaataacagcaacaagcttttttttaacagatcaattatattgaaccggctttgaaagaaagcccaacaaacaaacagagtcttataaaaaaagaacaaaaatagaaaaacacagctcaaacacaggctgtttttcccttgaagcacaggtacatgcaaacatccacacacactactccagacctagatgcaaaagagcaccaactgaactacatagctacaaatcttcaggcaatcgatctgccttcagttgtcccattttctccagcagacgatcacgccattcttccaagataccatgctcctcccattttagcatgatacatcatttctgaacaaaagacagagttttgtaaacaatatgcaaagggtatttaatcaacacattttcaaaaacccaatcgttcctaaccaaccgcaatgcccaacacacagtagccagaagcaccacccaaaccctatttattttcttccccttaaccaaatccaaaccctcactgatattacttggtcttttatccaagccaagagcatccctaatgacacaacacgcaaaactagctaaagggcacataaaaaggatatagttcgaggtttctttttttaccacacagcttacacaactcatctccccctctccacttccttttaaccaattgagtagcataaggtagtcttcctattcctgccatatacaagaaatgcttgatcttttgaggaattttactcttccaaatactcatcatttcagaatctttcacacctccaaaagttatcaatctatacatcgatctcacattaaagatcttgttgctggtataaggccaaaccactctatttgctcccccatccaaattatattcatttaaaaggcctctcaacctaattaaatcttgacctctgttatcatccaaattccttctaaactccaaattccaagtctcattctcccataaatcactcacagtcgcttcttgatgataatttatgtcaaacaactcagaaaaaacaactttcaaaggtacctaacccagccaaacatccctccagaatttcacacaccctccctggtgaacttctttaaccactaacctttctagccaacccttacagtcatgcaaacccttccaaacttggaccccc

SEQ ID NO: 12541 - DNA, 673 bp, Oryza sativa
  unsure (1)..(673): unsure at all n locations
gnnnnnnnnnnnnnnnnnnnnnnnnnnnnnnnnnnnnnnnnnnnnnnnnnnnnnnnnnnnnnctgcacgccgaagcaaccacttcatgttgtgagccgattgatgagtaccatagatcccttcgggaactccgccgattgcaaccttatcctgatcggcactcaagcacttaagtaataccccatcaatcgcccgataataaagctcatcattcaataacggatactgtaatgccttatatgttaatttcctagaagccgatcgagataggattacttaaatactgatgcacatcatacctgctatcatcggctgacactgatgcaatttgaactttaacatctatgatcatcggcttataccccgatgccccttgagccaaatcattaccttcaaaatattgatctcgagatacatgcttcaaagctaccagtcgaaaccctttcattagttccaggcacttctcattataaaccatcaatgtatcgtacttgcattcatatgaccctgccaattggctgattactagcaaggaatcccccatgatttcaatggtatcggctacaacttccttgagtaattgcaaccccttgagcactgcttcatactcagcctgattattgggcgcatatggtttaatagtataagcaaactcgaaacatgcccccctagg

SEQ ID NO: 12542 - DNA, 452 bp, Oryza sativa
  unsure (1)..(452): unsure at all n locations
actaatgggggggtggatacaggggccaatgtacatgtttgtgctgacatctcattatggtcttcttatcaggtcgcacggggttctaccgtcctaatggggaatgggtcacatgcttctgttcatgatgttggcacggtagatctgaagtttacttcgggaaagatcgtgcagctgaagaacatgcagcatgtcccttctatcgacaagaatcttgttagtggctcccgtctgactagagacggatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12543 - DNA, 546 bp, Oryza sativa
ccccgtccaacccgtccaagccgccgccggtaggggacgtattcgccgacgtcttcggaaccgttcgtcgtgagccggtcgtggaccgatcgatctcagccgtccgttttggatagggttgatctcggccgttcatttccgtgaaccgctgccgtgcacccggtccaccgcaaaccctagcccgctgacgcaataatccttcttttccttttcaaaaataattcattattgcgtcataattcaattaaaatccatataaaggttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaaatatgatctacatgtttgtttactttttatgtactgtttatttgg

SEQ ID NO: 12544 - DNA, 663 bp, Oryza sativa
  unsure (1)..(663): unsure at all n locations
nnnnnnnnnnnnnnnnnnnnnnnnnnnnnnnnnnnnnntttagtcaatgtccaatcggatgcttgatactaattagaagtattaaacgtactaatgataaaacccattccataaccctggactaattcgtgagacgaatctattgagcctaattaatctctaattagcctatgtgatgctacagtaaatatgtgctaattatagattaattaggcttaaaaaatttgtctcacgaattagctatcatttatacaattagttctattattagtctatatttaatactttaaattagtgtccaaacatccgatgtgataaagactaaaaattaatctctggatcaagcatttcaaacaactccgttgatgctctattatcggaaaaggatcgtctgacgtgactattcaccgtgaaatatgtactgtaagcctcaccactatcgggccgatatgtcggccaccaaggcaagggaaagttacgttatccgatcatccatagtttgtgtcacgagaaaccgagagagtgcgtggagtttgaaagaggaaagtgggcattgttttcttttcgctatcaagccgtgaacccctccacccccacctcttcttctgcactctgctgcccgcgcgggccagctagttgctctgcgactgcgaccagcgtacc

SEQ ID NO: 12545 - DNA, 696 bp, Oryza sativa
ggagggaatgatacgcagctggagggacactatgattacggtagctagcatgcctgcaaggcggatactacatgatgccctatgaacaaatggtttcgcgaaaaatcaattattttgacaacaggatgtgcgaactcgaagtttgacacgactctctttaccaattctgccccgaattacacttaaaacgactcagcagcttaacgttggctagccacgcattacttgactgtaaaactctcacttttaccgaacttggccgtaacctgcctaccagagcgagaacaaaacataacatcagacgaatcgaccgattggtgaggaatcgtaacctccacagagagcgactcgctgtataccgttggcatgctagctatatctgtgcgggcaatacgatgcccattgtacttgttgactggtctgatattcgcgagcaaaaacgacttatggtattgtgagctacagtcgcactacacggtcgttctgttactctttatgagaaagcgtgcccgcttacagagcaatgttcatagaaagctcatgacctatttctagccgaccttgcgagcattctaccgagtaacaccacaccgctcattgtcagtgatgctggctttaaagtgccatggtataaatccgctgagaagctgggttggtactggttaaggcgagtaacaggaaaagtgcaatatgcag

SEQ ID NO: 12546 - DNA, 631 bp, Oryza sativa
caagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatcttttgcagttttgtttagttgcaagaaaatttggatttggtttgttttgaaaacatttccaaaaatccggtgcctgaaaaccgcgtggagttccgataagttacccccgaattatcccggtcggttacgcggagtggagatcgtgccggcaccctgatcaagcgacctatctttatataaaccgagccaccgccttcacgcaaaacacatgaaatcaatctagggtttgcctcctcctctgtgttgcgtcgtcgctcgtggactactccatcccgctcgtcagtgtgcaccggcgatcggagagcaggtctccggaacctctgcctttcgacgtcctgcacctggagaaggcggcgataaggtttttgggaagcgctt

SEQ ID NO: 12547 - DNA, 3227 bp, Oryza sativa
aaaatttggatttgttttgttttgaaaacattccgaaaaatccggtgcctgaaaacggcgtggagtccggataagttacgcgcgacttatccggttcggttacgcggagtggagatcgtgcgggcaccctgatcaagcgacctatctctatataaaccgagccaccgccttcacgcaaaacacatgaaatcaatctagggtttgcctcctcctctgtgttgcgtcgtcgctcgtggactactccatcccgctcgtcagtgtgcaccggcgatcgggagagcaggtctccggaacctctgcctttcgacgtcctgcacctggagaaggcggcgataaggtttttgggaagcgcttcacgcgactgctccctgttcgtccgcgatggctcgccttcctctccgctcgcgtgctgcacgccttcatcgacgctcgcaaccgcgagtagttcctgccgagcaatcagtctttccgccacctcggtacgtgttcgacatgttgcgcatatttgatctgttcatgttttactgcttagtttacatgtatagatctaatgatgcgttaatgctagtatacatctgtaatgtcatgatttatttatggaatatattaaatcattatatgactatattctcaacaatccaaaaatcttaatataggcgctatgattttactatggctgtttttgccgatgcactgaggccggataaatttaatggtgtgcactttaagagatggcagatcagggtcactctgtggctgacagctatgaaatgcttctgggtgagtactggcaagcctatgggcgttcttaatgctgactagcagaaagaattcgatgaggccactactctctttgtgggatgcattcttagcgtgcttggcgatcatctggtcgaggtgtatatgcatatgaccgacgctaaggagttgtgggatgcattgaatactaaattcggtgctactaatgctagcaatgatctgtatatcatggagcagtttcatgactacaagatggctgacaaccgttctgtagtcgaacaagctcatgagatacaaaccatggctaaggaactcgaactccttaagtgtgtcttacccgacaaatttgtggtcgggtgcattattgcgaaactacctccatcttggagaggtttcggttctgcactcaaacacaagagacaggaatactccgttgaggggttgatagcgtctcttgatgttgaggagaaagctcgggaaaaagatgcggcgtctaagggcgatggtgggcagtccattgccaatgttgtgcaccaggcccagaacaagagcaaggggaaatacaaagctcagcagaccaccaacttcaagaagaagaagaacaacagcaatcctaatcaggatgagaggacttgctttgtgtgtggtcaacctggccatctggccaggaagtgtccacaacgcaaggggatgaaggcacctggagggcagacctctaagtttgctaatgtgaccattggcaacactggagatggaagcgggtatggtaatttacctactgttttttcagttaaccagtctactaattggtgggttgatacaggggccaatgtacatgtttgtgctgacatctcattattgtcttcttatcaggtcgcacggggttctaccgtcctaatggggaatgggtcacatgcttctgttcatgatgttggcacggtagatctgaagtttacttcgggaaagatcgtgcagctgaagaacatgcagcatgtcccttctatcgacaagaatcttgttagtggctcccgtctgactagagacggatttaagttggtttttgagtctaataaagtagtcgtgtctaaacatggatattttattggtaaaggttatgagtgcggaggcctgttccgcttttccctttctgctttctgcaataagtctgtgaaccatatttgtggcagtgtggatgatgaggctaatgtatggcactcacgtttatgtcatattaattttggattgatgtctcggttttccagcatgtgtttaattcctaagttttccattgtcaaaggttctaagtgccatagttgtgtgcaatcaaagcaacctcgcaagcctcacaaggctactgaggagagaaacttggcacctctagaactcctacactcagatctctgtgaaatgaatggggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaagataaaaatacttaggtctgatcgtggtggagagtttttctcaaacgagtttgacttattctgtgaggaacatggtattatacatgagaggacgcctccctattctcccgagtctaataggattgctgaaaggaagaaccgcacactgaccgacttggtgaatgccatgttggacaccgcgggattacctaaagcatggtggagggaggcattgttgacctcgaatcatgtgttaaacagagttcctaacagaaataaggacaaaacaccatatgagatatggattgggagaaaaccatcactttcttacttgcgcacatgagggtgcttggcgaaagtcaatgtaccaataacgaagaagcgcaaacttggacctaagactgtggactgtgtctttctgggatatgctcaccacagcattgcctatagatttttaatagttaaatctgaggtacctgacatgcatgttggtacaattatggagtctcgtgatgctaccttctttgagagctttttcccaatgaaggatacacatagtagttctagccaaccctctgaaataattcccagttcaatcacaccaccagaacaaactgaacatacacatgaacatgttactaaggaggatgacagtgaagctcctcgaagtagcaaaagacaaaggacagctaagtcttttggttatgatttcactgtgtacctcgtggatgacactcctaagtcaatttcagaagcatacgcatctcttgatgcagactactggaaggaggctatccgtagtgaaatggattccattatcactaacgggacttgggaggtgacagagcgaccctatgggtgtaaacctgtggggtgcaagtgggtgttcaagaagaagctcaggcttgatggggggatcctcta

SEQ ID NO: 12548 - DNA, 8476 bp, Oryza sativa
actcacttgttgctagattgaccacaattcgtgtgctactttccctagcagcctcacatggtcttctcgttcatcaaatggacattaagacagcttttcttaatggagagctggatgaggagatctatatggatcaacgtgatgggtttgtagttgaaggtcaagaaggcaaagtgtgtaaattgttgaagtctttgtatggtctgaaacaagctcataagaaatggcataagaaatttgacaaaacattgacatctgcaagctttgcagtcaatgaggcagataaatgtgtgtattatcgccatggtgggggtgagggagttattctgtgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgagattacactcttgcagtcccattatgtggagaagatcttgaatcgctttggctacattgatagtaagccttctccaacaccttatgattctagcttgttgcttcgcaagaataagagaattgctaggaattaactggaatactctcaaatcattggctcgctgatgtacctggctagtgcaactaggcctgatatctcctttgctgtgagcaagttgagccggtttacctctaatccaggagatgatcactggcgtgcgcttcagcgagtaatgcgctatctgaaatgtactatggaattggggctttactattctgggtatcctgcagtattggagggatatagtgattctaattggatctctgatgtggataagatcaaagccactagtggatatgtcttcacactaggtggtggtgctgtttcgtggaggtcttgcaaatagactattttgacgaggtcaaccatggaagcagaactgacggcactggatactgctactgttgaggcagaatggctgcgtgatctattaatggatatgcctattgttgaaaactggtgccggctatccttatgaacagtgacaatcaaacggtaattgtcaaagtgaatagttctaagaataatatgaaatcgtctagacatgtgaaaagacaattgaagtctgttaggaaattgagaaactccggagttataacgttggattacatccaaacagctagaaacctggcagatcctttcacgaagggactatcacgaaatgtgatagataatgcatcgaaggagatgggtttgagacccatgtgagttatactatggtggtaacccagtctatgtgatcggagatcctgtgaattagaacctgggaagaacaaaccattagtaaactagaggagagtaccaatctataccctctctaagtgaagatgcatgtactctcgtgagctacaaggcaggttggctatgccttaatgagttctgttggctttatatagcgaagatgctgtcctgcagagcattcttgaaagaactcacctttgtaagcttgactgttggtcgcagtctatgaagattttgggtgaatcttctaggaagcttactaaagacctaggagtatgacttatatgctctacccgaggggtaaactacagacggtctagtaccagataagactctgagtgaaacttgcttgcacaagactgtcaattcaaggcgtagtccattgttcaagttgtgagtaagtgtagcttggagatctaggtggatgttcaaccttgatcggtctccatcgaaccgctggtatataaacaatacattggaaaagacaaatctcagtgggattctgagatttggttggggattgttggaattaatagatgggctaaggcccattcgaagattaattctttggaaaatcacaaaagcccacctcataggatggcatgcatgtggagtttagtaccaccttgcttattctaggagagggggacctccttaaaatggaggatgccctcctagccacttgaggcatgtgtggtggagagaagagggggaacacacgcgcgcgctcgctcgcctcgcctagcctggcaggcggcgcgcgtgcacgacgtacgcgtcgaatggtccgcaaaattggctcctcacctttgcgcagatgcagcctccttttgcagttttgttttgctgcaggaaaattcagatttgttttgttttggagtccggaaaatccggttcggtgcgtgaaaacggcgtggagtccggataagttacgcgcgacttatccggttcggttacgtggagtggagatcgtgcgggtgcactgagcaagcaaccgtcgccttatccggttcggttacgcgggtttatctctatataaaccgagccgccgccttcacgcaaaacacacgaaatcaatctagggattgcctcctcctctgtgttgtgccgtcgctcgtggactactccatcccgctcgccagcgtgcaccggcgatcgggagagcaggtatcccgaacctctgccttcgacgtcctgcaccgggagaaggcggcaataaggtttttgggaagcgcttcgcgcgctgctccttgttcatccgcgatggctcgccttcctctctgctcgcgtgctgcgcgccttcatcgacgctcgcaaccgcgagtagttcctgccgagcaaccggtctttccgccacctcggtacgtgttcgacatgttgcgcatatttgatttgttcatgttttactgcttagtttacatatgtagatctaatgatgcgttaatgctagtatacatctgtaatgtcatgatttatttatggaatatattaaatcattatatgcctatattctcaacatacttcaagtccctgaagcttttgctgcccacacactcatggtgcaaatgaaacgtagttcatattgtccctatagtcacaagtgtcaaaaatatgagatttgctccgtccaataaaaaagtacctcgacgtaccagtacctcacggtaccaaatcatttctgaccattggatctaacaatactcgtcatgcccaactatatccaacgatcgaaaacgatttggtatcatgagctaccgatacctccaggtactttttgctggaccaaagagcctcgcatgtgcccatcctaaaaatcacaaaaaggaataatgggcaactaaacaactgattttacaaccggggcatgcacattaaactgtaagatgtggagggcataaattacacgaaagctaaagttgtaggaccagaactaaccttattttgatcatagtttcacaatgtatgttccacctttttgcgaacaatgttctgttgagagaaaaagtttgatttgtagctttaggccattttcaaggcgtcctgtgttagctcatcagttggctgcaatgaattataagggtaactccttgtatatgataacaactctgagaggtgaagggtaactccttgaatatgataacaactctggcaggtgaagaatatggttggaagagagagtatgtgccaacagttcttgaagaatgtggctggaagagagagtatgtgccaacagttcttgaagaatgtggctggaagagagagtatgtgccaacagttccatgacaacagaccgcaccataggtagcaattccatggcaaaatgcagataagcctcaggtttcggatgagacgatgcatatgttgtagctatgtaagcagtaacatcccaacttgatgtcttatatcattttgtcccgctgtctagattgcttgagtaagatctagattacttttgagcaaataaaccatggcatcatgttcagagaggccagaaacacgggcaaccaacacattgatgagaccatccaaagattgagactcgatacatataaaaatttgagagcttgatccggtgcaggaaacattggattgagtggcccgtaacaatagccggccttgagaaggccgtggtgataacggccgcggaaatcttccatagggatccgagaaattgccctgaggtacacaccatggattctgtccagaaaaatgccccggagtgacagtgtcaatgtaggctgaaccttcatttcgaatttatggcatctcatagcagcaagatccataggattgttcaaattcttcagatccagcggcttctgcatcaatctggttaacctggtcacatcttgaatcgagaggaggcgacgacgggccggaattctctgcagacaaagagtgggcgaggtgagacactggcgcggacaatccaatgaggaaagcattagcatcaacatcaggcagcctcgtggacaacgcggcgcatctaagagcagccttggcagcatgtgagcggaattggaatctgtccttgtgacgatgatggtggcggtcaacctcgatgaggcggacggcgagaaggagatccgccatggataggcggaggtagcggagcgcatcctaggtggggagatagtggtagtacgatgtcaaggtgatcaggccttccagcgagcgctccgcgacggtgtgcgcctctggaggggaggggacgtcgccgccggtgacgatcttagagaggaccatctccccacttgctcttgccacccgcgaccgtgaggccatggtggtctcccgcttcggaatcatggcaccgtcggagtcggggagttcgctggggacgacgcggagggtgttggcgatgatgttgttgacagggtcggcgaagccgaagtagacgcctgcgttgaggaggcgtgtgttaacgaccaaatttggtaagatatgaaccaggttcggcattggaatcgaagcagattcggcaaagagttagattcgaagaacagagtatgcatcggctgcgaaggcatcggctgaagtctgcatcgtttgagatggatcggatagagaacaacggatacagccggtagagtcaatacaaccgattccgatggggatggctccgaggctgtttctagaatcaatcaacgtgcttcacaaggattgccacgatggagataaatctctcagaaagacaattatatatattaattaggatatttcgtgtaattctctttagagatatgtttgggcaaaagtctgccgcaaagacttatggtatcttagagtttgttagagataagagttgtgtccggcaaggacatattttgtatctcaggtataaatatgacctgaacggctgaacccaatgtaataaaaaacaacagttcaataatactttcggtgcatcgccacccttttactttcgttctatttcgacgagttcctacttttgggttgaactgcatcggtttcgatcttcaactagatgaaacttgtcatggcggtttgcgttctccggattagtgtgtccatctttatgacactctaatcctgtttatgtaattcgtcgagttatcatatacactctgtaatctctgttagttgcgctatatgacttgtcatcggctggttcttactattaggaagtaaacgatagagttatgttttgttattaatctagattatataatgtatctaccatctcttagaggttttcatcctcttgcctagatcttatacttgtctttatgcttaatgctacatcggttgaattcgatctattaagtaatatctataattaattatgatatctggcttgttttatgattatcaagagagatagcatcggggtttcagccgatcttacctgatttagctactttacatctcatatgcttgattgataggctagatctaccctttagagtgagatcttattgcattaaagtatattagactttttgtttgatatattttgcctgttttaatatcttagtataaagtggtatcggagtattagccgatacatgctagatctacctgatcggctatgctataaacgtatatataatcattactttagtgtatacttcgactttagtgatttatactatctcggcatggcgaccgatctatcccaatcacgtagtttaaatatacatcgaagaaagcattatatatcgttaatatctacagccgatcgagtagatttagctttatcttatttattcataactgtcgatcgattccaacatgacatcggctcaaagataaatgatatgtcatcggcaactagccgatcggctatcgtttatagatttaaccgcggtttttcttatctttctttcttattgattgcatgatcaaatcaactggcacgctcacgaacctaaaagcaagattttggacctgcactgaagttaagcagatcttacaggctagtgtgtgtttttagcatcaatagcgtgcggcgagcactagcacacggtccagcgacagcgcgtcgagcgcctcctcgtagtacccgtacatcagtcctagaatcacgcgtctgttgcgagccatgccctcccgcgagcaatcggaacggtttggcccgacgccggagtcgctgccgtctccatcgcggtcgctcccgcctcgcaccgctgtcggccggccatgatctggggttagggtgagcgtggatcacaggaggaggagggaaacagatcctctgacattgggtggaaagtcacggtgttgcagttggtttcatccctgctgaccactgcatccaacggcacacatccatcttccctccttcgaactgcatattgtgcggcccagttcgatttctgtggccatcggctaggccatcaggtcacaatgaccctgttgcctgctactacatgcaaggactcagtctcgcagaggacaaggctgtcaagtctacaacaagaacaagagaaccaaaactactgaagcataaaactgctatcatttagaataattcaaaataagacctaagtttcaactagcatcattcatgcattgcaaatcaacagctgagtttggagaacactacaaggcgtggctattgtgactaaaacagtagaattgaaaaaaaaacaaaagtattgcactgggtacaagcagcgtgtgtagccaagattatgcggtccagtaacttcttaacatgccaactcattgcagcttttggcctaatccctgaattaccagccgcttcaatttcaaaggcttgaatttctgaaatttttctttgtgatgccatcaagtggatggtttctggcaaatgaaggatgtgattatgctcaagaactagatccgacacttgataatttcctacctctcgatttattatgagacccatgcgtactttacagtcagttctagtttcagctctaggatacctagtgagatgatctcttttgtcctctgttcgtcgaccctcatttgaacatacatatctgcaggatgtgatcttgtcatcagacttgcttttatttttgtatcttttttttacatcaaagcccatatgacctccatattgtacccaaaactcccaagccttatcctcatcaacctaggtaagaagagcttcagtgcggaagcagaaggcctcgagccaacagaggagtctgtcaacaagcatttctgcacaaggaaagttctcctaagcaatgacacgccaaacgttgtcgccactctatgtttctcatactgatctacatttgttttattttttctgcaaggaaatcaatttcatactatctatgtcaatgctataagcaagaagaaaaattcttcttgagattgaattatatcatcaaataaaggaagctatttaatcagttgaggactagacacgatttatttccgcctttgttccactaatggcaacttggagaactaatttgttattgcaacaattttcattctatatatgtagctgcacaagaattggcaattaatttaattatgaactatttcgttattacttcaacagtttatctaaggtatgattcacaccccctcaaacccctctattctaagaaaataaaaatcaagaaaatatttgtttttcgatctatgtgttggaaaattattgggattttatgtgttggaagaaaattattgtacatattatcttttaattaatgagtagatgatagggttaaaattagagctagtagtcacatttactataaaacttgctctaaggcaagtagcacattccaacgaagttcaatcaaaagaagccaaaccatcgcgccaccgctagtgatgactagaatgacccgtcacaacatgtgcacaatctccgtggtacaatctcaactccagtagtactccagtgctctctggaacctcctagcttgcccgagacagagaaaaaaaagcctcttctctggcccctcttcctccttgattccggtggctcgccgccggtgacgggagggagaggggtcaggctcaatcgcgtctccttcgtatagtagtttagtcgggttagtctcgtagtcgagttagtctcattctgtgtccttcctattcttcgtctttggtcctctatgaagagtccagtgttcccttcttcagatctgaaatcttgtgggtggatcagccagggaggtcagtcttcgcggtgccaga

SEQ ID NO: 12549 - DNA, 682 bp, Oryza sativa
ggatgagcagcggcagcggtgggtggaggcgcatcgcctccttcatcgccgcccggaggagcgtcatcttccccagctgctcgcctgctcctccttgacgatgacgacggcgtcttcgtctccttctcctccgtgtgcagctgctacgacatgtctcacctctgcttgcactttcgccatttctgctgggttcttgatgagctcggccattgttcattctatcgacttgtagactgtgtccgtgcctgccgcgaacatgtcctgcaatgcgacatgaaagaaatcgaaacgaattttagcatgattatttgattggtgataattggagagaacttaccaagatgaggagtcccttgacatcgatcctgtcgagcttgtaccatggtcgtcgccgccgttggccatggagagaaggtcgtccatgaggtcacgggcctcgccgtcgccgtcgtcgtcgtcgtcgtccccgcggctcggctcgtggtcacggagcaccatctcgagaacctcgtcgagcttggccgacgtcctcttcgtcctcgcgtcgagccccgtcgcccagtccacccaccggagccgcgggaacatgtcgctcactgcgatcgtccccagcaggtcggcgagctcccccaccgtctcgcggaccttcgccggctcgacgccgccgagcttcttcccgaac

SEQ ID NO: 12550 - DNA, 15015 bp, Oryza sativa
  unsure (1)..(15015): unsure at all n locations
aacttaccaagatgaggagtcccttgacatcaatcctgtcgagcttgtagccatggtcgtcgccgccgttggccatggagagaaggtcgtccatgaggtcacgggcctcgccgtcgccgtcgtcgtcgtcgtcgtccccgcggctcggctcgtggtcacggagcaccatctcgagaacctcgtcgagcttggccgccgtcctcttcgtcctcgcgtcgagccccgtcgcccagtccacccaccggagccgcgggaacatgtcgctcactgcgatcgtccccagcaggtcggcgagctcccccaccgtctcgcggaccttcgccggctcgacgccgccgagcttctttcccgaacgccgccctcgacacgacggcgtgggtcaggccgacgatgagctcggtcaagttgacgacgcctccgccttcgccgttcgccgcgcggatccggttcacgaacgacgcgacctcctcctcccggagggcgcggaacgagtcgacccgcctcgcgctgaggaggtgcacgacggcgacgcggcggaggcggcgccaccgctcgccgtaggggctgaacgcgacgtcccggcagccgtacagcgtgccccgcgccgtgtgctgctgcggccggccgcagaacacgtggtcctggtgcctgagcacggcctccgccatggacgccgaggagacgacgagcgcgcgcacggagccgagccggagctggaacagcgggccgtgccgccgcgcgagctcgcgcagcgcccggtggtgccgcccgcggccgagctggtggaggttgccgatgaccggcaacgccggcggcgacgtgatcgccgcgccaccacggccaccgtccgcgccgcccgatctcaggtagctcctaaccgcgacgaccaagcacgtcgccaagaagagaaagccgatgagcaggccggagtcgagctgcgcggccgccatgtacagagctcacgacacacacggtgtacaatgtgcaagccttcactgatttccttggtcactttagagcaggtacaataacaggctataagccagctgcaaacatattttaagaagataaatgaggagagagaatggcagtgggctacagatttgtagccagctgtagcacagactccaagacacagtgtgtgtatgacagatgggactaggtattaatagtgtaatatgtaactattgtatagatgagctattagattgactatagatgaattggagctagtagctagctggctatactattgaacttgctcttagacatgcaactagcttatgcacgaacctccaaaaatcctatgtggcccaatcaggtgcaataacatggacctcgatgacatcctataggacacgccagcaatcatagcaaacttgcctatgaaatatctgggtctccccctgattacaagccggctgagaaagacatacctccaaccgcttgtctacgcagcctccaaaaaaaagaatagaacgcttcagcaggcttcgcaagcggaccaatagcttctcgacttggacctgcaaggaaatgcgggctggacgacaaacctgattgaccaacttatcggggtttggaacgcactacacatggtagagcacgaggaggacaatataacatgaaagcttactaaccatagtgaatatatgatagtgtcatccaaaacagagtctggaccttcgccaagttggcgaccagaggttggccaaatggttccatctgccccttatgttgtcggacccagaaaacaaccctgcacctcctcgcggaatgaatctagcggcattagcggagcgggcggcgtgcggacgactaaatcctagtcagtggtggcaaactttgacggtgatagatttttttttgactaaatcaccggggggggagagaatccccacctgaatatattgagccaaatgatcttacacagggcaagctttacctacgcaagcgcaggggccctggaggataggagaacagaatacacggagaatacaacgaggagagaacagagaaagaaaacctcctaaaagattataattgatgaacgacacctgcaaaagttatcttgccaaaatacaagaggcacccaataaggcactccgcactttgatgctgttggtcggctagaagatatggaacgaaaggaatcgcataaccttccaacaaaaggagctttcagctacctctcttctagccaagatcaaggaagaggccaaaacttgggccttagcagaaacgaaaaatcttcgtaattagttttcttttagttagctcagaccaaaggtcctaagcttcttttctttcctttcgctttgtaaagctactccttctcaattcaatgaaattggcgctcgtcaattcattaaaaaaaagatatgcactatagaagttaagaagtacgcatcaacgcatgggcacagaaaaaaaattcaggcgggaaatacaaatgcaaatgcaaatcgaggaggcaaatccaacatggcggggagaggcatgatgccacgtaatacaaccatggatcacattaatggcgacgacgacgttggccggtgccaatttttccacaggggatttgctagatttcaggcacgtgccttttccccttccatatgcagcattaggacccgtttagatccctgccaaaatttttcaccctgtcacatcgaatgtttggatacattcggatacattcatgtagtattaaatataaacctaaaaataattaattatataaattgcgtgtaaattacgagacgaatcttttaagccgaattgctccatgatttgacaatatgatgctacagtaaatatttgctaatgacatattaattaggcttaataaattcgtctcgcagtttacagacaaaatctataatttattttgttattagtatgcgtttaatacttcaaatatatctctgtatatcacacgccaaaacttttggacctaaacacggccttagttgctggttggaccatcgggcctgggcttctataaagattgagctaacttttggggcttaatcgtctgatttggcccaacttggatatgggccgtttacaacatttggccccacacggattctcaagtcttacggggacggacacacctcatgcacttcatgccatctcgaccgtccaaaatgcaatcgaacggatgccgattcatctcaccatggacgcggtccagccaagcaatgccagcataaaccgcgtgcacctggtttatgtgctggtgtgtcctcgccgccgccatcgccggtcaactccggttcaaaaaaaatttagagagaccaaccactcatcgtctctctacttccatccgcttcaaccttcaaggtgcgccgcctcgccctcgtcggatccctaatagggaggggaggtttccgtctgccgccgggaggcgcgggcgccgccatgaccgggtgcgtgcgtctgcctgcccccccactccttgattggatcgtgtagcacttgccccgagctgttcccctaggtcatcggagggaatgcgatttgggattgggcgggatgcaaaggaagcctccttttgggttctagggattcgcgggatagcgttcccctgttatcctcactgatttgttgttgtttatcatttcggtttggtgaatgcgatttggattggggacagtttgctgtgtgctacagtgaaaacatggagattatcgcaggatcctcagacttctctattgttttttttttgaatcgacctgcaggcattgtcatgtttataaggcccggtgttcggaccgcgtcatacattcgtggaacagtgtgctcatgccttcggtgtgagacgaaaggttgtgtcttttttttttttttggttctctggcaggcgatgactgaatttcgtcactagcttgtagtgttgtaggcttttgtagcttggtctgtgattgtatagtagaaggatgacgcttctgcattgattttagttcaaaggagatacttttgtttttgccatttcgggacctgagggggggggggggggggcgtggtgggggtgcagttatgcactacgtatgcattctgttctcttgcaattgattgaagggcacccagttctgctaggtgttgcaccgttttagtttagctgctgcttctttctacagcgtggttgtgctagttatagcggtctccattatatcaatttagtttgaaaaaacactagtggtgttactactcctttgagttaaaatgtgccaactattagtagcttgtatttgggtatacacctctccaagatgaggttgaattcctcatattcatatagtcgtgggtagcaatagataaccttttttctttatatgtggcctgctgataagatcatgtcatgcattgtggaacaatattttgtcgctatctgtttcagatgaaaggcgggatctgttttttagaattttttttttggagggggcaatgattgaatatcgtcactagtttgtagtttatgcttttgcagttaagtttgagattgtctagcagaagtacaacgtttttgcacttcattatagttgaaaggaggcatctccctgttttctgccatttctggtggtatggtacctattttatcaaatctttgttggaaagacattggatatagcctttgggttgaaattttgctaattttactattgttagcttgtctttgggccatcaggtatgcatatacatctctgaaagctagaggttgcccactgccttgtattcctactttagtacccttcacaaaatggtgaaaaaagactattgttcttagtttacgtatcattgtgaccagcatttcaaattgtgtcagaagagcatagttttgaacatatgcctgtcatccataccggagatcaatgtctcttgatttttgtaagctggtgcatgattggtattagtatagatatacagttctgagaaactacattttgttgtagattgaatcgtggtttaggagtacttgtctcctcaggattaattggatcattctttgggatcattttaatgatattagatgtgcctttacctgcatttggtgtgttgctggttaattatgccgatctatatgggagttcctgcagttagtgttcttgaacaaatctgcttcattcatctgtcttaactctataatcaatatttctgcaggacatcctggataattgacagccatagaattgcttcaaaaataaaaaatgcatctggatcggtggatgccagtaagcacaaatgggttagcaacccaactaaggcttgtccaaggtgcaaccacatcattgataacagtgatgtaagagatgtgttcttttatcatgtataagaaccaaatacgcacgtagtatatcatttgtatttcattcctgctttataccattctaaacagattaaacaatcaaataaaactacatgtgaacacctactgagtagtgtcattgttatgcacctttgttttcgtcgagtcgcctatatcaataaatgaatggatttttgctattagcaacttactatttatcactttgacagtgactcttttgtatattattctgaagtcctctgactttctctctaacatcgaagctttgtttgtgtatactttcagatacaccactcagtattaataaataatgtgtgctattgagtgcagtcctctaatgattaatatttcaccacaggttgttcatcaatggcctggtttgccaagaggtgtaaagtttgatccaactgaccaagaattgctttggcatttgcttgcaaagcatggcaaagttggtgcaaaagctcatccgttcattgatgaatttattccaacagtcgaggaagatgatggtatctgctatacccatccacagaaacttccaggtaaccgttagtgaaaggatatatatttttgtttctctcttcgtggggtgagcaagagaagtccaattttattttcatataagagtaaaattcacatttttcagcttgtatcaaatgcttgcctttggtccgttttcttttggtatttattttcttagtcacaccatatgcacaaagtttggcggtagtgcgggtgtggcaataaggctacttattttacttctctttattggcttattaacccttgatttttcactattccactcagcaacactctacaactaagtaattctcattgactggtttgcatttcttaaatggttccgatagagcattcaaattctactttcttttgacataggaatctcagtttctaactggaaaattgttgttttttgtacctctgttgtattgcttgtggtattcttcaactgacttttttttctttttcaggtgtcaagcaagatggaagcgtatcacactttttccatagaacatttaaggcctataatactggaataagaaagcgccggaagataaacactggtgatcttgctgatgtccgctggcacaagactggtaagacaaggccagtagtagttgatggaaaacaccttggttgtaagaaattcatggtgctatatatgagcaccatgaaaggtggtaaacctgaaaagaccaattgggtgatgcatcagtaccacctaggaactggggaagatgaggtagaagggcagtatgttgtctctaaattattgtttcagcaacagtttaaacctggggagaagaacgcacaggacttaacctctgcagatgctttagaatctatagttgctgaagatcttccaaatattcctccacttcccctggaagaacatgtttttaccaaccaagaactagaagttcttgagaaatctgaaactatcactgaccaggtaattgaacatctaagctttctttatttcccttccaccttttccctatgtgcagcacatatttccaggtaattcgacatagcaaagaaaatgtcaatatagtttctttataatgatattaaagggaattggataaatgttgtgccttcttttgctggcaaatgtacagggaaaagagactagcgaaataaacaacgaagataacgctgtagaagatgttgcgcatatggctactgagaaacctgaggatggagataacccctcatcgcaagatccgaaatggtgggaaggtgaatcccagttcctgttagactctcagcaactggcagagaaccttgcgatttgcgatgagttccttcagagtcagagccagacctcatgcggcggtggagatgatgaaaccgataagataaagccccgtcttgctgtttatgcccagttgccagtagaggacttgaagaaggatctggaagaatgccagaggttggacccctcagatggcacaaatcttgagcttgaaaatgcgtctgaatttcgactgagccaaattgtacgtttccattgtctcatgttaaaacgtccagttttctctccatcctttactttgctaaacttgtgcttcacttgcaggagttttcgcaggatagctttacgacggcatgggctggtggcaaggtgatcgattgacatgtctccaaggtgctgtcaacaccattttgtacattgaagaaacaactgaagcctcttccttctgcgagacaacagtaaaatgctgtcgatatatgtggtgaagcaactcttgtctcggacagtaaaaagtcataattttggcccggcggcttgccggggtaggcaaaaggtgagcttatgcgctggcttgcccctgaatcccttgatgcatatggactgtgcaccggtgactattcaatgctaaagatcacatattcctggctgtaaattgtgatggtggatgtctcattttgcttggatactctggaccatccggtggtacaaggggaacttttgcttctggttgaactgattactccaataactttcgtgttaataacttttgccatcatgatagtgcctattatttataaatgtggacacaagtcattttctggagcttgtggtaaagcagggctgagaatctcgtgcaagcttcatcttgtaaattgcagtaatcagcataagattgtgacagataacttccatgtttcagttcctatgcattactactatctaattttcctcgggcaatgagcatgaactatgcatgagactctacagaagatatcggatacgaccatacgaatggactaggatgaggatgctactactggccgccaattttgcttggcattatggtggattactctaatattgttttgtgaaattgtttctactacctccgtttcagattataagactttctagcattacccatatttatatagatgttaatgaatttaggcacacatatatgtctagattcattaacataaatatgaatgtgggcaatgctagaaagtcttgtaatatgaaacggaggaagtatttttttttcattatcaaaattatttcttttaattcatgttacaaatgatagctcctcgaaaatttgaacaccatttttttaaacatgagatagaagctccaccgatcaattaaaagggaaaaaagcttaacaaggtctataaaacaaagctataccgatcctactggtaacaaagttaatggacgcttaaaaaaagtatggacacaataactagaaagaaatttgagaatatacttttccttttaaaaaaatggacatgattgtaggaaaattgagaaaatatacacgtcatgtggcgcaaaactatggagtaacgggaccaaccaacaagttcttgctaatgggaaaaagagagggttgaatgtgggtgctgttcttattttgcccgagggatccgaattagcgccgcccgactgtatttctcctgagttgaaagaaaagataggaaatctctcttttcagagttatcgtcccaataaaaaaaatattcttgtgataggccctgttcccggtaagaaatctaccccgcgcattggctgagcgtcactgggttggtcccacagcccggccacgtgagactgagggcagcaacaagtaccgcgccgtgggtcggtcccatagcaccgggtctacaggccccatcgtttggccaagtatggataatagcactgtaataataatttataagtaataatagcactgtaattaaacttttatatatgtgctcttaacgatttaaataacaatgctgaaaaataaactttaataaaaaaatcaaaatcaacttcaaaattgagttgtaaaattcaaaatttggcagcggctgatattgtatggaggaaacgatgggaatcttaatacactgatgcatattgattttctcagttcatctatctctaccgagtttctaatccctactccctccgtaaaaaaaaagtttggacatagctaactacaagtggttttttatgtgaagagcacatgttatcatgatgcatcataacttcactaccccggactaaacaagattataatatgctgcaatctgcatggtttctgaaactttgaatccattttgaacaaaaaaaaaaggttttgagatgacatgtagacctagtggtgcggagctatatctgatatggaatcgattgggtattacgccgtcccgactgttgctaccttcggtcccgcgttgctgggccacaggactaacccactgccccgcagccgaggcgcagggtggagttggtatcacgctgttgagcaacggtaccaccgtcctcgttgtcggtcctgcagcttcacgccgcgccgattgacccacccatgtcttcgctccgtgggatgtgtatattttctcaattctctacgattatgtatgtataaaagcaaattcttaaaaatgaaatctatatcctcaatatttttttctaataactattacaattggatgggatcaatggcattaatttgatacgtagaacggttacaatttaataagttattgttttcacaatgactaggcttatgaaatcaaatatagcacaacaacacaggctaaacatctaaacatcaattgcttgtcctttccatgattgccgtgacaatatcacaataccttgttctcactaatactctatgtgattttatctctacctgacaaaaccaaataaccaaatttttcaccaacgtcagctgatgcacggtgtaattttggctcagctttgggtcccctagctgttgaccacgactcttacgacaggtaagtgtggtgtgtggataaaggtgggcccaagcccatggcgacgggcccaccacccagcggaggctgagagggacaccgtgggtctcggaaaaaaccgtaacggcgtctctctccgttacaacggagaatccttcgcaaacacggtacgtttttttcgtatccaggtccacctcagcccctatccttttgcaaacaaaaagagaaaaaaaaaggtgacctgattgttttatttgctttgcaccctgtcaatacttctttgttagataaacacccctgggaatatttttcctttggcaaatcttatctgcaaggaattgagtgcaaggaaagccttagaaatgacatagcaactcatgtttttcctatgtgatggattgagtaagtcaataatgtgatattttttattatgtggaaggcgtggccatgcataaataattattcatgtacactgtattcacgagtacatcgctgacactagatacactcaaagaatgtattcacgaattcatacactcaaagaatgggaggctaacaatagatccgtgacatcaataaaattgagggctgctagcccacgggataccgttgcaacggaatatttacgaaatattttaagtgactctcctttttccttccctctgtctacgtgtgctcccctagtacctggtaccttacgtaccggttggtacttgatacctgctatcttaggtaccggttggtacctagtacctggtaccttagataccaactagatatcgaccgatacctgatgcccagtacccaagataccgggtggtacctaggtatcagaccttggtaccaaggtatcaagcctgatacttgtggggtatcagagggtaccgtcaaaaagaggaggagacgtgggggagggagcgccgcaacggcggaggatggcgtcgaggaggcatggcgaggtgagggacgtgtgttcccctagtacctggtaccttagatatcggttggtacctggtacctggtaccgactaggtatcaaccgatacctgatgcctggtacctaaggtactgggtggtacctaggtatcaaaccttggtaccaaggtatcaagcctgatacttgtggggtatcaaagggtactgtcaaaaagagggggagacgtgggggagggagggccgcaacggcggaggatggcgtcgaggaggcacggcgaggtgaggggtgaggcccaagccagagagcgcgagaagtctcgaggaggagccgaggaggaggttgacggccatacctgttgcaggtcgacgcgggctgtcagcgtccatcccgaaggcgcaaaagcggcaggccgcagcggggacgacagtgacgccgaggccgagggcgaggacgaggggagctcccgcttcttccctccccggggcgatgactccccggcgcacacccgacccgacgagggcggcgagccagagcggcgcagcgaggggaggcgagctcgagggcgaccccgccgagggttggccgaccttgccgacgcagtgccgtcgtcgtcctcctcagccgccggagacgacgacgacgaccccttcctcccggccggcttcgtctccgctcggtcttcttcagagagagagaggggggggggagagggagagggagggctgcagtgctgtgtgatttgggggaggagagtgaggtaggaggagaggattcggatgattttggggagaggagtgaggtaggaggaggggatcccgtctccacgggatgtcgtggtgtaggttttctgataaatttttattgaaagtagcacatgagcaaaagctcgcgagctttaccgagccgagctcgagcttctactgagcttaaccgagcttggctgtgtatagtttatattgcatgctcaccttattgatataataaactaatagataaatatatatattagtatctatttacacaataaattagcatgtgttagcacaatatatttattttagtcattttctactcttttattactgcgattaactagaaaataattatacttatcaagagattatcattaaaatatatattatgctacttatggccgagctcaagctcgaacgagctcgaatcgagcttgcctaaaagctcgaaggtgcaataggctcggcttgagctcggctcgagcttgtgtcgagttcgagcttaggcaaacgagctcgctcgagctcggttcattgacagccctagcggggagttaaactatgtatatttcttgattttttccactacatattcacatgaaataaaatgtagagaagtcaaatctttcttggtcgtggtgaaaaaacttatgtgatgatcaatgcggaatggagggagtaataagtaacatattgaagtcttgaagcctcttttctttttgacggtttgcaaaattgttttttttttatcagaatgatttacgcggtattatgtctcatttggattgcaatcatgcttatagtgtatagtttggaacattttattacccttgactttgcacctatgcatgcatatcctctcaattcctccgaatcttaaaaagatactttattgtttatcattaattttgttgaaataataattccaaatagtaatatatactccctttgatctcgaataattgatacttgcactattcaaatttaaattttatcaatttgtattttcattaataaattacaaatatggacacgactacagggagcgcatgcactcgttagtgctaaccagcgaccatccttttttaccaaaaatagtacagtgtgtatcaactcattacccctcttactaaaagtagtagcacctgccacatgcatcctcatttaaatacttatatgatctaagatccgattactcagttgtgttcgttgcagttaaatttatacaacaagatcttatatgattatattatgatgaaaaaatatttatgtttgtaaaatacttttattatatactaagttacttttatcatatatataaattacttttagatttagatttgattaaattacttcctatacattcataatgctatgaggtggttacttttattattgtttttagtcaattccataatttgtgctgattaatttagtctctagatagagttatgtttttatccttacaacagatttacttctaatgttatgacaaagttactttccttttgtcttaagttacttctattataatatatgtaaattacttttagactttattaaatttacttttatatgtccaagaagtactttagtgaaatctaaaaataatttagatatattataaaagtaatttgtaatttttcatcataatataatcatgtgagatcttattataaagatttaattgcaacaaatacaatggtgtaatcggattgtagatcagataagtaatttgaaagaaaattttataagaagggagaaaaagacatagatgcctaacactacgatgcttctctcaaattctaaactctgatgcttctcgactaaatcggatggccgcgccaggcgtcgctgcgtaagactagatcgagaggcctcacgttatagaatttacgttcaaatatattatattatcagagtatttggtgccataaatataaatttttattcttcataatataggtattattatttataaataattcatgctactttgcactccggtcggatacgccctaactatagataaagccctgatcgatctccatcctgaaacacacgcaaaaccgtattctaattctaattaaacagaaactcaaatcacgaagacaaacaaacataaaaaaccgtttgcattacaacacaacccaaataaccttcctgtcctcctccgatttaggtaggccccaccggacagtgactcgaccttggcggcggcttatatataaaaacacgcaaagttaacacagcgcggccttcttcccggggatcaggacgcaacatattcacaacacgcaaggtctaatccgaaaaaagggaaaaaaaataccctcctcgcacgaaacgaagccaacccccaaactccgccgtcaccggcgaccccctcccctcctccttccgccgccgccgccggcgaggcgtatcccgccggtacatctagagaagaggtggtgggaagggtgggggttggggtgggagcaaacgaggcggcgagacatgaatttcttctcgggggtatgggtgaggacgatgatgaagcggctgtgcaagtcgctgctgaagaagcggctcggggatctgatcctgggggacctcgacctcgaccagttcgacctgcagctcacccgcggcacgctccacctctccgacatcgccctcaacgccgacttcgtcaaccgcaaggtgagcccctctctctctatctcgtgccccgacccgtgtgttcgattaggatgcacccgcccgtcgtgattagtgtgctatttgcccgaggttgaaattctggtggcagagatgggaattgggtgtttggggatgggaattttgtttttttttgtttttgttagaaaaaagaattttcctgtttagttgcttggtggattcaactctgtatgattttgatctcgattggttgctagcatgagagtgtgggcttgaaattttggtctagaattttttgttgcagaggaaataatctgttcgcaggaaaaaaaaggaaggctttttcctttcaatcagtaacctcgggtatgggtacagttcagggttatttgtgttcatttcatggctaaagctcatgatcgcaggtagagtattagggtttaggagaagtggagaaggggttatannnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12551 - DNA, 643 bp, Oryza sativa
aggtgcaacgaaacctctactgacaatttccaaatttaatctttcaaattccttgcataacttcaatggcaactgtcgtccttccgtagcattgcaatagcctttcctgtgagagcatctgctacaacattggcctttcctgggtgataatgaattcccatatcatagtccttaatcagttccaaccatctctgttgtctcatgtttagatccgactagataaaaatatacttcaaacttttgtgatcagtgtacacctccgtacgagtaccaaaaagatagtgacgccaaatcttcaacgcatgaaccactgcagctaactcaagatcatgagtagggtagttcttctcatgcggacgtaactaacgagatgcataggcaaccaccttcccatcttgcatcagaacacaacctaacccaagcttagatgcatcacaatacacttggaaacccttcttaggatcatgcaaaatcaaaatgggagctgatattaagcgacttttcaactcttgaaaactctgctcgcactcttctgaccacttgtactttacatctttctgaagcagtcgtgtcatgggcttggcaatcttggaaaaattctctatgaacctccggtaataacctgggagacccagaaaactac

SEQ ID NO: 12552 - DNA, 647 bp, Oryza sativa
gcggttgacgggacttccaaaaagtaaaaaaaataaaccccatcgataatcatatttaatttttaaaatctcaatgacaataaaaaggagaagcagcgggtggggtatataggagtatagttacaaagccgccgatggttgatgagacttctagaaaataaaaaatgaatcccaccgatagttatgttcgatttttagaatcacaatgacaataaagagtagacggcggacatgccatagaggagcatagtggcatcgtttgacgagacttctaaaaattataaaaaataaaacccaacaagacaataaactctaaaaactataatgttcaatttttaaaggttcagaacttctaaaaagtaaaaaaaataatgataatcatgttcgattttaaaatctcaatgacaataaaaaagggaggcaacgggcgagccgtagagaagtacaatggcaaagccgctgacggtttggcgggacttctagaaagtaaaaatgaatctaaacgataattatattcgattttaaaaatctcaatgacaataaatagaagagacagtggacgagccatagaggagtataatggcaatgtttaactggatgtctagaaattataaaaacgaaacccaacgtgataataaactctaaaa

SEQ ID NO: 12553 - DNA, 688 bp, Oryza sativa
taaactccgtaccgttcgtttttttcattcattttaattattgtccgttgcaggcttgcagcagtcacatgagtgcgtataaatgcaccgatttcaagcccggtgctattaatcaatagattcttcttcactgtggttcgacaaacaatgaaactagtataactatagtataactaggtgattcctcacgctttcccgtgctttgttgtaaaatttactaaaaaattctcaatatgttttttttacaatcaaactaggattacgaagaaaaaaaacaaaacattagggtttatcagtcaaataatactcgtgctttagtgtgaaacatattgataagtatatgttaaatattgtaaaagtaatagatagatttgttgaaatattgtgcaaatgtatgacggagacggatgatggttggatgcttgtattttgatttgtataattaaataaattgtagatcatttgtatgcttgtatgagattaaatatataattattgctagtgggtgatgatgtggcatggttgtatattaagctttagatttagtgtgctttaactttacagaaagcatagatttcgtataaaatatatgttgcaaaaaagcgttgttcctgtccatgaggttgtacctcgcggtacttgtaaaaacacaaatattaaaaaatgatctaatatcaaataattaaaa

SEQ ID NO: 12554 - DNA, 381 bp, Oryza sativa
aatcacaataaaataccaaaaaaattcatccgttgttcttaaaaaaaatccaccgcctccacctcgccaccggcgctacagagccgtgccgcagcctccatcgtggcccgtgcgccagatctgagagagagagtgtgtggtggtggcagagagagacctgggaggtgcgccgcctcgatccgtgtgctcctccgctccggatctggtcccgtcgccggatccgccgcgagccgcctcgggcaccgccgccgtgagctgcacgagcgccgccgcatcgcgacgcacgggcgccgcctcgatccgcgtgctgctgctgctgggctcgtcgccgctgctagtggggagtgaagggggaggagagggagaggtgggtggagagaa

SEQ ID NO: 12555 - DNA, 20616 bp, Oryza sativa
ttgtttctttgcttgttgtctagtgtccgtgccatctcaagatctcaatccccgatctatcgtcgagttcaattccgaatccaatccctccaaatcaaattcctccgcaaaagtccattttgcctcccccagggtcgatgggccgattttccctcggcccatcttcccctctctctcccggctctctctctcgctttccccggcgcgcccccgctctctccctctctccctccgctccgccccgcgccgcgcgcgcgagcgcgtgtcgccgcgccgagcgcccctccctcgcgcgccgcgcgcgagcgcgagagccgcgccctgcgcccctccgctcggccccgcgagccagcacgcgtaagccgcccgcgccgagccaagtcctccctcaccgctccctcgctgccgcttcccgcgcgccgtgttcgcgtgcgcgcgcccgcgcggacgccgtccgttgcaagccgcgcgcgcgtgccgaatggtcgaccgcccggtcgccgccgccgtcagcctctgcacgcgcctgtcgccaatgtcgccgctccgctccaagccgtccccccgtcatcgtcgtcgtcatcggccggcccccgccactccgcgcgcaagccggcaagggacggagccgcgccccttcttcctctgccgcgacgctcccgctccccttcccctttttcccgaatcggcaaaggggcaagcccctttctccccctcttttttccctttttctcctcgccggcgtcatcctcctgccgccgctttggctgcaagcgccgagcgccagctcgcgccttgaccgttcaatgccggtttccctcgcccaaaccgacattgccgcccatttaagcccaagccctccccctccaaactctctcattttcgcctccgcgccattgccgccctctgtttcgccgtcgccgatcgtcgttgcgcgtgtcggaggagccggcacgagcaaggacgcggaagaggactccggccgcgccctctccttcctcttccccggcccgaggccggagagattactcccgcgccgtcggcctctcgtcacagcgccccgtcccgcacggtagtgcctccctccgttcttcctcctcgctccatctcctccccttagatttcggtagtagctcgagtagcctccccgtagttagccggcgccgccccgactgttgccgtcgctcgccgtgtgctcgccgccgtcgccgcccgagctccgtagcacccgctcgtcgccggcctcgctcggcgtagttccgcccaatccgacgctagcgtcgagttcccgacgccgcgtagatgctctcaccgccgggaatcgacctctcgtgacctcgtcgccgtttccctcttctcccgccgccggttgccgccgccgcaatccgccgccgtcgagcaacctccgacgaatccgagccgttggctcgtctccccttgtcacgtgcagccgcccggtgtgctcgcttttgcctgtatcaccgtggttcgctccgctgctcgccgccgccacccgccgtccattcgcggccgggtcgtcgtctacctcccgccggcccgcgtggcagccacgtaggcgccacgtcggcgccagctcagcctagaccgggtcgagcccaccccggtcggtccctccccgtgcgcgcgttccaccgcgagccgtgaggctgcgcgtgggcccgccgcatccgcgtccaccgcgagccgcgcgcgtgcaccgtgtcccaaccccgcccgcgcgcgtgcgccgtgcgcacccttcgcacggtgagccgagccgctgacaagcgggtcccacccgggaccacgcgtggtgagcccggtccaccggctccctctctctcctccctcccgcgcgcgcgcgcttgggccgtcttgggccgaccggtccgttaagctcggccgagcttgccccaaatctcttgggccgcaccctagccacccgagaaaagtctatattccctccctcctttcttttctttttcttttccaaaaaggatttaattaaatcctttttccgttagaccaaaaatccaataatcttagaaattcaatatcttcccacccgtaaatccgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatctaattatattgcttgcaaaatattatgcattgataggatcgcacttaatctattgttccgtctgcaaggcagattggcggacctacctaaattgttgcatttgatcctttccttgttaattgttacagcatgtccccttgtaaccacctagttgcgtcttgatattcgtgcatcctgtgcgagtatcgacggacgccttcaaacttataatctgaataacaacttgggtaaaacttgggttttacgaaagacttggaaaacccgacacctgggtcggtgcttgcgaactaaatgaatttccaaaaccgcggaccggggaacgtaccgggtgtacggtttcccgctctcgcacttaaggaccgatttccttggaatttcatccaaacataagataagttcgaccacatgggtggaatgggacacccctggctgagtaactagcttatcaggggagccttgatgccgagagacatgtggattcgccggggtggtgtcagggaggacccctgggcttcctggcacagtatggtctgggacctaacctgttgttggtctgggacccctctcgtcggcatatggtaaacctgtgtcggctttcaaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgatgtttgaaaaatcagcagctgacgggatcagctaggcccgggtggccgtttgaaaagttgttggcccgggtggccgtttgaaaagttgttggcccgggtggccgtttgaaaagctgttggccgggtgccaaccttgttgcaatcctaaagagtgacacattgcacatactccgaccggacgagacgcactgtctcatccgagtcgtttgagaagcactcacctaatcattttagaaaagagttcaaataaaataaattgcaaaaataacagcctttccttgaagcctgcattaaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgtgcctgtgatgattggtccaagtcctggcttccgctttccttttgtaatgcagttgtgagctcgggatctgtccgcagcccaacatgactatacttctactctttaataaagagacctctgttgctgtgatactctgtctccctgtgataccagcactgtttcctgggactggtatcgattaacaggttaatttggagcgtcacgggctagttccggtcgggactagttcggggcgtgacaaggacagaggagacgcagtgggtggagataagacacgatttttctggcggaggtgttagtagccgctagtgaaaacacgatttttcttggcggacgcttaagtgctccgcctcgaaaaatagagtttttttatggcggatctcttagcgtggccgccagggaaaatatacttttgctggcggtccgtagccccccatcactcgttacatttttgctggcggttttcgcgtacggccaccagcgaaaattatagggcgacgccatgaaaaatcgtttttctagtagtatacgtttggttttcaagtttttgcacctaatcgtacccacctgccaagtttttgtaccgccaacgcaatttactcttttgatatatttggtggtccacttgtcatcgaaggctggatcaagtttagcgccgtgttcaagacgtgggagcgagaggcagatacggcaggggatgttgtgtcaatggcctgcaaacgtgtctagcccatgtgccggcctcacttcaagcctattaggcccacaacgggttacaagagtgcgtacgcagagttctgagctcatttgacatttagcccagctaaaaattaaaaaacttggtacatgaaacttcttaatagcaacattcagtatacaataggaactttatacataaaagttggcatagaaattttatacataaaaacctttttcatagaaactagtgttgcttgaggaggatgcaaaataaatgcttgaggatgcaaatgcaatataagtacaaagtaataatgatttactggggagggttctacatggtcaccataaaatctactccctccattctaaaatataacaacttttagccctcttctccaccatcattctattcccaaccaatcacaacactcttctatattcacttttctcacctacctccactactcaaccaatcacaaccctccaccattcaattctatatatttttttaataaccgtgtctaactctaaaatgcttattatattctaatatggagggaacagaacacgacgatggcacgatacctcatttattccaagaaactttgctcccacagcttacggaacaagaggaagataacctggtcctctagctaagtcaggggacggaaactagcgatcgaaacgatgactctgacagtgagggcgatgttgttggtacaaacgagaaagacgatgagaccgattgcaacacactcccacagtgactactctgatcatgagcctagctcacttgggctcacttggctggtggaaaatgttggttttacctgtcaggtgaaagaatgtggatctttttatcgtcttgaatttgtgggttaatttgtttcttaataaactagatactaaaatattacttcctatacctatacatagattgtcaaactaagaaaaaaattcaatagagaattattgtttgggctgggatattcttactagttgtctagctaaataataagaaaaatgatactttacacatgcataacattttttttatatttatgaaaaagcaagtccttatatttaagcgatcaatgtacaatattgaattccaacattatttttgtatagaccaacatatatatatatatatatcattaaccaaaaaaattgagaatgtcaagttatatatgtgtacacatgtaccaataatgaacactgtaagaatatcgacccccgtacgcttcaacatctgtgcagcaactcactcgacacactccttattgtccagtaatacgtacgtagacggtttagtaaactccttttttttcactcgatgcaaattacaccatgctagcatgcatgatgcacatttgccatcatatacctgccctgccctctccatctaacctatatatatcatcagtcaaatatgtttaatttgctttgttttcttccatccatcaggggccaaagcctgcacctcctgtgtgcacctcaaagttaggcatcgtcaaatgagcagaagcagccgccctgttgttaggagccgcctggctgtagccgattagcgccgccgctgggttgtagaaatctacaatgcctgcagcttccttcagcatgctgctgttgttgccaccgtggccgccgccgccgacgccgtcgttatggtggtgttcagcagcagcattgctagccttgatgttgttaccggcgacgaggtcgacggagaggtccttggccgtcgctgccgagccgccgccgcactgcctcggctgcgtctggtagaacaccttggacacgacgagctcgccgtccttctcctcctcgtcggagcccaggtggtactggtgcatcacccagttggtcttctccggcttgcgctgcttgccgtagttggtgtagagcaccaggatcttcttgtaccccttcagcttgccgccggtgaacaccggccgcgtcttgccggtcttgtgccaccgcgtctcgccgccctgctcgtcggtgtgcaccttccgccgcttccgcgtccccgtcgtgtacgccttcgacgggcggtggaagaagtgccggatcaggccgtccttgccgactcctgaaattaacagcggcagaaagagaacagtacggttaatatggtagagtgccacactgccactgctctcacgaatgagttaagagatgcaaatgtaatcaattatattacgtgcatgcatgcaacagcaggtcagcaacacaacaagagtggcttcgtaatcgtagtatccagttgaccagttccaatgtcctgacggctgacggctgacgcagcataagaccattcagtcaaactatatgacgaatgggcccagttaatgatggttttgggccgactccagcaattctctgattctatctctctccccctgaactgttattgtttagttattttttgcgtcctttccatcataagaaaaatacttgctcggtgtttcaatacatattctctctgttccaaaaataaatttattttacactcatcccatatgtaccaatataaaacaaaaagacataccctcactttatcaaatcttaatgcaattattcctcattttacctacattccagtgcatctattatttactttcacaaactctagtgcaatgagtgttcaaaaataaatttattttaaaataaagggagagacaaaaataaacttattctgaggtagggagtattacactaccaactttattcgttcgtatagctttgactattttttttctattagtataacaataatgtgtaacaaaaatttagtattgtaaaagtacttaaaaaaactgctcttttgatttttattttcaaattaaatacatatttgagagatgttgatggttaaactttaaagtttcaccgaataaaattatatttaaagaggaggtgggggcgtatttgtgttttgcatctcttaacatagaaatgaaatttcccaggttgtaaaaaaaggaaaagattatgcatgttaactacaaccttaaacttttataaaagtgtgatagacaatcctagaatcttcatacattatttaaccataaactatcaaaaatagattactttttatacaacggactgaatttaaagtggtttagtggagatatggcgctgaagggtgaaactatctttgaatttaaagaattactcaccgataaacttcagaaaatccttatccacattatggagtacttataatataatgtagatagtagtggagccatgctgtgaccctgtaaggtcaattaaccccgatagaatttttgcaatcaagtactattagtaaaaaaaatatttgcatttcgcgcgaggtggatcttgatcttggctcagccactgaatctaggtaaatttggtgtaatataaataaaatgtatatatggctgaaaaatagtgtgcggaactaaataacacatttttatttgtcggcttaattattttcttacagatagaattaatttaggtcagctgtaatctatgaaatgtaaagaaaattactttgtaccatggaaggagcatcccctgcatgcacattgttttccagctcaacacgcatatgtctaacagactaccacaccaatattcccatgagaataccccacgaacggccgctagctccagcaccaacaaagaaaaaaaatgtttgcgttgtaaacgacataaagagccacttgcattggttttttaatcataattaattcttgctagataaaagtatttgtaatatatcattttctactggattaatatatagtacaatggtgacacgtggtttattattgatagctgcttatatgaaaatagagttccatgaaaataatatgatcagtgcactataatgtctcttggtgcaatatttctatcactatggtagaaaatagtacaagttatcctgtggaatggaatgcaacccccctgaagaatataatattatttttccaaaagcaggaaaggcactcataataatttaaagtatctgtcagttattcttaggccatgtttagattcaaaaatttttctttaaacttccaacttttccgtcacatcaaatgtttagacacatccatgtagcattaaatgtggatgaaaaaaaaccaattcacagtttgcatgtaaataacgagacgaatcttttgagcctaattatgccatgatttaacaatgtgatgctacagtaaacatttgctaataatgaattaattaggcttaataaaattgtctcgcagtttatagacggaatctgtaatttgttttgttattagtcttcgttaatacttcaaatgtaatttgttttgttattagtcttcgttaatactttaaatgtgtgtccgtatagttcaaaaaaaatttggcacacaaactaaacatagccttattgcacaaatatacaatgactatcctacccatgcaaatacaccattatatataggcaaattaaatactaggaatataaaaggataagggaaaaaccagttcatattgcaacaagtcttttcaaagtttattctccctttgatctgatgttgcgtgtatcctgcatgacgtggacctttgatgcactgtgctgtcacaatcactcgttttcaatgtgaaataaacttttatgcaagtaggagaagcaattacttcaaaggcaaactttagcaatatttatacggtatcgtgctcaaatgcaacaacacacgatcggacatacacgaaattaatgaaaaacgcaaggacgatcgacatgtatataccctagtgtggatgttacaaatactaagcggctacgcatgattgacatatatgaagcaaggtcatcaaattggaaacgaccagtaaaactttatatcaaaatagggaattttaaactgagaatcaaccaagcaagaaaatgttttgtcaggagtacttccgtgacggacagcacctatagtttccacgtcccgtccagatctgatcatctttgcaattgctatagctgatggcacaatgtaattaagcatgcaagctagctgatcgagacaaatgcacttatgtagatcatgaactgatgaaactaaaactgattcgatatatgtcgatgagtcgtaggaaaagcatgcatgtaagtatattatacgtgcctggaagcctctcgggatgggtgtagcagatgccgttctcgccctcgatggtggggatgaactcgtcgatgagggggtggagcttccgcgcgtcaggcctcgccttcccttccaggtgctccagcagctcctggtccgtcgggtcgaacttcaccccggccggcagccccggcaggtcctggatcgtcgccgccgccgctgcctgcaactgactctacaccatgctcaatgccatccaacatgtacacaggagaccgatcgatcgatcgagcagggaggaagctctagctagctacctgctcatactgcgcgcggtggccgcaggaggggcaggtcttgatgaggttgacgtgctgggagacctgctgctgctgctgctgcttcttggccgcggccacggcggcggcggtggccaggttgttctccacggcgcgcacgtcgttgaagctgttgcaccatgtcatggctgtataatccaacaagacgagagatcgtgcagagagagcgagccagaaagcctctctctctctctctccctgtccctccctccggcctacgctttgctcgtcgcccccatatgcggcaaacgttaaggcgagaccccgcgcgcgggaggagggagagagaaaggaggagaggagggaacaaagcggcctgatcgacgagagggagaacaaagagaaaagagaggggagctataggaagcttgtccctgttaaaagctactcctactagctgctaatcgcctaatcctccctgcctgccttcccggcccagctgctgcgcgcggctactgattttctatctccatctggtacagaccaaggaggagaatgaaggtggattctaaacactaatcagagtttgatttgttatttttgttacaacttatagaagttgaatttgaacttgcatatttgtggggtgatatattacatatgaatctatcttgtcaaatttttttgaatttttttcatacacatttagttgacatacaacaaatgggtgtatctacctaggtgattaaaagtgtttccggaggagaatacatcaattctcacaccaacttttcggttggcgcttcccaggaagatcgccacgagctgatctctctctctctctctctctctctctctctctctctctctctctctctctctggcgaggcaggcagaggcagaaccggcagtgcatcagctgtgtagtgcaggcaacaactacagaaagaacactccacaaaaggagcaagagactaggattagagagagatcgagctagctataggggacgtacgtgcaacagctagctaggagatcaaaatgaaaggcttaagcgatcgatgaacacgctgaacaatgagcgtttgacagctatgggcatggacagatatgtgtcatgagagtccgcttatcgaggtgtgcagcaacacgcgcggacgataaactgacaataaatcaactcatcaacctccatagctaattaagctaggcgaacagcgagagcgaatcatagaacgcaggggatcgatccgggcgaatgatgcggtgttgcttggacctcaagtctgggcttgctaatgcaaaccgtatacgtgagccgcaaaccaggcgccggattctctgcgcgcgagttgctgcgtgtacatctcccgatcgagatatggacgtccggccaccacacgtacacaccacaccaatttgacggttaacatttacacgtcagaaatgacaccggccggtgttaatatagcttagctgctgctatagcgctggtcgtacgtactactactatagtatagtccatggccaaaggcttgcgttgcaagaaagcacctacacttgcgattaaccggaagacccgtacaccaaacgcatatgaaatgcatgacgaagcgattggtcgaggagaaggttgcgcgaaatgcgtgtactttggctggggtttaaattaaaggcggcaggatgacctacattctcctccgcgcgcgcgagaccccggctggtacggtgcgcgcagggtgtgcgtgcgtgcatgtacgtgcaggtagccgctgcgaaatacgtatacgcacacatatactaaccactgttcatcgtttcaacacggttagctagctctatagctatccaatcagttggtaaacaaactatacacgtacactttgattaatattattccattcgatctgtgatttatggtgtgtatgacgttcgatcgatataactctatcaaactgggggattgcgaataccctaagctatttcgcaatagaatacagatgagagaggagagggttgggggaaaaggcaaaggagggacagagaggaggtagctagatgcatgagagagagggaattagaccggctggccaaaagcgtacgtgtggagaagggggaggaggaggaggagggtggagtggagatggggcaacctgattcgatcgcgaggacgtcccaccacaccacaccacaccacaccgccccacctgcaacacgcacaacaccctactacttggcagcacgattgatcgcctgtcagtcagtcgtctctcgcggatggatcgagtcgcggggggtggcggctgggctggctgcggtgtgcgcgcgcgtgcgtgaccgcgtgagatggggatggatttgggagagagagggacttttagatatgaggtcaccgtagagtgtcttggaagagagaaatgatgatagtagtgtatagagcccagcccccagcgacaaaaggactcctgaacgaccgagccgggggggcgcgcgcgtacgtcgtcgatccaccggtcgagacgaggcgcgtccgcgcgtgtattgatccgtcccgtacgttgatcgatctgggcgtttgggggccatgtgcagatgcgtcgtggcgtgcgtgaacatgcgcacctgcgggatttggaccggtcgatctaagtttgagggcgtggatttgggaccattgatcttcggcgtatcggtccggccggtcgcgatgagctaagcgatacgtcatgcccctggatcagattgacaggaatcagagattagttaattaagtataatactccctccatactcgtaaagacagtgacacggtttccaaaatacaactttgacttcttatttctataaaaatatttattgaaaagtgatatatgtatacttttatgaaagtatttttcaagacaaatctatatatataatttttacatttttaaactcaacaacttaagagttattcataatttatattttcaaggtttgacttaaacattgttctaaaagacttcctttatgagtatggagggagtataagtagtactaggcactactccctccgtttccaattaatcatcgtattataggagcgcaccaagatcaaaaaaaaaaagaaaaatccataactctcatatacttatatttactttggtaacaaactcgatgcatgtggacaattctcactattttctaactaataacaaaccaagacatcactttggttgtaaaatattatgtgcagggatacatgcaccaatattcatttactcccatacacagataacgaatagacttatgtaatgataataatatgatgatcacttgggaataaccccaaaaaagttagatgatgatcaattgggaatagagggagtatattataagacgttttggcatttccatcgctcgtttagatccactaacatctatacgaatttggacacatatatgaagcacatatatggatccatgcataactatattcaaaatccaaacatcttataatgtgaaacaaatgaagtaggtgagaattaacaagggtatttaaggtatagcattatactcccaaacattgccacacctccttacaaaacctagccaaaggtgtggtcataaattgatggccacacctcttagacaaggtttggctaaaagatgggtgtaagacatgtgggcctttgaattgaaaaactatggtatgccataactttgatagtgaaacaaatatactccatatgtaccatatatggcaattttgtactggatgagacatcctaaaactacgaatctggacaggggcatgtccagattcgtagttataagatgtgtcacatccagcacgcccctatccaaattcatagttatagaatgcgtcatatctgacactagattgctatattaattatgggacggaagtggtatatcctagaaagggtggtgaagtttggcaaaataagggagtgacccaaacaaccacaagcataacttcaggctgattacaacgtgttagtcgccaacccttgaggatattatatggactataattactggtattttaagattgaaattcaaatattatgttaaatgtatgatcactcagatttaaatgtcttttaaaggatgtttctactttaaaagtttctatatatataccttgtgtatataaacttaattaagaaaaaaataaaaccgtgtgagcggaaaaaaatagaagtagggtgtttgcgaggggtcattagacttctctctcaaagtgtctaattagtaaagaatagatagatagatagatagatagatagatagatagatgtagatgagtacatggttaggctaccttttagcatagtcgacatgtgtcaaattagtacaccagatggggcaatagatgggagaatgtatattttattttgaaagtttaatgttgtatggtttgatcaataataagccagattggtgcatttagtgtattaaaaagtaccttgaattgctttagtttcagaaaaagtaccttgaatatgttttacttaatggtcaaagtttaaactttaatactttttagaaaataatatacagcctacgaaaaaataatttaacaccctttcctcaaccccccccaaaaaaaaccaaaaaaaagaacagttgaggtatattattcgttttcttcaacgagatttgcaacctatttctacacaccaataatattatttttcacatgtattttctccatgcatatttggttgaagaaaaaaaagtttaatctgagtatataatctcattgtgcttctcaggagggcatataaaaagcacaaagtgtgcacgtatctgcttctccctcgaagagttaaaaataactggtccatatgtatcttgacatgcaagcgtctccctattgttcgactgtgacaatctttgcgttagactacaacaaatatacgcgtcgtcgattagttggagaggtatatgcgtcgttggtaagtagtgtaatctaatcaggtactccactgctactaatactatttaatttaacttgtagggcaagtctcaccatctatagctagctccgtcatgttgaaaaacggaggcagtacttcgatccgagagaatcggaattatgttggagtttgacattttaccacactttttcaacagatgggtatgaaaatgcacaaagacttcaaggatgcaatcacttctccaacttgctctctgactctaccatgcgccttaaattttcgcagaaagctagaaaaaggcacgtttttttttctcatttctcttgatatttcagagtacttttctcaacatcaaggaatgaatgaacgatcggtatgaaatgaacattggcagtcaaagatattactagtaatttctcagtgacagtctctcatattttattcgagagaattttaacccccaaaaaaaatctagagagcagttaattactacgaatacagggattgcttttgtaggactttcatgtgatttggtacatgatggacaacgacatatatcgaccattggcgattagatgttgcttcgtgtgacactgacactggacttgcttctgatgcattccatatatcgcacgatagagtacatgtacctaactgaacctgatgtatccatgtgagtgataccacctctagctaagctaccacgaagaactgaactcgcctagtgaagccaagagacaagacaaatgttacttacactgaagctttttcagaggataaaaacagttaattaaggggcgtcacacgcacaccaaggcaattcggtatgcagatatacaaagctctgacctttactagatcattggctacaactaaagctccgggcatgatcatgccatgatatgtgcaaatttaaagggatggaaagaaggaatcacatgattaaagccgtatgctgtcgcctctgatgatcggcagcttttaatttacaatgttccccagactcctggtagcagtagcacactgtcgcctcatgtcttgagaattgcagatgcagcttggttatcactcagagatcagctaggaggaccactgcatacatgcaggaggatttgtctcaaggaaagtgttttacttggaggagcctaaactgttttgttccaatggtctttatgtggtcgcctaggtgaggcaagcatgcatgcaggtttgtctctactctcaaatgctgttgttctgttctcaaaaaagaaaaaagaagtgctgttgttctgaagattgtcgaggatgatcgatgttctctttgcaggctttgcagccttatattgggctgggctttgcatctatgagtttggatcagcccatttttgcctctgacatatgcatggctcggtggatccacatctatgagcaaggcattgtagttcttcataccagatgaaaagaatcaaaccaaatgcataatccagttaagcacggctaggagggaacatctatttacgtgtatatataactgccacagaacaattttagacccaaaaaactgttctttccgttaccaatgtgcgtctacaactgttggagctcaaaaaagagaaactggaacaccaaacattctcgcatttcttgccagcagaactcccagttcatttaatttttgcatctttcttgcaagaaggcatccataaacggacaacaaacagaaacagagtaacagaccattaccttccttcccttcaaatcccttccttttccattgataaaatccctagttgcgtctcctctaacaaaagatcaccaacgctaaatagaacgaactggacgaagaggacagctactatgtctgctccacaccaccgtcaccacaacatggaattgctggcaggatcagaggaatcctcttttgttgaatatatttgatcgtaccagcaacatgagcccatgcagaaaacaatcgcccagacataagaacatcaaatttcttccttcagacactgtccctgtcttccaattcctggctccaaccttggcaacggcagcacaaggcccctgcagtgacaatgttacattcatcaaatggtaacatgatggttctttgtgcgttgccctgctttgttctcagtttcacagatagcttcagggataaggaagggaatgcgcgctataggtttgtcgcattcaagggattgtggggtcatcgacaatcaagcacctcttgatccacacgttgtagttgaatgaatacaatttctagactttgtccattgaactgtttcagcaatgacttttgtttctatagcgctgttagaccaaaatgtggtgtcttgcttcaatccaataccgtaagagtaagcaaagaaagttctcataatattgctgactattatagtggttattggcagaatgcagtttgtcagcttcccagccacccaccatgacattggctttccactctccacaacagtctggtaatcaaagatcttgctcgctcaaattcatgttgattgatcaaacaggtgtaatcccctcaacatagacagaaaaacatacagtagcatgtatctcaatacttgatattttggctgttgactttttctcatggttatactcctagccaatagaatgaagatccataattccatattttgcgatgctgtttagcctgttccattaagtgaattcatagattaagcatgttagacatgtcataagcagaggattcactatgacaattaagcagcataaactctaaagaaagctatcagaacaaaagtacagtgaatttcttttggaaaacaaggttattatatgcaagtggaaagtaataaacatatttgatttaatctttatggagggaaccgatggaaaacatcactagaaactgtgcatttccagggaggttcacattgtagagattttcttttgccgtgcaataaacctgaacaattgatatgctactcagcagtccataagaaaatgaaagaaaaatgaatagaataaaatcgacatatgaaaatatgaaacagtgcaataacctagctaacatttcactttcccaataaatctacctaacattggttgtacaatatgtcaataattacatttgacttaactgcctagcttgctatgcaatagtttgagctacaggttttgatcatttatcaccaaactccacatatatgaacaattaaagttaatgcttagtatatttacgtatgtactccctccggtttcattttaattgacgctttggacaatgacacgctctacaagatatacctttgaccttatttttctattataatatatacaataaataaatgcatgtttacttttattatagtgttttgaaagacaaatctatatatgtttttctagtttctttaaactaaatatttttaaagttattgatggtcaaagttataaaaatttaacctcaaccatgtccaaaacatcaattaatatagaaccggagggagtaatgaacaagatgtatgggactatggaaaacaacatcgcaccatacctgaacactgccaactgctcgtaacttcaaaaaaaaacagatatcattacataacctggaaaagtgaacaccaaaatgtaagatctatcgacaacaaatctcccacttgtgtaacagcatagaaagagtaagaagtatatgacctctgagcacaatgtttgcttggcaacagctcgcgcatacgatgtatcagtggagtgtagtctgtacctttatttcaatttgaaacggttaactggctccacatttcctcagcttcttgtcttacctttttcttactccaatatgcacgtacaatcgtatcccatgtttccctctcagggatgcatctctctgataacatgtcacgcacaacatgagcagctttctctaaattgttctttttcgataagcactcgacaaggagatggaaagttgttggcttggtagaaattccacgggtacgcatgctctggtacacctgaaaagcccttacaacttcacccttagaacacagtgctgtcaccactgcatcatttatcctgccatgcaggctccaagtcaagcggtttggtcggatgccagcaaaattcatctcatcgaggtaatttgaagcctccaaagcccttcctgcatcacatagcccaacaattagcttaccgaacaacccagcatcaggcttcctcccctggagacgcatccggtctaaaatctccatggcctgacccagacagccctccttacagagcccatcaataacagaactgtatgtgattgtatttggaagcttcctctccttaaccatcctgtccagcagctccactgctgaggcggcacgcccacccttgcacaatccatcgatcagtgaactgtatgttaccacattcggcatgatccctctcctagccatttcatcgaacagtttcagagcatcatcaaagcaagcctcccgcgcgagccagtggataagagtggtgtaagtaaccaccgttggtgcagtgccattcgcaatcatctccgcgaacaggtcgcgggcctccggcagccggccgcggcggcagagcccatcgatcacagtattgtaggagcacgcgtcgggtttggggatgttccgaaaaacgcgaacggcgtcgtcgatggggacggcggcgtcggagcagtgggccttgacgaggacattgtaggtggcggtggtgggggcaaagccggcggcgcgcatgtcggcgaggagggagcgggccagggagaggtgggagtgagcgacgagggcggcgaggaccgcggtgtatgagcgggcggagtgcgggaggccgagggcggagggcgcggagcggaagaggtggagcgcggcgaggggctggtgggcgcgggagtaggcgcggaggagggagaggaacgggggctcgagctcgccgggcgaggggaagagctcgcgcgagcgggagaggagggaggatgcgagcgggaggaggctggcggaggcgaggcgggacgtgaggagggagacggtgtcgcgcgacgggaggacgggcgcggcggcggcggccgtggaatcgtcgggcggggacgcggacgagggcctggcggtggccgcgtcgaagagcgccagggcccggcgcgggtcacgctccgcgcggaccaggcggtggaggtggtcggcggtgagggtcttgggccatctggtcgccgagggggtggccggcggcattgggctgcggcggcggcggcgggatgggcaaagcctgcgtgtacgaggcgggacagaggtgttcggcggaatgctgccctgccctggcaacacgaggacctctagcaagtgcgcgcagttgcgtgaccgaacatttgtcgggccggccaaatgtcaaagaaaaggatgggcctatttcggccatagctgaaaattaattagggcctgcttgggaattaaggacctttctcgaccggaataagttcaccagaggtccctcaacttaacagcgagacttttgagatcccctaaccacaaaaccagaaatttccacccctaaactttacgaaaccgtgtaaaaaaggtcccagggcagtatggatctctagtttcgctgatgtggcatcctagttagcaaaaaaaaataaaaaaaattatagggccacatgtaagtgagaagaaaaaaatgtgggacccacacttctttttggttttcttttctcttttctttctcctcttctcttctcttctccggaagccgccggcggtagagggagcctgggagagagggggcaggggtgggcgaagtggccactggcgagcgcggcagtgggcggctggagaggggggaagaggtggccggtgagcctgcgagggaggagaggggggcggcggtgggtggagcagcaccgggagagaagagagagggggtcgcgccggccgagcttcacttgcgagctcgtcggcggcaatggcgtccctccgcgcgct

SEQ ID NO: 12556 - DNA, 5741 bp, Oryza sativa
  unsure (1)..(5741): unsure at all n locations
cccctgttggtgttgctgatgctaatgcggcttcctccgccgcctccccgcctgcaccaccatctggggcagctccacgccgtggtcccgcacccacagcgacgtcgtccgcagcgccctcgctgcgcactgccccagctcctctcccttcccttccccgtctttcccgccgtcaaagcagcacaagaggcacccaaggcggcgacgtcgcctccctccgagcggcagcggcgaccttgtctccctccgttcttgcccgtcgccaccctgcccgccggcctttcaggctcgggggaagaagagaagaggagaagagagaacaaagaaaagagaagaagaaaaaaaaagaaaaagaaaagaggagaaaagggcgctgatatgtgggttccaccatatgccacgtcagctaaacgggggaaaattagatcagtactgtttagggacttttttttgcacggttttgtatagtttaggaatggagatttctgattttgtggttaagggatctcaaaaatctcgctgttaagttgataaaccttcggtgaacttattccttctcgacctggtaaaagaaataaaagcccgtaactttcggccacctaaagtaccggagaatatattcaatacccttcctgttcgggagaaaaaattggtagaaataacttatcggagcaatttgggacttcgaagtagacaaatagatagataaaaaaactatgatgaataatcaaaaataacatcaaactcaccaacagatgttcatgtaatgttccacatgttttcacgtaaatcttcattgtagttcgtaaagcaatgtctcggtgcttcttcgtttgtacttatatttcaccggtaattaggaatgcagtttttataggcgatatataccgagaacaaaatggatatccttaaaaaaacaaatggaactgatagatctcgatataaaaagtcacctaataaatctatctattatattattaaaacagctttaaaaggagacatcacgttcgctgtgggagctagaaattctcatattaatcggagaaaaagaaaaaaagaaaagaagagtccaagtagaaatacaatctaaaaatagctgaaattcggaattaaaaataagcaatattgaaagaagtttctatataacaacccaatacgagattaatacaaattcgaaataaaaataaaataaaatccaaaattataaaataaaaggaagtccaagtaggaatacaatttaaaaatagctgaaattcagaattaaaaataaggaatattgagagaagagtccatataataacccaatacgagattagttaatattcggaataaaaataaaaaaaattcgaaattagcaaaaagaaaaaaagttaaaataggaatacaatttaaaatcaactgaaatacgaaattaaaaataagtaatagtgaaagaagaatcaatataagaaaccaatatgagattaattaaaattcagaataaaaaataaaaaatatccaaaattaataaaaaaataaaagagagttcaactgaaattcaaaaaataaaaaaaaataaaagtattaaaaacactatacggtattaattaaaaaaatttaaattagaaaaagaaaaaaagatttcaattaggaatagtggtggcagttgatacaatatataaaaactgttagtaaaacaccaaatagaatcctaatgatgattaaaaggagggacgagcaagacggttgccgggacttctagaaagtaaaaaaaaaacccaattgataaacatattcgatttttaaaatctcaatgagaataaaggagaagcagcatgcggggtgtataggagtatagttgcagagccgccaacggttagcgggacttttagaaaagaaaaaataaattccaacgatagttatgttcgattttagaatcctgatgaaaataaagaataggcggcggatgggccgtagaggtgtatagtggcatcgtttgacgggacttctgaaactataaaaaatgaaacccaacaagacaataaactctaaaaactacaaggtccaatttttaaaggttcggaacttctaaaaagtaaaaataaaacaatgataatcatgatgcattttaaaatctcaagggaggcagcgggcgagccataaaggagtacaatggcaaacccgctgacggtttggcgggacttatagaaagtaaaaaaaataaacccgaacgataattatgttcgatttgtaaaatcccaatgataataaagagaaaagagagtggacgggccttagaggagtataatggcagcgtttgacgggacttctagaaattataaaaacgaaacccaacgagataataaactcaaaaagctataagatccaattttaagaggtttcaaggagaatgaatagaaatagtggtagaccgaggaaacaaaagaaggatatgacagaagtaaggggtagcagctggtgtgacttttcaaaactatataattagaaatacgaggataactatttaataaatcttaagtaaaatcatactgaaaaatatatgattttgtttgggtgctagccgcgcaattgcgcgggccaaaaggaggcactacgttcgttgtgggggttagaaattcccacattaatcagagaaaaagaaaaaaaagaaaaggagagtcatacaatttaaaaaaaagctgaaactcagaattaaaaataagcaatattgaaagaagtttccatataagaacccaatacgagattaatcaaaattcaaaataaaaataaaataaaatccaaaattagaaaaggaaaggagagtccaaataggaatacaatttaaaaatagctgaaattcggaattaaaaataagaaatattaaaagaagagtccatataagaacctaatacgtgattaattaaaattcggaataaaaataaaaataaatccgaaattagcaaaagaaaataaaagaagaactcaagtaggaatacaatttaaaattacctgaaattcggaattaaaaattagcaatattgaaagaagaatatatataagaacccaatacgagataaaaaaaataaaataatatcaaaaattagaaaaatcaaaataataaaataatatcaaaaattaaaaaaaaatcaaaagagagttcaagtcgaaatacaattttgaaacaactgaaaatggaaattaaaaattaaaacattaaaagaacacaatacggtcttaactattttttaaaaaaaaataaattctgaaattagaaaaagaaaaataagatttcaattaggaatacaagttataaataactaaaattaggaataaaaataaagattattgaaagaaaagaccatctaaaacgtataacgagaaaattaagtaacatgccctataaaggagtagagtggtggcggttgatacgacatataaaagttgttaataaaacaccaaatagaatcctaatgacgattaaaaggagggactttaggcagaccgtgaagcaaacaagtaaggcggttgctgggacttctacaaagtaaaaaaaaacaccattgataatcatattcgatttttaaaatctcaatgacaataaaaaggagaagcagcgggcggggtgtataagagtatagttgtagagccgccggcggttgacgggacttctagaaaattaaaaatgaattccaacgatagttatgttcgatttttagaatcacaatgacaataaagagtaggtgacggatgggctgtagaggggcaaataaagagtaggtgacggatggactgtagaggggcatagtggcatcatttgatggcacttctaaaaattataaaaaatgaaactataagtccaatttttaaaggttcagaacttctaaaaagtaaaaaaaaacaatgataatcatggttcgattttaaaaatctcaatgataataaagaagggaggcagcgggcgagccgtagaggagtacaatggcaaagccactgatggtttggcaggacttctagaaagtaaaaatgaacccaaacgataattatgttcgattttttaaatctcaatgacaataaagagaagagacagtggacgggccgtagaggagtataatggcaacgtttgatggggggcatctagaaattataaaaagaaacccaacatgacaataaactctaaaaactataaaatccaatttttaaaggttccaagaagaataaataaaaatagtgatagatcgagcaagcaaataaataacgagataacataaggggtagcaactggtgtgattttaaaactatataattaggaacaataggatgataaggtttggtctttcaaaatcttaagacaatgagatagctatttaataaattttaagtaaaatcgtactaaaagatatgattttgtttgggtgctagccgcgcaattgcgcgagccacccagctagttactcctaaatgaaagaggaaaataaatgcgggagggataataagaaacatgaaactgacaagaaccaagaagtagcgtatataaaacattaaaaaagcacgaaaaatagttctcatcttgctgtcaatgacttaagaaaaagggaaatatttgaattgtccttttttttaataatggaagttttattcagactcagttaattacaccaagatgatacaacgaagcccatacctagcctatgcatataatgcacaaatcccaaagaaaagatagaaacaaccaaacctcttacaagcacaaaagtttaacaaaaacataggtcttagtggctatcaattcgtagactatacctcttaaactaatgaggtagtctaatttatctctgtcatggttatggataagacatacctcctgtcctacgacttgcggtataccttcgtgcatacgatgtactttcttatgtgataaggaaatctacaagatatcatggaaaatatcctcatgggcaagtgattactagagtcctactcggagaggattgggtttattcgttgtctcagagttctacttggagactgaggtaattcacggtataaaaggcacaccccctaaggggtttagatcatcgaatcatagcgccaacacatccaccatagtctacggagctggaggacgcaaaacctactcacccgagatctcgtcgaatcatctcgacaaggatctcgctggtaacaccgaattcatctgttctctttgtactctgtggttttccatatcaatctcatataaactagattggggctattacattacgaggggcctgaaccagcataatctctatattcttgtttgcttgacgtcgtatcgtgtagatcctcgtaccaacgtaccccaataccctatttatccggtctaggggtatcccacgtcgacaatcccctcaattcaaataccaaagattttgtgcctcaaaatctttcaaacccgatgagttacacccctcaacctaagaggggttttggtcctagctggtgtacatgtggcattaatctgattatgtggcaatctagtcaataatattattaaaaatataaaaaaataattattcacccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12557 - DNA, 1709 bp, Oryza sativa
ttgatggaggtggaggcggacggagcgttcgctccgttcgtcgttttttcttataaacttggtcagtattttctctggcggctggtatagtgtaaccgtcagaaaaaaaaacattttcgctggctgccgtcttaaaccagtcgccagcgaaaatggatttttgctgacggctggcttaaggcggccgccagcgaaaatgttttttcgcttgtggtcgataaccgctagcgaagatcttgattttcactggcctttgctttgtggcggctccaaattccgccagcgaaaacccaaaatagccaccacgaaagatggttttcgtagtagtggtagcggtacaataacttggctggctaggtgggtgcactcatggtgcaaaagtagccacgtaaaagaaattgccaccttactattccaccttagcaaaattgccacatcagctttgacatgaaagaactatctcatttcatagaaaacccctaatagcttttttttttccaatcacattcctttttaactcaataaacaaaacaaacgtatgcatatcttcttccatctttcttgacgtgatcctaattgagaggtagctgcggtggtggcggtggcggtggccgcgacagcaacgacaacgagcgaaaccattacatcgcggtggcgatgagggctccgtgtgtcacattagttcaatccctaaaccaataaccaaaccaattcaagtcgataaattgctgctgtcgacgtgatcgccgcaagctttgggatagctccgactcgacgagtttttggagcatatgctcctagcttgttatggtaaatcacttgctgatggttgtagacttctattttttgttcatttgatggatgattgcaaagtaaaggtttcattgatctatacaatggctgtattttttttgggttttcacttgaatatcatattatttgttattacaattcaatgaagtgatctaatggtactagccacgagattggttgcactaaaattattggtgtttcctgtagctgtatacgatataagagtaacattggcaatgagaaattcttgctagatgtgttgtaccattatcagcagcatatagttagttggataatctgcaaataatcttagtgtattattttccttatgcggtatatcacatcaaccaattattttgtagtgcaggccatgagaaagaagaattcacaattgaactgcatcatggtgggtttttctttttttggagttggcagtagtagaatttatttggatgagaagatggactggtttgatcattgcgacacgaggaaaacagatacatctaaaaaagaagtaattgaaatataaaagttactagggacttttctgtaaaatgataaggtcaatgctcatgtgtcactttcgctgaggtggaacaatggcgtggcaacttttgcaccatgagcgcacccacctagccaagttattgtactgctatactcggcttttaagtttttgcacctaattgtatccacctgccaagttcttatacagccaacgcaaattactcatatcaaaatgtgcgtgggaagtgttcgactccggtccaatccatgatgcatgaggtagatgagtgcgtatgtcacacaaattaggggctagttggccacataatcacatatccgaagcgcgaaatgcacacgctttatccgatatcaaaccaactgtaacagat

SEQ ID NO: 12558 - DNA, 17426 bp, Oryza sativa
ggactcccttaagttggattcaacggggaagccggcgggcggcgtggcaaagccggcttgggtcagctacctggcggaggtggttggtgctgtggcagtcttgtcgttggcaagactggaagccggccggcggtggggcgtcggttgggtgtggtggaagccatgtgccgccgatgtttaaatggtggtttcggattgggcaacggaccatggcggtagggggtaccgagcgaaagcttagcccaacctttgggccaacagtgactacgctttcgggtcgctttcgggtgtggtaaccctcctgagggcatggttgaggtacccctcctcccttggcaaggagctctgggtgaaaaccttgttccgtttttgggacggatgacgacggcgtcttttggcgtcgcgaccttcctgagggcgtcgttttagagtcttcgcgtcgtggtggtgttgttggcccggtggcgatcggtctcgcatagcgacggccggttcggtgctcggctcccctctctgtagcgtgtgtttgcggttggcacttggttcggggcgtgtgctctagtgcacatccttcctcgacaaccagctatcgatgtaaaaccttttcttgtaaccttttcttccaatcttaattgaatgacctccttcggtctttccggcgaaaaaaaagtggccaacacgacaagttagcaacacccagcacctgaccgccgagagtttccgcactccgctcgcctgcgcggtgcaccggtgacactgtaccgaaccctgcgcaacccaatcacgtaagctcaactaaatttggcccaaccaaatgctcgctgctagtactagtacaagcgataggggggtctagaatgctcgctgtccatatattagatagataaactggtgagattttacagtcgacggcttgctgctcagcacttgcgctatatagaaagagaagtaatcaacattacagagaaaaaaacgtgcagattggtggcaggacacatattagttcatccagcaaaactttagactgtcacagacaacaaacgctatgtcacacaatgtatgtatagctccctctttgggatgtggacagcggacgtacagggttactatcagatactgcccaatgcaaaaactacaccagtacagaaaaattacagtggaacgcatacatctgcatatgaaaaaaatcgtcacactgaaaagaatcgaatccgacagatttatatagcaggaaaggtggtgctggtgatggctgtgttgaagatggcttatctgctgattcggtagaaggtgcaccattgtaacggtgatattagaatcaagatcacttgtcgcgtccgtcatcaccggtgctgctattttctcggcattgtctgctgcttctagctataccctctaagtgtttcagcaggagcaccttcaaatgtaggagctccagaggttccttgagtcagggagtgccctgcattatcgggtgccttgaatcataggagtgccatgggccattggagaaccttagcttctacctatccatcattgacccatcgatcagtcctcagcttcaggggtactatattgctaggcaggccaagttttcgcaccagatcttttaattgcaacaggaggtgcagatagaggaggccgaaaaacactgcagcagcatcagttccttaacagttggtgcgtgatccagctccttctgtagcatcttattccgcgttatgactaaattcctcaatgatagacgaccatgggctgaaaagtgaaagatcctttgtaagtgcttgataatacatatatttgagcacatttagtcaaataacaaatgaattctttagggcaacaacaacaacgaacagattgaataaaaaacacttaatggtttggctaaactcatgagagaggattggaaaatatgcaaatccttctctctctctctctctctctctctctctctctctctctctctctctctcttaaagaaatcaatgcacatcctctgtatttctaacaggttcatggttcattggtctgctcaagccatacgccctaaaataagtctaagcacatattcctattgacattttactgatcatgctatagcttgcttaaacatacataatcgaaatatgaataaagacagtgtatagcacataacttatgagatgcaaacaaggaaacataaggttttatcatgtgcatgcatgaacaatttgccactccatattccacaaaatgtgatcaaactggagaaggaaattacagacacttgtgtgtggtacaactctctaataatgacacttttgcagacgagatcatgtgggtgagaacttaatttctttatcacaaaaacagtcattgacaagaaccaaaattcttaatggaaacatccaaatcttttgaggaagtagcaacgctaattaaggaagacctagacttacggacttttgccttcaagcctccctaatttcctttctttctttccctccgatgtatccttaagttgtattctccccctgatctaagcccctttaaaacgttgtaacaactcttttttgccctttttccttctaatataaccggcagccctcctgtcctctaccgtttcaaaaaataatagaaacttactactgataaattttggtcaaagtaacataccgacagcctagtaagttcatggtttccaacatggagtgccagacctcgtagaatttctccatgtaaaagcacgctttatagaagtcgcagcagccaatctcagcaatgctagcctgtctggtggactctgtggcatcgataaagtctgaaaattcgttgacaaacttcaagatcgatcccttgcatgccatctgccatactttcttgcttagctactggtaaattaagggtgtgtttagttgggaaaaaggaaatttttaggtgtcacatcggacgtttgaccggatgtccgaaggggttttcggacacgaatgaaaaaactaatttcaaaacttgcctggaaaccgcgagacgaatcttttgagactaattaagccgttattagcacatgtgggttactgtagtatttatggctaatcacggactaattaggcttaaaagattcgtctcacgatttcccctatgactgtgcaattagtttttctttttatctatatttaatgcttcatgtatatgtccaaagattcgatgtgatgtttttggaaaaaaaatttagggaactaaacgggcccttaagaaagtgtgtaacatcggtagcagtagtttcttgtcccacatcctggcaatggtcattgtcaaaagcatgcaagtgtccttttcaagtcatttagtactttgcagggtgagattgaactccaacctgaggaatatcagcagaagtttgaattcatgaagaaacacagaatagtttctgtcaatatcaaccagtacacgtaatttcacaatacagtttaaatagaagcatatcaacataaagcaactgagaaataatatgcacctggggatgaaaacggagcggatacggacggataatgctcataccatattcgttttcatattttttttaccggatacaaaaacgaatacggataactcgaatacggatagctcgaatacggaaacaaatacggattatctcgaatacaaataagaatcgaatatgatcggacacgaatacggaaacaaatttttctcggaacacgaaaaccaactcaacttctaatagaaacaaatatcaacatatataattagctcattttatataaaataaggtataatttataaatattttttaaaatttaaataatattaatagtatggactagtgttaagagataaactactattaaaatctataaaggtatattgaaggttatagagttagaaagaaatggggtatatctcatgggtcctgcggatattcgaatagcactgttcaccggatatccgaattattatccgtatccgacggaaaccctgataccatattcgtattcgtatccgagagaaaatatccatattcgtatccgtatccgaaatatccgagaattatccgatccgaaaggtatccgtatccgtttttgtccggagcggacggaaactatccgctccgttttcatccctatatgcacctcttggatattccaggtaaatgatgaaatgcttcaacagcatatccattcccagcataaacttagttaggtcatcggtgctcacgaccaagtctagtggccctgcataattagttttgggagtattacatatttacgtctcgcactaaaaaatgtcaacaagatgcaatgttctaagaataaacatataccattcgcgacactaactggattgacatatcctgcaaggcaccgacatcctataccaggatggctgaggataaggcatgtgcgcacatatacctacaaaaagggagtgtcaacagttacaacccgatgtaattcaagataaccataagaaaaaggtaacacccctttttcttctttgcaaactttattccataagaattcgttcatgaaatgagataattaaaagttacacacttacctgtcaacaagtcagagaactccatctctgacactgacaccaatcacaacaagggatacaattggtcatttcagctcaaggggaggtggcttactgtaacagatacccctcctccagcagcagcaactctagcatatcttctatcatccatttattttctgaaacacgcccggcgattcttttttttcttgaaacactggatctccgcaatctgaaacattgccaatgaggtggtctaagatgaaagtttggtaaaaataacttacccaatgtgcaatttaatataccaaagagagaatgggttaaccagcttgattttgactaataagtaaataatgacataaaagctataatagaatttttgcaaaagggcgatatgagactacaggtcacataagtaatattgcacaacaagaccacatcgatcacattgcatcaaccaacaaaaaaatcaaagatattcaggaagcacgaagcccttacatggatatctcaaaggcaacaaacacacctatacatgtataactggaaattctaagatgacctttatttggaggaaaatggatcatctgaagcaaatgatgacccacttcccccaaaacctgataaaggatatagctgttgtgaactgattctacaagatttagggtgtgtgctaagcaaagcacgtccaatgcaatctaattatctgcacgatcacaaccataaataccattttattgaagcaaagcagtactgagtaccgacaatagcatgcttaactagttaactggagaagataatattctactgctgaacaagctgaaaaattaggtctccaacacactgatcaaccaactaaatgctcaaaggtgaaagcaaagaacaacttatccgtacctgttggagccgtcgcaagaatccgtgcgccacttcagtgatctccgatttctgccgccgcgttcttgatccagccgtattcgccaagaaccccgcttctatctccgacttcggcggggtgattcttcatctccgatcttcggaaccgccttcttggcctctggtcgcgttcttgaggttgccccgccaggacctcgtgcgctccgaaacttctcgccgttcttgttgtactcgtgcattcttggattccggccgccttcttgccgccgatatgaacccttggacgccttctttgtcgtcgtggtcccgtcgatgctggggccgccgccgtcgaagaagccgtcgccgtggacgttgggggcgccgccgtcaccgtggacgctggggccgccgccgccgtggacgctggggccgccaccgtcgccaagaagcagtcgccgtggacgctggggccgccgccgtcgccaagaagccctcgccgtggacgctgcggccgccgccgtcgccaagaagccatcgccgtggacgctggggccgccgtcgtcgccaagaagccgtcgcggtggctgcctctccccgaaccggctggtcaccatcttcgcctcttgggtcggcagttcgacccgcgttgttgacgcatatgctatctcacggcctcaacacgtaaaaggaagtacagaattgggttcacatagtccgacccatcaaacgacacaatgttcaagcgtccaaccacgaaccaagaaacacaagaaaattccacggcaccgacgatcggcgctcagcgctgacactcattgagcgaaatgtgaacatgtaggtcctcgctgagcagggaacctgttaccgcaattgcggcaaacgaatggcaagatcagacgatggtgctctaaacgatagtggcgccacatgtcatccctcgtgaggcgtggtactgtcaccgtctcatcgtcgtcagaaagaacacacaccctgcacaagaatcggtgaccacgagcccacagagaaagcaccggtggtgctggtgccccagcctggatttttcacattttggtccttttaaaaaacttatttcgcaaatagacccctagaaaaacttatcctaaaaatggtcctttttggggcgccagagtggctggcgccgtcgtccaacaggacagtgccagcctctctggcgccgtccccctgccgacgtggcggggcgatgctgaggtggctagggagtgcgccagagtggctggcgcccccccccccgaaattttttatttttgttttatttgtttgatatttttttcacgcttagggacacataaaaaccaaccatagaaaaattgaactcaaatggacgtaatatgtgacctgtagaatttttcctctcctctcctctctctccgaactagtgcaaaggagagatgtgcaacttttttatttttattttattttttgatatttttttcacacttaggaactcacaggaatcaaccatgtaaaaaataaactcaaacggacgaaatatgtggtatgtggaattttccaaagttctaccgaaaaacttctctcctcgaaaacacaatcttgcaagcggaatttggaggttttaatatcgccgaacccggcaaagctagagagaatcggatgtaacattttctatagatgtccgtgcatatattatttgcctgattccgagtccgtatgagaaagttacgcctattttattagatgacatattttgtccgtttcggtagagttttggaaaattctacaagtcacatattttgtccgtttaagtttattttttatacggttggttcctatgttctcctaagtgtgaaaaaaatatcaaaaaaatgaaataaaaataaaaaaaattacatctctatgtactgtttaacttatatatgtcatttcatgtggttatattttgaattagattaagtaatttcatatagtggtagagtgcattatgtttaacatgctgatcaaagggttttactaaaggaattatggtctaattttagtgaaggtgcaaagtagactgagtggtatgctagctattttcagacttagttaagtggtagttcgagtttaaattttttttgtggttggttgtatcgtgatcctaagtgtgaaaaaacatccgaaaaaataaaataaaaatgacaccgttgcaacttcatacagagaacaggaatggaggcggcggcgccagcatggctggcgccctcctcctgccacgtcggttcgcgtgcgccactgtggcaggaggacggcgccagcctctctggcgccgtcccgttggatgacggcgccagccactctggcgcccaaaaaaggaccatttctaggataagttttttcaggggtctatttgcgaaataagtttttcaaaaggaccaaaatgtgaaaaatccagctgccccagccccctgcccgttctccatgtcttcgatgtgatcacacgtgggggagaggaggcgttgacgtgggatgaccagtgggagagagaggaggggttaatgtggggatgacaagtgggggagaggagaggatcgtgttgcctaattccccttttataataggtgagcagataactatgtgcgtcaagccgtcgattaatgtaccgttgatgtacagttgcttcccgtgtactttaacgtgacagaaaaaactacaacaccagttagctcgattggatccaaacaaaatatttataataacaaaaataacttacatatttggactccatctttagcacatgacaaataattttagtaccgaaagataaaaagatacgggggctgttcagattgatgtcattttcagccatactattttttttaaagttgtcaaaaaaatatctacgtttagtttgttgccaaatttggtaaatatataaaaaatcttaccaaaattttgacaatattaccattttggctacaatctgaacaggcccataaaatatcgagagagcgaggtcaagtaactcaattgattagtttctgtctacttaagtcatacatttggtctacttaagtcatacatttggtacatatatgcttgtatttacgattcatttatgtgattttttcggtccgatttttatccggcgtacgtcgccacctccgtcactccgattttgctgcgcaatgcggcccacaaagtctggagtctgtgcgccaccagcctgcagatcgctcctatcgctacaaatcagacgggggagttgggactcctctctgtctcgcgtcggcgagccgttgacacagtggttccagggcgcaccgtacagcatggatggagcaatggagagtagtatcaggcgcagcagattcttttttcacctgaagatgtacttcagcacttaagtctttacggatgtgtataaggcaagcgattaaataaacaatggtcacagctgatcataatagtgattattttttaaaagtatacatatatatggttatcaaattcatatactctgtatttatatgtttttcaataatgaaattttattttggcctttatttcaaacataaatctatatccatatatctttatctatacctaattagaaaataggtaaggcttccgggtcgcttggttccggcgtacgattacgaggatgacggcctggatctcgggaatcctgtcgtcgtcttccgctgttgtctcggcgccgatctccatcgtcgtcgtcgatacggcggcggccatgaccagtattgtctggcacccgtcgttcgcgatcgttgtgatcgtgatggttgtcgtggtcccggtcctcgtttgagcggtctcctcgatttatgttatcatggcaccgtgaagagacatgacgccgagagcgattcacgttgtctcgtgtgcgtcgtgcttctcggcggccgttgatttgatctcggagatcgccagtgccgcgaggtggaggggtagctcgttgaggtgattccctccgttccggatcttcaccattggcctcgccagttggtggctgctcctggtgtgctgcggtagtggcttcttcaaacgcgttgctgaggttagtcaccgattcccgtagtcgttctgtccaacgctcgaggtcaacgttcagaacgggatcgtaaggagttttcctcagtatcgcttgaacagccctgatatgctgggctagagtagttgattgattccccacttctgcgttggcgtgcgctgacgtgccaacgtcatcgatagccaatacctcccacggcgcgctcgttgtcgatgacccatagtcctcaaggagatgtaagaccgatggttcatgaggatcgatatcgattaccccaacgaatcgatctgaagttagagtcgctccttgttccttgctgttatccctgatggggacatatgacttaggagacggagctttcatggcgccgagaaagactttgcagctcgagaggtcatgattctttgtcttgtgaataggacaatagacatcctgagttggagaagtacgttgaattccatgttctttgcaggcgcgaatttcaacacggacgttgaggaaaacccagcaatcttgcagagtgtgtttcttggttttgtggataggacaccaagaccttgtggcttcggaagtcatctttgtcgactcgtggttcatgtcggaaggacaaggtttgaccgtatcagaatccttctcgagcttagatgtcatcgatattccgttcttcgtctcgatgggaggatttttcgacatggaatcgccttggttcgtagccactgcgttctcgtctccagtcattggaggactggttgagatcggcgtcgtggtgtaaaccgggaagacgatttcgccgacttgagtccataccagcattgttgaagcagggagtactgaggctagtgctgacgttgttgtcgacgaagctggatgacatagtagtagaaccttgagtaccaaggccccctacctggcgcgccactgtcgacgggtgatacccgtagaccagatatagagggtattggggtacgttggtacaaggacctacgtagtacgacatcaagcaaacaaaagacaagaattatactggttcaggccccttgataggtaataaccctaatccagttgatgtgggattatatggtagaaaacacagattacaaagggaacaagggaacttgtcggatccggcgagattgtagtcgagttgtttcgactagccctcgacgatttggctcctcgtaggctccggcttcataggctgtgtaggttgtgttggctctgagattcgatatcttaaaccctccctagggggtcccttttatatcgcagatctagaggtctccacgtagaactcggacgtatcagaccctatacgatacgccaacgacccagttctgcccgagtaggattcttcccgtctataaattccgtgaaaggtttccttacaatatacaggaaatattcgcatgcgcgtggatatgacatatcgatatgtaacgtatatcgaagggcaaagggtatgcctaacccgtaaccctgacaagcatcattttaattgcttatgactgtttattaatttaattctagataaactaaaccaactagaaatttgcctacatatttctcatgatgtgtatttattttatgaccaacgttgattataaattcatataggttttatttatattcatgtttataaattatttatgcctgacagtgacgtaattcatgaattatttctgtttaactttgtaattaattgagccaacacaaattaattattttcatttatccacgtgtttcgtgttttacgtgtcgcataaaagatttttaaacacttgattaacaacactaacccacacgccctccgtccccatactcaataggtgttcatcgcgtacgcaggtcaaaggaaaaaaaaaatcagggatcagagatcgaatcaaatcctaatcacatacagcgggcaaaccacaaaatcgaatgtcgattaaaaacccaagcgacaaatatcattcaaagtctatatcaaataacacaaaaaaattaaaccaaagtaaggaaaaagtataatatatagcgatccaaaacgtttttacccgttgcaacgcacgggccattttttttagtaatgataaaattataatcggatagtagcgcacacaggtgcatcaataactttttccacattattaatttgatttagagaaaagaaatcatagcatcgaaggagtaacccaaatttgtgggggccaacttttcatgtgtactcctggtaaaggcatcggcttcatcaccttagccttcaagtcaaaaactccaatatcacgtggcatttgtttacggtcccaaaaaaaacttaaattgtcttcagtgaagtagatgcaatctgcacctaatccggggatcctatcactcaaaaagaatgttgccgagttgctaccaatgaagattgacgcgccaccaaaatcatgcacctctctccactcgcttcctctaggacgctcgtcaagaataaatgcttggaattttactgttggatcgggtttaagctcaggctccggctccggatcatagcggtagttgtggacttgtgggctgcattgtaattgtccttgtcattttcctcctcaatagcagtgacatcgtcatcgctttcagagtcacatcgatcggtactatgctccctcaaaatgagcatcaggtttccgttcggtgactcggctaggtacttcctaatgtagaggggcaggccgtcttcgtctcgggacataaactgtggagcaacgtttcttgggttaaatggtgttgtgacgtcatcatgttcccaggtttggactacgccatctaaggcccctcacagtgctcctagctgtagcgtggcttagtactgccacgtaggtttttttcacccgtgtcgctcggccacgcttctctgcttggacgctcgtgagtaaactaggatgcgcaaaaccaagcctggaaaagggaccgcgcagaggaatcgaggggaggcgctagcgctgtgggcgtcattccctcgccgcccggtgctctcgcgcgggattcggccggcgaaatcccctattcaccctcccaaaatcccctcccgccacaacattatttctcccgccacagataggattggaagagaaaaagcaagaaaatcttgaagattggaagagaaaaacagatcggattcacggcaaaatcatcacagaaaaatcatcacagaaggcggtgccggcgaattccaccacaaaccaccactcaagtcaactcaaatcaccccaaaccacgctgaaatcaactcaaatcaccccaaaccaacagatctggacagtgcaagaaaagaacagcagcgacggctcatgctcctcttcctcgcggcggcggcggctgccgggctcgccgcggcggcctgtgccgcgcggctccgccgctccccggggtccggcggcgctgctcgaggtcccccttcggcaaggtcgttgcggtggaggcttgccccgctcgagcctttcccctcctcctctgccgccacacgaggccagcgccgcgcttttgcccgccatcagccgcttgtctgctcccgtctccggccgcccgtcggcgacgcatcgtccactcccgccgctcccaccgctcccgagtccgcgcgggaggagaagcgagcggcgcggtcgacggcgaggcgcacggcggcggcgtcctcggcgcggtcgccggattcgcctcggccaccggagggaggggaaggaggcgcaggggagaagcggagcggcggcacgggaggagaagcgaagcggcgcgggaggagaagaaggcgatggcgatggagtggaggaggagaaagtcgctaggggtaggtggggaataaatttcgtcccgtaccccgtgtctacacgcttgggtaacgctgcactgtgggttcggttttcttcacttgtggctccatccaattaagccacacatagtatgggtgcttgcactgtggggtgggtgtctttgggccaacttttttggcgagagctacgggccccatagctcgcactgtgagaggcctaaggtgaccatgtagaattgtcctcggtaaacgatcacatcttcatacatgtgtcgcgtttgcaagggcatccattttgcatcacgcccacgagcaagcacaaccctgttccttggacaatgcatcatcatgataaagtattcaccagaactagggtcccacaacgggacggctttaaggagacgagatgaccggatttcctccgcagaaatctcaatgtcggagcaccatccgacaaacctggtgtggccctccggccagtaggtttccacgaatgaggctactttaaacaagaacctagcttcatcaccgtcagttcttggaagggcatcaaagtaaccggtagtggtgatggatggcagcgagtgttgagtgccggagatggggttaaggaggtgcagcccgcacttgtcatctgttgtcacaagccaacccttcgccgagccaatccacatacggctttggatggcaggggaaggcagggtgattgagcgacgccgtccatccgagaaagagtagaagtccgcgacggctagatgttggggggaatcaccggcggccggtagcatgagccaaggcggttcaggcttcggatgaaggcggaggttcatgccgtatccgccgcccgcttccacgtcttgcagacggcgccaaacttgatccagtctgcgaggactaggcgggttacaaatgttagagtttgtgtcgaatatgtgtacgtagtcggttacagtttaggacttggagttgtaataggtattaggactagagtatgagtcggactctatcctaggatccctcataaatagaggggcgtgcctgttgtaaccgcatggcgacttagcatagcgagagggagcggctgccggcgtcgaccggccgtgagtcgttgtaactctgatacgctatatatgatggatcggggaggagcgcccgtaatcagtgccccggagatgtaggctacggctgaactccgttaccaaatatcgtgtctcggtgtcgtcatcgttttggatctcctatggagttttcttccgtatttagctatcgatgtcgatttcggggctggttttataacaagtggtatcagagcctgcgggaggtccatggtagaggcgcgatggaggtgctccacaccgcgtagcctgctataatgcccagggaggggcattggcgcaaggtggagcacggcggcgatcaacggagtcttgatcggtggatcgaacacttctggcggcggccggaaccgtcgatggctgccttcaacagggagatgactagacatggtgctcgggttgatggcggcggaagcgattggcgatccaatcggtgggtcggacacttcgggcgggtggcttggactttccggtgagctactctcgatagggagacgtgcggccgcacgctcgggttgattgaagctggaggcaatcggcgttctcgatcggtggattcgaacactctgggcggggtggcccgggcctttcgatgtgttgagttcgacagggagatggctagacgtagtgctcaggtcgttcggcggctgggaagacggcatgcgacttgtcggcttcggctcgcgactagattgatggcgttcaatcgaaagtcggagcgggtggatcctataggttgttttggaggtgttgacgaggtatttgcgtgacaaactgctacggagaaggcgcacatacgaaaagcaacggaatcaggcagaagggcagtcaatttcagaccgtcaatgcgctgatcaatcatgttagcacagcaataagcattggttgcaactgaccggcggtattcgtcaccagcgaggttcagcgggaggctaggtggctgcgctagaggtcgtacgggtgcgtggaggctgaggaggtcacggagatggcggtgtgcacgtgttggtgttgaagccgggaccatggaacgtggccagagcccgagtagcaggaagtcggattgcgcaggactcgatctggagaggttgtgacatggaaggagtcggatatgtttccaactcggatgcatagcacaacagagaaatagattgagggagagacctagtcaagcacggaaggggaatcggacgaggactacgattcgttcatgaatcggactcgatttttcccaaataaaagcagcagaggaccacaggattgcaacaacgcaatcgaaacaaatcatctagcagagggcgagattcgtacccgattttcgcagaggcaaaggtggtttgggcggcgaggtcacgggcggctggagacgcgtcattgcaggtaggcggcgcacggcggcgtggtactcggcgacgttcgtcgcagctcaggcaggagcttgcggcggcggcggcggcggttcccggcgaggaaccggcggcggacttcggcggcaggcgctcccaggtggcaggcggcggcttcccaaggtaggcgacgcggcggctcctcgcggggtcggcgcaggtgacagcggcgggaggcggcggcgccccaggcggtttctgaggtggggggcatggtgcttcttgcggggccggcagcgtgaggagcagaaggcggcggcgcatcgggaaaagcggcgcgggcgcggtttctgggaggagcgaggaagccaaaggaagaagggagacaggatcgatctgtttttctttgactggtggttgaccaagtaaaagaaaccggtccggttttttggagaaagaaaaaaaaaccggttcggtccggctggtactgttcgagttagtcggtggggtcgattgaaccaaggcagatcaatttaacagggcaacagctgttgagttgattatcgtcgatggcggtgacggtggtttccaaatttgagatggtgaagttcgatggcactggaaatttcgttctctggcagatgaggctgaaggatctgttggctcaacaggggatatccaaggctcttgaggagacgatgccggaaaagatggatgctggcaagtgggaggagatgaaggcgcaggcagctgcaacaatacgcttgagtctctcggattctgtcatgtatcaggtcatggatgaaaaaacaccgaaggaaatttgggacaagttggcaagcctgtatatgtccaagtcgctgacgagtaagttgtatctcaaacaacagctgtatggtttgcagatgcaagaggagtcagatcttaggaagcacgtggacgtcttcaatcagttggttgtggatctaagtaagttagatgtgaatctgtatgatgaagacaaggccataattcttctgtgctcgcttccaccgtcgtatgaacatgtggtgactaccctgacgcacggcaaggatactatcaaaactgaggagataatttcgtcgttgcttgcacgagacttgagaagatcaaagaaaaacgaggcaatggaggcttctcaggctgagagtttgctggtcaaggcaaagcatgatcatgaagcgggggtgtcgaagagcaatgagaagggagccggtgctataagtgtcatgagtttggacatataaggaggaattgcccgttactgaagaagaggaaagatggcattgcaagtttagcagctcgtggtgatgattcagatagcagcagtcatgagattctcacagtgtctaacgagaagtctggagaagcgtggatgttggactcagctagttcctatcacgtgacatcgaagcgggagtggttcttttcatacaaatctggtgattttggtgttgtttacttgggcgatgacacgagttatcatgttgttggagtggacgatgtcaagttcaagatgtatgatggaaacgaggtgctactttcagatgtgagacacgtgccgggactaaggaagagtttgatttcgcttgggagcctacatgagacaggttggttgtatcaaaaggattttgataggaagaccatgaatatcatgaaggacggcaagactgttatgagggggatcc

SEQ ID NO: 12559 - DNA, 8660 bp, Oryza sativa
cgcgtcgcgtgtcccgaggcacgcgcgtgcgcaccgccgcacagggcctgtttctcagatgtgcgcgaggaggagcggtgctgtgtacttgtgtgtgctgatcgcgattatattgcgttgaaagaattgttagaagaggataacactactactacagtagtcaatcgtggtagtcatgcactacactgaagtgactgatcactgttgcttgcatgattggattgactatttagatgccgagtagtaattcggatatctcatcgaaccaggttacaaaatgcatgagagcaagttgtttaatagtatagccaaatactggctccaaatcaactgtagtcaatttaatagtcaatttatacaatagtaatatataaacatatacacaatagtaatatataaacgtataccacactattagtttatggtcccacatgtcatacatatatttcgtcttggagcccgtgctgcaactggctacaaatctgtagcccactgctcatctctatcttctttcatctactcgatatgtgtttatagctggcatatagcctactattgtatctgctcactaccacacttgagaactaccctgtgggctgttatattttctatgggttccgcaaccaacccacaggaatatgtatttttgtgatggttctacttatccctacagaataattcatttttctggcggtgcggccctacaggtaaatgagactaaggagaagagagagataaccctaacattcgcccatcccccagaagacttcggcattttcttccccaccgctgccaccctcccatcctccgccccctcactggatctcgcccacgacggcctccgctcgctgactcaagggagcatccaccttcgccgcacctcctcgccctaacgccagggagcagcgtcggccacctccccgcgcctcgtcgccccgacgtaaggaagaagcgccgacacctctcttgcccttgtcaggtgaggagcaccatccccgcgcggccgcgcccctcgtcgtctggctttggccggatccactctcccttcatcttatgtccgttcgggcgggcaagcgtgaacccaccgagtatgcggcgcagctcggacgcatcagatctggcagcccctggcacaggcggtgccagatccgtctacgagggccgaggagagtgggcgatgcctccttccccctcctcgatgtccattgcctcatcctcatcttgaaagataagcttttttttttctccaaattcttgttatcctgccatggcttcagatccgtgctccccaccgtagtggctacagattgggaataggctttccgatctagtgactagagatattgggttcgacttgctaagatccggtgatgcctttgctttattataactagccgggtggcccgcgcaattgcgcggctagcacccaaacaaatcatatattttttaatatgattttacttataatttattaaatagccatctcattgtcttaagactttgaaagaccaaatcttatcatccccgtgtttctaattatatagttttttaaaagtcacaccagttgctaccccttatgtcatcttcttctttatttgcttgctcgatctaccactatttctattcattctccttggaacctttaaaaattggatcttatagtttttagagtttattatcacgttgggtttcgtttttataatttctagacatccagttaaacatagccaatatactcctctatggctcgtccactgtctcttctatttattgtcattgagatttttaaaatcgaatataattatcgtttagattcatttttactttctagaagtcccgccaaaccgtcagcggctttgccattgtacttctctacggctcgcccgttgcctcccttttttattgtcattgagattttaaaatcgaacatgattatcattattttttttactttttagaagttctgaacctttaaaaattgaacattatagtttttagagtttattgtcttgttgggttttattttttataatttttagaagtctcgtcaaacgatgccactatgctcctctatggcatgtccgccgtctactctttattgtcattgtgattctaaaaatcgaacataactatcgttgggattcattttttattttctagaagtctcatcaaccatcggcggctttgtaactatactcctatataccccacccgctgcttctcctttttattgtcattgagattttaaaaattaaatatgattatcgatggggtttattttttttactttttggaagtcccgtcaaccgccttactcgtttgcttcacggcctgcctgtcgtccctccttttaatcatcattaggattttatttggtgttttattaacagtttttatatgtcgtatcaaccaccaccacgctactcctttataggcctgttacttaatttatctcgtcatgtgttttagatggtcttttctttcaatagtctttatttttatcacaaatttttgttatttataaattgtattcctaactgaaatcttatttttctttttctaattcagaatttatttttttcaaattttaattaatatcgtattgtgttcttttaatttttttattttttattttcaatttcagttgttttaaaattttattcctacttgaactctcttttagtttttctaattttagatattattatatttttttattctgaattttaattaatctcgtattgggttcttatatggattcttcttttaatattgcttatttttaatttcaaattttagctaattttaaattgtattcctacttgaactcttcttttttttcctaatttcgggttttatttttatttttatcctcaattttaattaatctcgtattgggttcttatatggactcttcttttaatattccttatttttaattccgaatttcacctatttaaaaattgtattcctatttggactatccttttcttttttaaattttagattttattttatttttattttgaattttgattaatctcgtattgggttcttatgttgaaacttcttatgtggtgtctcctttcaaagttgttttaataatatcatagattttagtagtcaaagctttgtcattaaaattatgcattagttcctatatctccttatttctcatcttatttttcgtggctaatttattgtctgtagctagttgcacaaatatctcctcgtttaagtctggttagtgtccagcacaagttgctcatttttctcgattggttgaagcatctacttgagtcgaatgttgcattaaactagttagtttgctcataaccgatttgttgtgcaattttgagatggaatctgaagtgatttggggtttgaggggagtacaacgtaggtgatacatatgcttgactttgtcttgtggacttatttaactactgcaaactatttttttttcacttggcatgctcttttttgccaatttgctaacgccattgctgtccttgaaggtccttagcgtgagcaggcttggcgtggcctaagcctttattcctcttctgacagaatcacaaactgaggtaaatcacaaattaattcatggtacattctacttgtatactgcatcattgctaatcaattaggaaaaagaacagaagtggttgatcctaatgacaatgcagttactgaagctgttgtgaaatatggcattaaactagttaatttgctcatgaactgattttttgtgaaatgttgagatggagtctgaagtccaatgttggggttcaagggttgttctatgtactggtgaagtggtgacacatatgcttggccttatcttgtggacttatttaactactgcaacagattttttttctcttgccatgctattttttgccaatttactaacgtcactgctatctatagtatgcactgaactgaagctgttgatgcaccatatattaatgtactgcttgtttctagaggtagcacagtgtacttcaatgtttttgtgactcgggaaaatttatgcatgtcagaattgtcttcagaatttctcaattgacacatcctaaaatacttaatgccttatttttcttgttcctctgaatatgtcagtgaaggatatatagtttgtgcaaagcctgttgcttaaaagccccctcctcaatatgtagcatttcaaagacatacaaaagatgataaaatagctagagcttaaatgcttggaagagggataagttatctgcatttgctgtttcatctacttgtattattggtactggaagttgtaactcccataactcgtaacttacagtggtgataaaagattcttgttgaatgtaaattggttataaacttataagttacagggctgaaagtttgcttgtattttgatggatgaatttgtgtgcatgtgaattgctgtgtatatatatataggaaacaactccattgctataatgtgttgagaaagtattgttcagtaatccatattgacatatgaactgcattgttggttttttttttctgccttgaagttaatttttctgacggttctacctttgtttttctgacggttccacgtcaaaattatggggacaaaaacgtgacggcagtggattttttctgtgttcctccatcagaaaaatacccacagaaattgtttttctgtagggaaaccgtcaggaaaatggaatttttccgtggtgatttttctgtcggcaatttctgtcgattcacccacaggaaaataatttctgacgggaaaactatttttctgacggtttcgctcctacagggtaggtcccaaatctggtagtggctctgataccgctatattcgaagggcgtacccagccttagctaaatcttatgctacttggagttctagaacaaacagaaaaggtgctgaaattaatttgaagagagagtggcacagcgcaaaaagcctgaaaggccaaaatgatagccacattcgctgcatggccaacttaattggttagggccacgtaatcagcttgggaaccactgaaacccatttgacagggcaccagtcattacggtctcctggttttcctctcttccctatctccctaggacgacggcggtagacatagagaaagacgacggccaacggtagaggagctaggcaatggcggtgggcctcgatggcatctcggagaggggcgatgtggagggagctcaacttggacctcttatcacgtctggtgagagatgactcagagtaagccctcttcagcaactagagggtaaaaaaaagaggaggaaacaacgagcagccggcggcaaagtacatccgttgcgctccccatcgccgttgccgccactgcgaactttgatttcccaagtccctctgccctgatcctcctttgcgccctctcgagctcgtcgccatctcactcatagccgttagtggcgccaacagtctttcaagcggatcttagcagacgaagcgcatgcagatgacgactgaccatccccattgattccccttatcgttgtcagcatgcaacctcctcacgcgcggctagatgaggttgctcacgagctgcgatgtgactcccaaccccgcgtgacggcataacatccgatgaacacccagacaacgagaaggccaccatggctagttcgttacgctctatcgccgcaacagtccatgtcctcccttttcatccccttcccctacctcctcctttatgatatcctttcctttttttggcgccgttgtccctgagccttccctatagccactgccctggagagatggtgaagaaatggggaagaatgtaagggccctgacataggtttcatgtggtctcacggccattttgactacagtcaactcaccatgtgagtgaaaatcggtcaaaatactgtcctgcgacctcgggtactctggttgtaagttgtgggatatgttatatctggtattaccattcaattacacgatgcaaactcgaagttaaaatgagggaccaaaagtgcacttattccgctgaagtgctgaacattggaccgatctcctttgtgcgtcctaaccgatccaacggctgcccacgcacacgtacgagtaacccagttttatttcggcccaactggtgcccaagtgcccgaccgcgcgtaggtttgctattgccgccgcggatagctctcgtggccgccacggaacgaggtccgcgcgctcgcgattgggctggcagatggatgcctggaagcgttggaagtgggctcatatattaggagaggaacatacaagtcaatagtggtaggcatgcacactgaagactgaactgactgatctgaactgttgcttgcatgattggattggttgtttagataggagtacttggataccttaatcaaatcatactacaacatgcatatggtactagagttctagagtactctctgtatttattttgcgatggagggagtagaaagcaaaggtgttgagattttctttagaagagagagtgccacaacaatgtcttactttttttttcagattattcattggattatcaaaacggattatttggtatatacttttaaaaagaatatgttttctacaaactttttctactatattgcttagatcactcgttttaacttttaaactctttttaatttatttttaaaaatattttggttaccccttaaaacccatcgcaataagctgcaaaataatctgaaaagtacggggtgggtttgaaagtttatactttggaatggcaaccacattgctgcatggccatcttgaggagagataaagactcaaagtattctttccatgaggttctacctcatgttaaatttcctctaatattcacatgggaagaggcatttcataggattccataggatttattcttttgattcaaaaggctatataggaaaaaaaaatcatataggaatgaaattccctaaaatttttatgaatttcctttcaatcaaaaggggtctaagtttgctagccaacaatgagatggctagctactcatagacttactttgtacggcaaacataaccaaaaataccataattagaaccatctcgatctaagctctagcgagctacttcaaacctttcgccactagcgcgcagcatgtcgttcttgttgctttcctttcgtagcccttgggctacggtttactttcccgggttatacggctcatcagagttagcagtggggcataatccacaaactgccttgttgatcgtcgaaatcacaaagaaacacgcaaaattctggcgtggcggccgcggggaaccgtactgcatgccggcaatacggcgaagaagcaccggccccagtaccgtgtggatgcacggcatcatacggtacgaccgaccccgccgggggctgcgctgatgaaagatgcgcttaaaccgggggggagcagtatcagcatcagcagaacgtgacaccccggtcccgcgcgtcatagtcgatccaaaagccccccatgatcctctcgccagagcctggcaccgggccccacatatatcgcccgcccaatcgagcggggccccgaaaagtatcaggcacaggagacgcgatgcgttcgctgatctgaaaaagataaaaaggaccaacgtacgcatgcaaccgcgcggaggagaggaggcgagcgtgcagcggggcagagctaaacacgaacgaaagcccggtggtggcgagttggcgactgagcgcccgtgtacgtcgttggattccccgacttgtcaccgttgcaggcttgatgtcccccgctgcgttcgcccgacggcgggggccgtccgcacattaaccgcttgtgtaagtgagctttatgcgcggtcgtcggaagctagctagcaaacaatgccttgactgttgggggcgctttgggagcagctggcgcgcgcgtggggtcttctccggcgaagcagagcggacaacgtgtggagttcccaggagagatcgagcgagacgccgagacggacacggtcacgcagctttgctgctgatgtgggggcttcgttcactgcgtgcactcggtccgtggaacagtggattagataagaggctccgacgcgagctgatcggacaacggcgtccggctctccgaaaggccggctggagtggagtggagtacaggagggttcagcacagcgccaggccggcttaaacatgaattctgtgagaaaattttgtcatcgatcttcatctcatctctttaaacgtgtattaagagtagttatacctacgggtgtttgctgcacaggcaatgaggtgtatgtgtgtgcatctttctcgaaaaatataaatgtactcgtgctgattttaaatataccatgtaagttgtttagacttgtgttgtgtatatgaattgagaaaacaacttgcttactccttgtttttacatttctgagatttacgagggggatactaacatagtaacatttagagtatatttcattttgaaccacttttaataaccactggtagagaaaccatctttggtcggtcgacctatatccacaatagtcccggttccattaaaaaccgggactaaaaatgatttttagtcccggttaataagaggaagatctttagtcccggttgttgttaccaaccgggactaaaaatcatctttactcccggttgat

SEQ ID NO: 12560 - DNA, 11026 bp, Oryza sativa
cgcggaggcggcggctgcggtgggcggccgctcggcggtgaccgacgcgacgctggccggccggcgcggatgggaggaggggaggcggcagtggccgccggccggattttttttttgaaatgtgaatctgtgatgtatttttgtgtgagatgtgaatatgtgatgaattttttagaaccctgtgatgtaatttttttaagagtttgtgatgtatttggatatgatttgtttgaggatttggagatgttctgtaatatgtgatgatttggatatgggaggggatggtgtgaaatcaatattcaatattaaaagcagaaaaaaaagaaaaaatatctttagtcccgggtggtgttatcaaccgggacttaagattctcccatctttagtccccggtggtaacattaaccgggactaaagattgatttttagtcccggttatttgaaccgggactaaagattctcccatctttagtcccggttggtaacattaaccgggactaaagattgatttttagtcccggttatttgaaccgggactaaagatagcgatctttagtcccggattcgtagtcccggttggaaaaccgggactacagggggttacgaaccgggactaaaaagcatttctccaccagtgaaccgaagtttcatcatggaccgccaagcttatattttcacttagcacagttaccaccactctttacactttaaactagggtttacaagttagcacaagaacatcaaatgtaacaggtatacaacatcctataaaataaatggaattgcattatattactgcatatgaacattcaaagataatatatatttcattactatgtatgaacattcaaagatcatatttcactgcttgaaaattaagatatcaacgcatgttgttcaaccttgtccaaagcgtgaacgattgtaactatatgctgtgatgttacgtgaaaagataaatctagcgtagtctattgggaaactttggttgataaaagtagctcaaagtgaaatttactctaacatttatctgcaaggacatacaaggaaaaaagttgcaaaaatgtcttaaagtaaaaaaaaacagcttacaacttggaaagagtcgagaacttatgttcgagacaggagagtcaaaaaaattaatttagggctttcatggaacaaagaaaaaacataagaccttttaggattgaaatccaatggaaaattttcataggtgctcatttggaagaaagaaatgagcacttgagattcctacgaaattcctatggaattggcttgaatcataatttattttaaggatttctatcatgaggttgggcctcatgggaaactttccttgtgttatctctctcgaaaaatcctgtatttttcctatgaagcatctaaataacatatttcacacaattcctgcattttaggaattatttaaaattcctaagatcaactaaacatgccattttgattcttacgtttttcatgtctagtgtttttagattcctgagcattttttttcttttttgccgataaccacctattaattcaatactcaacagtgacacaaaatgccagagctggcaaagtggagtagctattctatgcaaagatttttccaaacattctctccggttataaacatttgacgtggttgactttcattcatcttattaaaaaaatttatataaatattatttattatgttattacttgtgtgtctatatatatatatgtatttatttatttatttatttatttgcacgaaatttttaaataaaatgaacggttataaaatatttatggttaaagtcaaccgtatcaatatttatggtcaaagagagttcttcgtgaaagaaagaaaaggaaataagctctccaagaattgcatgcaatttgactttcggcactacggtcataaaagaactggagtagtgatcatttttgctacctgacacctcctaggctcctagcagaatctttaattaacacattgcctaaattttcattacatatggcagggaaagagctacagtaatgtcgttactcgttaggccagccaggctcatcgatctcccaacgaggcaatggcttggatgaagctctacagtaaatttgagcagtacatatctacagtattcactgccactcagccagactagcggagtggtgccgttctcaggctcacggtcccggtatggtcgattcttacgggcgatagaagtcgacagtatactaaattgcattggactgactctgtgtttctgtcaaaagctctatatatatggagtagtgtaactcatgtcaatctaggtgtctataggtggtgcgaaatccgcaatttactaacgcgacgctgctgcaaatttgtaaagaatatgataagcagagattggaaagtcgtgagaagggggggcagaggcatggacgcggtccagggaatggaacaggatggcgcagcgcagcggcaggggcgtcgccaggcaggcaggcaggcaaggccatggcgaggagggcagcagcagcagccgcgcagtgctgtcactgctgtgcttgagagacccacacacacccgataaaagcgagcgcgaaagcgagcgggcgaggtggacgtaacaccccccctctactaccgctgcacacacctgcacactgcctgcctccctcccgcgcgcatcgctacgacgagccagctgccagccagccggccggccggggaggtctttcctcttttactccctgttccttgctcgtatagttaacagtagtacgtactcatgcacggctgccagtgccacagcctctctccccacgggccgacggcgagctagcgcgcgcgcgcgcatcatccgtcgcgctcgcgtatggttggcgtggcgcatcattcatcagtagtcaacagtggcagcgccgcagcagcgagcgagtggcagcctggcgcagggccgcagggggggcatcaaaattttggcagctgcgtgcatgcgtcaacaatcgtatacacggccgagtacagagatgacatgggcgcgtcgtcgtagcgtggatccatgatgatgtgttatattccggggaaggaaggatgattggatgcgatgagcgatgtgccaatgtcacgccgcgcgcatctcagcaaattcagcatcgtctccccctgcacgattcggacctgtcttaaacggtttagctatggtcaaaaccaggagtagtttatttagggcagtcccaaccctctatataggatggtgtctatagtattaactacattgttatgtaggactattaacttatgtggcactatattaattaagagagagagtgaagagaggaagaaattgggtctcatgcaagacacaacttcaacacgagaacctatgcactagacactatcaagttttacattgagagataatactgtcttcataatagatgaataataaatatgattggtagagaaaagagatgatgtatttattaacggtccactttaagaaacaatgagttgtagagtgtagtttctattgtgatgtcttattgacatggtaccatagacactgcttatggacactataagttgggactgcccttacatgccacataatgttatgtgatgtcatgctgctgccaggcaggtataaagacatgagcaaggccttgcttagtcctaaaacaaagaattttcacggttatatagattacgtgtaaattatgagacaaatcttttaagcttaattataccatgatttgataacgtggtgttacagtaaatatttactaataacggattaattaggtttaataaatccttcttgtaattttctgacaagatctgtaatttagtttattactagactacatttaatatttcaaatgtatatacgtatatatgatgtgacaaccaaacctaaaaatttttctcatctaaataaggcctgaaccaaccggttgaattggtgttcaatgacggtgcattgatcgggctggccgtgcagtaaggaaattaaaagcagggctagctgggaagaaaggcagtaagacaccgtggacaaaagagtaatagcatatattgactacctccattattgttttctactggcatcgatacacatcttttactttatcgttgtttactttattacaactaggaaggatggaaagatgcgtggatatcttatttattatttatataaataatattagaagagttaagtcatatctcatcatataaatataaaaaaaattatagatttcgtctcataagaaaaaaaatatgttgtaaaatagatagtagactttaatataaacaataaaaatgtttcttgtattaaaaaatcactgttgatcaggatacatttaaactcatctattgtcgccgttacttattagcattatcgctaaatgccttttgaataaatggaactgcatatgtaccaccaaaataagtctaatgcatcattaatacataaaaacattcatcttcgctgcatacctaaatgtttatgtcaacacttaatttttaatctataaataagtaatctgaaaatattgcttctattggttaatggatagcaccgttaacaattagatatgaatgccccctctaacgggtgaagctaccaaggctttatttctcttttgccttcatacataggttccgtatcgatatactcgtgcctctcaaggccagcatggagcacacttttaagacttagttcactgtcaatatcttcaaagacgattgtatcgctaagtaggaagttgagcactattgtcaatggtaccctccactaggactgcctcaactcaaccatatatatgccccatgctatactcatggtaacgcaacaagcactatcatccatgcttgatgcccttcaggggggaaaagcaagaaaagataaatgtgatgagaatagttctttccataaaaagtatatatatttttattttttagacacaatttgtttggggtgttaattcaaatttttatggtacagatacaatgctctgttttgaaatgagcaaggttgatccttaaaatcgcaatatttaaccatgataagtcatcaacaatataactatgatggagcggatggttaatggaattttttttatataatatatataccttcccacatctaactgtatactggtgccttacatgcatggccagtataaagtcagatttggtggataagagatttttgatatatttgaatgcaagtaccatgtgccaaaggaagtcgttttggacagcgatatggtctccaaaactcaactttgacttcttgtttctataaaaatatttattgaaaatgatatatgcatacttttatgaaagtatttttcaagacaaatctattcatataatttttacattttcaaactcaacaacttgagagctattcatgatttatattctcaaggtttgacttaaatattgtcttaaacgacttcctttacaagtacggagggattacaaataaaagtagttaaataagtaaatattccactgtattttcttatggcaaagctatcgatatcatttcaaagtgacaacacaaatatttttgttatgtatatgttgtgatcgaagttttttaaaggtatgcatgaactcacatgttctaaaatgacgacaagacctagagagggacaaatagaagttttcaccagaagatcgatcgacaaagagcaattttcacaaataatttatcagcacactaggtagctccaataatgcaggatacaaccatctcagattcacaaagcaaaccaaattattggccccaaaatacatccgaaaagtcataatatcacacacatctaagctagccatggaccacgagccgggccaacaggggggaaggtaacatggcaaccaaaggttgttaacacacacaagaagaggaggatctttcggaaacagctcaacgaatcgtgcccgagatgcagaagaaggccggacccccgggctagctatttactggcgagtactgtgttgtactacacatctatagtagggtggggaagggaaaagacatggacaagaacatgctcagatggctacaggaagttgatagtaatgccaatgtggacggcgcgggggccggttgatgaaggcaccaccagccgttctttctttggacagcatggcccctaaaatccaccatgcatgatcagtgctgtttaattagggttcagccgctcagaggaccagtaagcaaaagttgtgggctttaatttgctttagcaatcagtatccctgctaaaagtgtgcaggttatgtaaagggtagttaaagatgtatataactacatgttcacaatggcatgtcacatgttcacaatggcatgtccttgtgaccaaggagaatatcatagaacaacttcaagttctattatatgaagtcttaaataacatgtgatacactatacattgttcaattgcatgactcggaagatacgcttgttaattagtatatatagtgctaaactaaaagatgtgcttactagtgtagtggaaaaaaaacatgtggttttaacatgtcaacatgtattatattctcggatagtattcacctcattattatctgacatcttatacactctatattgtttgattgcacaactcgggagatgcgcttgttagtgcaatggtaaattaaacgatgtgcttgcatgtgtagtgggaagatgtgtggttttagcctgttggtatgcatcagattctcggatattaattattattattattattattattattattattattattattattattattattattatcaagtacccttttgcacgagtttcattatatgaagtcttaaataactcatgatatactctatattgtttgattgcataacttagaagatgcttttgttagtgcagtggtgaattaaaagatgcacttgttagtatagtgagaagatatgtggattgattagcctatcgacttgcattggatttgatagtattcacttttgtattattatttgatattaagtatttttttaattgtataatgtttttctattgcaaattcggttcctttcatgccatggttgcccattggcgtgtaagctagaatcaacaatcaagttcagccatcaacaatctgccggtggtcaagttgctatccctactcttcccaacttgcacacgctccttacctgactcacgctatctttgaattgtcaccaatgaacatgagttggttgatccggatccgaccattagcttatgatctatgccttgactgatatcaaactaaatgttcttttagttcggcaatacgtagttgttgttatgatataaaactagtggcgatgccaccgctcgataaattctgagcagtggctcggtctcatctgtgaacacataatataactttggtgttatcacaatgatggaaaataggaattttatagttaacatattctatagttagatatggtcgggctctaaggccccctttgattcaaagtaaattattttttctatatagccatttgaatcaaaagaatggatcttatggaatcctatgaaattcctatggaatgcctaatgccttgcaagttttggagaaattctaacatgaggtagaacctcgtggaaactttcctttgagtctttatctctcctctaattcctgtatttttcatgcgttccaatcaaacaaccattcttgtgttttacaattctctgttttacacttacattcatatcaaaatcctacgtttttcctattcctacattttccaatgttttaaatagcgggctaaggcatttagcagtttgctttttaaacagctatagcggcagctatagctagctaaatggagctatagcggctaaattgtacatgagagcaaatagctagaatccttctcaaacagctacaacgggagatagcgcagctatagcgggatatttaaaaccctgacgttttctcattcctgcgattcaaagggttctcgaactccatcattgtgtgaaaccatgaaaaaagaaagttgtagcagtggctacaccaaaatcgcttgagccatatatgaagaagagtccctttgatttggaggaaaaacatttaaattttgggatttttatcttataggagaatttcgtatgaaagcttttgatacaaaggattgaagcctatgttatcctttgaagggcccatttgatttgaaggaatgcataactctgtagagattttgaaggaaatttaacaagatcttcaacttcttggaaatttccctttgagtctctctctcttatccgattcttatgtttttcctgcagtccaatcaaatggtcatccatgtgtttttcctgtattttgcacttacattcctattggaatcccgtattttttatatttctctatttttctattcccgtgatttaaagaggctctaagagatatatagagcctatcatagttggaggcgatgaataagaagggtgaagtaccataaaaagtactcctagtgaaatgctaaattcttcatcagtgtttacctagggggtgtttgggagagaggagcccccctagtactacaatctgaaaatggagctagaatctatcgcagggagggcagctgtttggctgagagataggttccatttcttaaggaaaataagttccacttcatgctgggattaaacaagcaagttactacaactgtttagagataaacatcgatcatgccttcaagcaggaaccaggaatcttactttgttcacgttaaaaccaaaccagaagcacagaaaggtactactatagcagcactcctactttaggagtatatatgcagcaaatcaacattcagaaaccagccaacttttagaaaacaaacctgtagggagtgagaaatgtggccccgcatgttttgccaagactgcagcaaaggcagtaaggcagtgaatcagtgatggaaagcaaagcatgcatgcagcagcattgcgtttttacttctcactgataaagacattatcagcgcttcaccgctgggacagcatcgctgcggcagcctcatccaagcccacctctgccgctgccgcagcagctgcccctgcgcgcccttcactgcgctcggctcccgcctctcgcgctgcctgtctcttcctctcttgccatctcgcccacttcacttcttttactgcaaacgccagtactatgagcaagtaataatgtgataatttaagggcattcatacccctctgcccaaaataacttcacctttcatcgttttatttgttctaaaataattttatctttaaaacgatctaatatatattatattagagtttatgaaagtgagaaaaatacattacgatttgttaaagtagggataattgtattgagatttgttaaaatggagatcattctagtatttttcttttttgacttatattggctgcaatagaggaaaagtaaagttattttaggatggaaataatactgcttatagtgctagctttattttttcatagcattgtttgatacttcctattttagttcacgtattttttttaatttacatataaataaaaaattacaaaactaatataaaatccatgctccctcctattactcatttactccgctggtctctcttctcctattcactccaactcctccctctctaccgccaccatcactacctcttccttctttagccaccaacacctctcccctcaagctatagcaagcttcttcgacacaaattgaaggtggcttagtaccgggtggaccttattttaccaatttaggctgagtttaaaaaaggggagatagagaagattgggaagatacgcaaaatgaggtgagtaattaacgtatgattagttgagtattaactattttaaatttcaaaaatagattaatatgattttttaaaacaactttcctatagaaaatttttataaaaaacgtaccgtttaatagttcgggaagcgtgcgcgtgaaaaacggaacaaactatctcacagtctcacggtggcgaacgcagccttagacatgagacgagagcatcacttgcagcccaacaaaggaagcaggaagggggcgccttctgtggcagttgaggaggaggtagattggcgatgtagcacaagaggatctcattgttccctcaccatcaccggccatcccgttaagctcactgaacagcctaattttatagtcacaacctcactatcattcgttgctacatgtagcatggtgtttcaaccctctaagaccctgtttagatgggactaaaacttttaagtccctatcatatcggatgtttgaaaattaattataaatattaaacgtggactattaataaaacctatccataatcttggactaattcgcgagacgaatctattgagcctaattaatccatgattagcctatgtgatgctacagtaaccattctctaattatggattaactaggcttaaaaaaaatgtctcgtgaattagctttcatttatataattagttttataagtagtctatatttaatactataaattagtgtctaaatacagggactaaagttaagtccctagatccaaacaccacctaaggtatcgagtacaaccaatgtagggagtagtttttacggtaatgacaacccgcaaccatgcagggagggacaacacgtgtcattgggagacacggtttcagtcgaggggagctagagcgtcgatatggatggttggaacaacttacaagtgtcaaaagctacaaactatttttatcagttttcaaataaaatttttgaaaatcacttacactgttttatttttttaaagatgaatattttcgtcacgtacagtacacgctgttttggccagggttgattttaaatatttttattcagaagaaaacaatagaaaaaaaatccaaagctgctggggtcagctcagctcgaaccctgctcccctctgccgctctctttatccaacaatatttgtaggccgtagccctggcctcccctctgccgcctacgagagaca

SEQ ID NO: 12561 - DNA, 50024 bp, Oryza sativa
  unsure (1)..(50024): unsure at all n locations
cagccattcatggccatcaccaccatgtgtggcctccccacctccgcctctcctcacccactccgctttccgctccataaacccaagcgagggacctcgatcgcctcccctcctcgcttccctccccgtctctcctctttcgaccgcgttgaaagcaagcgcgtcggcggctcggcgagctgccggtggggggttgcggctatggtgggcatcgacctcaacaccgtggaggaggaggaagacgaggaggagggcggcgccaccggcaccgtcacggcgcctgcggaggcgaggtcggggggcgcggtgtgcctgaaactgtggcacgcctgcgctggccccgtggcgccgctgccgcggaagggcagcgccgtcgtgtacctgccgcagggccacctcgagcacctcggggccgcgcccggctccggccccggcgccgcggtgccgccgcacgtgttctgccgcgtcgtcgacgtcagcctccacgtgagtgcgctcgccgcttgctgctctcgcgcgagcgcaatgtgttcgaggtattgattgagagagagggtctgctcctcccgttgtgctgtttgcaggcggacgccgcgacggacgaggtgtacgcgcaggtctcgttggtcgccgacaacgaggtgcgtttgcgtgcgtgctgatccaaaaatgggatgaatatctttgacattcggtcagtgctagtagctcaaacgaacattatttctgggtggttttttcaggaagtggagaggcggatgcgggagggagaggacggcgcggcctgcgacggcgagggcgagcacgccgtgaagcggccggcccggattccccacatgttctgcaagacgctcacggcctccgacaccagcacgcacggcggcttctccgtgcctcgccgcgccgccgaggactgcttcccgccgctggtacgggacgatatcgattgggacaagctacctcaccgtgatctgtttgattgcttgtgtggtgactctgttcagcttggcgcctgcaggactacagcctgcagaggccattccaggagctcgtggcaaaggatctgcacggcacggaatggaggttcagacatatctatcgaggtgattcgccggtttagcctatcttggtgactgggatatcagccgtactatcactaactaccatatatatgtcatacagcttggttgttaggcttctccctgggaacatgggattaattttcttaatgcgtgagagaacctagtaacctacgggctgtacagtcctacatcttcctatagtacatcacaggctgtttaggttgaactactgtactttgttcaccgaataacgcattagtatatatatgttttttcttttagtaagattatccaggtctcctttttagatacatctatcatgtctaggtattggaagcgagatggctgtccagtttagacgaaacaagcaaaccaaactgtaacttggctggctggatgagataaaaatgagcaaactatgctattttttctcattaggctctgctcacttactctgggagtgttttcaataaattattttaatttatgcatagactacctatttctacagctattgcgacataatctctaatagttaagctaattgcaatttggaggagtcttgagaaaattatggtccatgaatatctcataggtctgcctctaattgttacaggccaaccacggaggcaccttttaaccactggatggagcgggtttatcaacaagaagaagctagtatctggggatgcagtgctattcctcaggtaggcctatagctcatgtgctcatgaaccactaactcgaaatgtactaaagcttctcttttgtaatgatctccagaggtgaagatggagagcttcgattgggagtgcgccgagctgctcagctaaaaaatgcatctccttttcctgcacttcataaccagatctcaaatactagtagtcttagtgaagttgcacatgctgtggccgtgaaaagtatttttcacatctactacaatcccaggtaataaagtactttcctgattttttgaatatttaaatacctgtacctgtagatgttatttgcacaagtaaccatcataaaaataagtacaagtcacagatgcacataatattgcacatactgtacttttccaaccagtcaaataatcaaccatataataagaggatgtcggacagacagacacagcaatagcttgtgatagaacaagttatacataccatatgagctagagaatattaatatttattccttgtttcctcatgtcaagttcaaactccagatcatataagttggtggcatgttttcagtcatccagaaaatttccaatgctgacatttttcaaatgctcattgtttatatcatggaactggacttgtaattttgtattagaattgcaacattgtaaagtttagttccggctttttctaatccaaccttttggtatgtgaatagtagtttcctggctgactttgctgatctcgaccatgtagaatattgtgttgtttttaccacatttaatttgctgaatatatttgttttctcggatatactaaatgatgccacattgccattgcatgtgttcctcgaaagtgttgaggaagtgcacattgaagcagcaatatgatttaagaggatgtatctaattttcttgttttcaaatggtcatgtgtggtttactgctttactttcatgtgtggtttagcaatatagatttcagaggatgtatctaattgtcaccattttgcaataatcgagcaattttaacaatgttttgtgctatttctaagatacatcagataaaaaaaagaaggataattcagttccattgtagtgataatggtctttctttcaaatgatattcatgcatttgcaatgtgcaacttctgactgttcttctgcatgctatgtcctaatgtggatatggttaaaagtcttcagagttacagattttctttttgtctgcttctcttgttggataatgtcttgatgtcagttcctgcctttaataagttgtactcacaggttaagtcagtctgagttcattataccatattggaagtttatgagaagcttcagtcaacccttttctgttggaatgcgattcaaattgagatatgagagtgaggatgcttctgaaagaaggtattatccaacagttatatttcatgttttgcgaaatggcattacaatggtaaagatatttctagctcgtgcttggtttttcataaagaatttgtttttcaggcgtactggaataataattggaagcagagaggcagatccaatgtggcatggttcgaagtggaaatgtttagtggtatgcgctcttatatataatactgctttgcacagatggatgccagtagttctcttatttgatgttttactgcctagtgggtccgtgtctttcaaatagcagagtgcttctctgtattcagcattcaacattttgtgttccatgtcttagctttttatctgttgggaagttatagtttgtacaatccaaaattttgaatagatttaatggctcatacaagggtaaattacggaaacaaaggcatttaacctttttatgtgaaataaactagcttaaagtttatttttgtgaacttatgaaagtattggtcaagatttcagtgtttgcagcgcatatgtaaattcgtgtttgcagcgcatatgtaaattcttggtgtacttcaggttctatatctatgtttttctgaacacacaagtttagaagcatttgatatgatgaaccctgaaaaatagcgccctgcacttctgcttatcagcttataggatagaatatagaggttgaagggcatactttacatgccatagtgggcagggcatcgtctttactttgttaaaattttctccatttatattccaaatctttatcatgttcctgatttctagtattgtattgtgatggtgacaggtgaaatgggatgatgatgtggagtgccgtcggcctaatggggtatctccttgggagattgagcttagtggatcagtttcaggatctcatctgtccactccccattcaaaacggctgaaatcatgcttcccccaagttaatccagatattgtgcttccaagtaggttccatttacaagtcaaaggaatcattttctgtgctgcatgttccctgttgaactcacttttccttttcccattttggcagatggaagtgtttcttcagattttgcggagtctgccagattccacaaggtcttgcaaggtcaagaattgttgggtttaaaaactcgtgatggtactgttaatacagcttctcaggcgactgaggcaagaaattttcagtacactgatgaacgaagttgctctatcaacatgagtaacaatatcttaggggttccgagacttggggtgaaaactccaagtggaaaccctgggttttcctaccattgctcaggctttggggaatctcaaagattccaagaggtcttgcaaggtcaagaagtgtttcgtccttaccgaggagggactttgtccgatgcctgtataagaggttctggcttccgtcaacctgatggcaaccatgcacctggtgcagcatttaaatggcttgcaccacaaggatgtgatcatcatgggataaccacatcagttctgccgcaagcatcctctccatcatctgtcttaatgtttccacaaactagttcaaagatgcctggccttgaatacatatacggatgcctggatagaaatgagaatagccgacattttaagattggacctacacaagatatgacaagaactgatcaaacattacgactctggcctcatcttatttcaggcaaagtgctagatgagtgtacgagaaatgagaagctgcactctccagtcagtggtgctgagcatgaatcaaataacaagtgtcttaatacaaatggctgcaaaatctttggtatatcattgactgaaaaggcccaagcaggcgatgaagtggattgtggcaatgccagttatcattctcggctccagtctttaaaaccacagatgccaaaatcattgggcagcagttgtgccacggtaagtgctcaatgaaatgttcttttggcatcttcttcctgaaattgcttgctaaccgaattatttacaggtccatgaacaaaggcctgttgttggcagggtcgttgatatttcagcagtgaatacgatgatctgatacatttactgtatccagggagtatgcttgcagaaatagggaccaacattagtatcatactcactggtgctgaggacacaacttccattctggctatctcgtccctctacgtgcttgttgcctcaacttcagcatttccacaggctgtgctaccgcatccaggatgatgacaggggaaatgcagatgatacacgaaggatgcttgtcaagtttgttgtaatgcacttctaagttctaagctttgaacctcttaacgttgctcctattttaagctcccgttgtaatcggcatttatgttgcctgacctacttgcatatttttcaatttgtccgttaagacagcccttttagagggcttgcttatgttagcaacccttaatttccaaattccaagtatggcgaccgttcgaggggtttgtttgctcctgggacgacatcggtacatgacatagaatccattggtgacaccagggcacatcagaattaaggtgtagggcgaaacaatagaagctgaaagagcgatgctccggtgctttgatagcagtagaaataatcctaagggtacattagtaatatgatagtgatatggattaggggtaactttgaatattttttttttgtgtgtgtgtctcggtcggtctttaggtctgtcgtctccgtcatcgatcccacggtcgctttgtattgctcgctcgtccatcgaaaaagcgaaaagcaaaaagcgtcgctcgcttgtcgatcgtgactgagtcctcccgccggttgcacgtgtggatcgcgagtcctcccgccgatggcgaaacacttcggcggcccttctctgtgcattctccttcacgttctccattcatagctggcaacccgcttcgccgccgtacgtgcgcgcaggagcgccctcgatccaggcgggggtgccccgttcggaggctgctccgacgactttcggcgttggctgcgacgacccctctccgcgtgcggggcgagattagcgacgacgcccactttggaggattcgatccgttccagcggcgggtcctagtggcccttcccgcgtgctcccaattctatggacggcggccactccgatcctctggagccggccggttgcctgatcccctccgcgtgcgcgtgagacttgtggtggcgcccaattcggaagctacttcgatccattcctatgtcgatttcgcagtactcgtcgtgcgcgcgagacttgcacgaaccaccctcgccatcaccgtctcaggttaccccgccgtcgctgatccttgattcaaggacgttcgtcggctctatcaagtttaggtaaaaaattggggctttctcttagtttggccttaaccttctccgctattaattacagttttcttcccaaaagcaaaaaaaaaaaattggggctttaatttaagcgatggtagttttatagtatattggtactcccttcattccaaattaatttatcatataaccaaaataaaaacttccaaattgatcataaccatgaccccttcatttgatatgtagcattattgcatctatgcatgtaaattgagtctgcattcatgcatgcaggcatttagggatagttaaaggttcgtttcttgtgcatgtggaaagttaaagtatgcatgtttctttatttttcaccaccacatactcacattaaataaaaaatcaacccccacatactcgtattaaatgaaatatatggtagttaagtctacctttatctcgatgaaaaactcatataatcatccatatggaatggagtgagtatattggtattgacagtctgatcacagcgtgtgggctcgcttgttctgtgcaatgtattctaggagatacattttttctgtctagtgaagcttagagcacacaaagtgatatagtaatatgagagtactaaccgtcacatgtatctagtgctgtgtctatgcatagcaaaattcttcacgttaacgctaaaacactgtatttctgatcaaataatttgcaagatgcctaagctgcataaaagcatcaaaagcagcatacttcagatgacacttgttctaaagttcagaaattggcatcttacaacttacaagctgaaattactgaaaaacacttgcatgttcattctattatcaatctgaacagcaaagtgaaaggacgatatatgaaaccttacagtttgggatgacgcagggcaggaagttggcctcgtcaccgacgtgcatctgcttgtaccctggctcgtactcgcacctgtaccccatgaaccccatcgccgccatgcagttcctattcccacatgccaccgtcttgcatatcaaccctgctctcaaccattccaaccaaggccgtgtttagttgttttggcaaaatttctttgacgtatacggacacacatttgaagtattaaacgtagactaaaaacaaaataaattaaagattccgcctgcaaacagtgagacgaatctattaagcctaattaatccgtcattagtaaatgtttactgtagcaccacattatcaaatcatagcgtaattagactcaaaagattcgtctcgcaatttacatgcaaattgtgcaattggttttttttttctccacattgtgtccaatcatttaatgtgacgaaaaagttgtaagtttgagtgaactaaacacaacccaaatcatcaaaaaacaagacgatggattgaagaaaaataaccccttttccacattaatcgggaaaaaggattttactaatttacatgggcaatgagagagataaggttgtggattcaaagcaccgctcttgcccgacgcagcgtgtgcctctccatggatccatagcaacgccacacaacctaacaaccacaactcgccatcgacttcccaaaccccgaatcgcgtacctcaccaccttgcctagggtttcatgctcacaagggatcgaggaagataatcgagggacgacatgggccgaccctcgaggcttgtcgtgatggagcggccaacagggatgggggtagggcagggcgaccgtcgacggaggaatggtcgagcctgctacgactgaggaggagaggaaacggggctgggcgacaacgcctgctagtgctatgattggtcggtgctagtcgacagtagaggtggcagaagggaggagacgctaagcggggatgagaatagggggagcgacacgttcgtgtttgggcggcggcatcaaacgacttaggtggtgtttttttctcctgaaaataaagatgaagatgaagattaagtttttttttacataaaacgaggtggtattaacgtatgattgattgagttttaattgttacaaacttaaaaaatagattaatatgatattttagagtaactttcatatagaaagtttcgcacgaaaaacaccgtcagtttgaaaagcgtgccataaaaatcttaatcttcatcaaactcttcttagaaaagagttgctaggtttagttgctgataaatgacacttatactccttcactccagctttttctagataaaagtttccatccacgtttctattattgataactatggtggtagtagagataaatctgatcccttcgatcaaataagattaaacagtttaaattgctttctaatacctgtagagatcactgtactatgcctgtttgttgctggaggtttccaagcgaaacagtgtgcatggaaaatagatctatatgatttcttttactacattagttattttttttaaaaaaaatgaatcaatatgattttttaaaaaactttcgtatagaatttttttttaaaaaaatacaccgtttaacagtttggaaagttgcgcgtggaaaacgaggcaaagggagttgggagcgagcagttgcgatttacgaacagagcctaaagctgaaaaggatcttgaaagtactgctctttcaggcagcgctgctctgaaaatacgatagggtgtgagaacccgggtttatttaaccggtatgggaaactggtgagaacactttgtacacgctttcacagcaaagacataatgaggaaatgagtatacacgagtgggttactataaacatattttaaagagataaaaacaagtttaatagtatagccaacccatttatataatagttaagtataaaaatatacatcattaatacctggtctcacctgtcatacacacataacgtcttgtattccgtgttgcaagtagctacaaatatatagccaactttcttctctcttctcttttcttcttgttacgtggttatagctggcttatagcctgctattggacctgctctaaaagaggagagaggagagcagtgggctacagatttatagccgactgcagcacagactctaaaacacagtgtgtgtatgacatgtgagactagatattaataatatagtaagtagctattgtatgaattagctataaatgatttgaagccagtagttgactgtactattaaacttgctctaactcctagccttcttccttttggttgttgacgtcgaagaatcttcaaagtcgaacacccgtgctctgaatgcatccaggttgaccaacagataaagctggtcaagcagctttcagagaccgagtagaatacctgtggacgcaggaaacgagttactccctcgttttttaatagatgacgctgttgattttttctcacatatttgaccattcattttattcaaaaattttattcaaatgtataagatataaatcacacttaaaatattaaaatattatgagtgataaaacaactcatgacaaaataaattataattacataatttttttaataagacgaatggtcaaacatgtgagaaaaggtcaatggcgtcatctattaaaaaattaaaaaaccggaggtagtactatttattatccttcactaatcgaacaaagagcaccgctagtactgctttacgctgctttaatggacgatgaatgccatattacgtgaattaggccccctaacacctttctgtaaggaagttcagaaaacgtttcatatgcatgccattatctcttcttcagggaccaacttatatcgagggcgatgcgctaaaataatccgctacgttgccctggtttgtctgtgcatttttcgtacttacaagaaggctgctttctcttctttatgccaactggcaatggcatcctccaatccgctcagcaccaaaattcacgcgtctgttagacacgaaacaatggaaaattccagaaaagaaaaaaagacactgatatgtgtgcctacatataatatgtcagacacgtacctcacaaaccagccaaaccaccgaaaacaacaggacaggaatcttcgccagtcgagtccaagctatcatccaccgccaaatagatatgtttaaagtatgagaagggaagacttccgtctccagttgcggatcacatggtagcagtagcacagagccaatgatatcaaacaagagagttgtcaaagaaaaacaaaacaatggcaaagtttctctatctgatcatcctttcattcttcctctctcttttggtgttctgcacttctgcttcaccccggctgacattgcacaccggctcatctttctcggtggaagattacaagcatacattcctcacatcaccgaattccaccttctcatgcggcttctacccaattgggacaaacgccttcaccttctccatctggctcaccaacacggcgggcaaaacagtcgtctggtctgcgaatcgccggtcaccagtgaatgggcatggatcgaaggtgttgctgcatgatgatggctacctggtcctgatcgatgtcaatggttccacggtctggacgagcaccatgagtgcaggcgaggggtcgacggctgcgctgctggagagtggaaaccttgtggtcagagattcaagcggcacaatcttgtgggaaagcttcacttccccaacggataccttgctacctgcacagcaattgaccaaagacacgaggttagtatctggataccatagcctttacttcgacaacgacaatagccttcgtcttgtatacaacggacctgagttctcaagcatctactggccaaatgatgattacaccatgttccgggatggcatcaaagtcaagaacaactccaggcttgcagtcctcgatgacaaaggcggtttcttctcaagtgatgctcttacagtacaggcttctgattttggtctcgggatcaagagaagactgactcttgactatgatggcaacctccgtatatacagccttgacgcatcagatgggagttggacagtcacatggcaagccatagtggagatgcattatgtgcacggcatgtgtggaaagaatgggatttgtgagtacttaccagaacttcgttgttcgtgtcctcctggattcgagatggttgatccacagaattggagcaagggttgtagaccgacatttagctataattgtgggaaagagaggtacaagttcattgagattccccaaactgatttctatgactttgatcttggctttaaccagtccatctcatttgaagagtgccaaaatatctgcttgagcacgtgctcttgcattgctttctcttaccggctaactggaactggtgtttgttaccctaaaggcctcctgttcaatggttacaagtctcctgcattcccaggaactttatatcttaaagtgccctacagcacaaatttacaggcctcatcaacacaatcagctctcacatgctcccctggcagtcaggagattgcaacaccttcagatcacccaagatggctatatttctatatattccctggagtattcggagccttggaactaattttcattctaacagcttggtggtttctttccataaggaatgacattcagaattcagcagagggaggttacatgatgataagaaatcaattcagggggtttacttaccaagagctgaaggaagcaacaggaaaattcagggaagagcttggaagaggtagttctggaatcgtatacagaggagtactcaaagataagagggtcattgcagtgaagaagctcatcgatgtcacacgaggcgaagttgaattccaggcagaaatgagtgttatcggtaagataaaccacatgaatttggtcaggatatggggcttctgctcagaaggaaaacataagctactggtttatgaatatgtggagaatgagtcactggacaggtatctgttcaataccatgggtactgaaagattgctcgtgtggaaagatcgtttcaatattgccttgggagcagcaagggcactggcttatctccaccatgactgtcttgagtgggttttccattgtgatgtgaagcctgagaacatactcttgacccgagatttcgaagccaagatagcagacttcggactatcaaaattgtataagagagagggctccagcttcaacttctcacaaatgcgaggaacaatgggctacatggctccggagtgggcaactaatttgccaatcaatgcaaaggtagatgtctacagctatggagtggtgcttctggaaattgtggctggacagagaatttcaagtcatacaaccagggaagggaaagttaccaagttaaagcaatttatcgagaatgtaaaggaagctcttgctactggggatactaagtgcatagtggatggtaggctacatgggcaatttaattctgagcaggcaatggttatgttgatagttgctgtatcatgtcttgaagaagaaagaagcaagaggccgaccatgcatgaagttgtcaaaagtctcctggattgtgaagagtaaattggtcatttttgctaatcaatgaacctgaaagcagtagggacgaaaagcagtaagagaaggagtaagcttggcattgatagcaatgttttgcaaacatatgtactttctgacccatcaaggaaaaggataaggcattacttgtagtcctgtgtcatttagccaataaccatattttgtccttttcctgtgaaaatcaagataatgcagtgtttagttattgacttattttaagatttatcaggaattttatgtaatcttttaaaaaaatgtattttgtttttttcttttgttcttgagacatacaattgtaggtaaatctctcaggttctttaaagacagataagccgaaataaaaggggtatctagtccctgaagcactaacatagttattttcaattaatcagttccatgaaggatttagctggctattattgtaaaacaatgagatacaaaatttccatccaaaattcacaactttgtagcttgttctattagcaatagattataaatttatgtgaactatctttgtcaataattcaatttgatcaacagcacaaatgtaatttggcaaaccaaactgttctttgaggaaatgtcttatgttgtactgagtttttctctaatctttaacacaaatatgcgtacaatgaacaaaaaggtagatgtatgcaagtatgtaactcatgttaacttcccaccgcatgaaccatctagatcaacaacatcttgtacaaatatatgtagttcatgtcagtttcgagtcttcgactaaccataggctgctaatgttacccgctgagttaccaaatgcagcaacgaggcagagcaaaatcacgcatcagactatcagagcattgcataacaacgaagagaagagggaggcgtcacctagacggtgcctgctgggaccacgatggagggggtgtggggggtggggggtccaaacttctcgtcccctgcgcccaagcctctctgcctcttccatcaccggcacggtgtgggggattccgtatcgcctaccaacacctccaccacttgcctcgccggcatgtcgcggaggttggcaggatcgggttcaacgcgggggcctctcgtaggcgtacccgtccgtatctcgctctcgccgccgctcggaagcggtcgccggcgtcattatcggtctctctttttttttatttgacaccgtcattaccggtctcctaacaattgcacagaacaacaacatgccgcacgtgcgtatatatatatatatcagatcgaacggttaaaagacaacgggcctgttcattcatttcgataccattttcaaccataccattttttaccaaaattataaaaaaaaaatggctacgtttagtttgttgccaacttttgtcaatacataaaaaatcctagcaaaattttagtaaaaccagatatcccacgtcctttaactaatcaaaaccggtcacaaaaggtccctcgacggttttgatcccagtttggtcctacgtggctgctgagtcagcgtgggacccacttgggccccacgtgtcagggtaatccacgtcatcaccctccctttttctcctcttctctctttctgggcgaggcaaagcggtgggtgcagagggccagaggctagcaacgcgaggcgggaaagtggagggcggccggcggcgcgacggtaggccggtgcccgacggcggctgctatagcgggaaacacggcgacccggcggccccaacggtgatgtcatcgactgcgtgccgacgcacctgcagccatccggttcgggatgaagcagccacgcgccgccgacatcgtccgccccgactccaccaacgatggctgcaactcctgctcgcgcatgccgaggcggcctctgtgctggcgctcctcctgcgcgcgttcggctgcccttggcgagcggcgcacaccttggcctcagcctctgcttcgcgggggccgcgccgtaggccgtggacgtgccgcggctggtgctccacttcgacagcgctgggtcatggagtagcagagctcgagcacggggcagtgctacagagctcggggattacgtcgtagttgaacccgaacccgagatccacgcaccccttcagctcctctaggtcgtcgttgactcgtcggtcaagctcggcgcgtgccgccgccgccgtcacccccgctcctcgccgtacacgcgccgccgccgaagacgacgacgccgcagggctcctccttggcgaccaccaccggcttcgtcccccgtggtcacgccgcctcccgctgtacaccgcaccacacgtcttcggcctcgacctcgggcggcgcttccgctccgctcgtggcctgctaccgtcgtcgccccgctactccgccccgccttccgcgttccaacacggcgagccatgcccggcggcgagaggaccatcgccgcggccgtgcaaatccggcagctgagcggcgggatccatacgcagcggcggaggaggaggagaccgggagattggccgccgcacgctgctcctctcccgcgagccgccgcgcgccgctcctcttccacaggccgtcgcgcgccgctgcctcctcgtcggtgaagactcggaggaaatagaggtagagaggggagaggtggacgccgccccgttgcacaccgccgccttgccgctcctgttcgcccgccgccatcctcgccgcggtcgtttccccatccgccatgccgcgccgcttccccatccgccaccccactgcgcgtcgccgccctttcgctgtccgttgcctgtctcctccccatgctttagatgccgcccaactccaaggcttcccccaccggccgtgcgaggagctcggccgggctgctgccgccgtcgcccgccgtcgtggcgccgccctcctctcccgcctcaccccgccaaccggcctacaggcacagagagagagagaaagaggagtaactgaggaagagaagagagggagagtgacttagcctgacatgtggggcccacgtggggtcccatgctgactcagccgccacgtaggataaaaccggggttaaaaccacttaaggttctattgtgaccggttttgattaattaagggatgccggatatctggtttgcggtttggggacaattttgtaactcgatgacaagttgagggaccttcggtgtactttttctaaacttaataaggtttattttggctataatatgaaccgtctcaacaaatgtggattgctaccattggttgtgattcagttatcgggcagcctgactcatgagtcatgatgggcccagcccacctattgggggtgatcggaaaaacgcttctctctttcgagtagccacggccaccgccccgccggcagcttctcgccgtgtctgttcctccgtgagatagcatcaatggtggtgaccttttggtctccctcctgatgatgtcaagtactttgttggtccttagctgtttggcatggttgatttgatgatttgaggtgtgtttggttgactgtcatgtatgaatgggatatggccatccatatttagttggatatggcgattcaatttttgtttgttttgtagagatatgatgatccaatttcttatttggttggagggatatagtatggatgggaaaaaccaaaagttagtggggtccatttgtcatatatacttttttatcaaaatataatcatccgagatcttgttttaaagatttaaatataacaaatataatggtgtaatcaaatcataaattagataaacggtttaggataaaaaaatcatttggaagttgcttaacagaaaatcaaactaaccacaactaatcagaataggacacatcacccaatccaaaactggatggcttcatcgagccaaatcatccggatgcactcatctaacttattgagggaatattccctattccggaccgctccatttaccttgccctccaatcaaacaccacagaaaatcgagcggccatctcccatctagactcatctacctaaccaaactcaccatgcatcagcggaacggcaggaactctgcctacaatattcaaagagtatgcaaagctatcagctatggcacgtttagaaccaacaaaaaacaactaggacacctgattatcgtgagtaaaggaaagcttgtccaggtttgccgccaatcgtctttctccaaactttgtttcgtgagtcggcggaaagtccaaagtcgaaatcccgcgtccatgtgaatgcatgcatctagataacaggcataccaggtcatagagattccatatttccgtagaccaactcatgtatcgaggataaatgaagtggctgcccggtgttggtttttttgtcctttaattctgaaacaagggaaacttcttaagaatctcacacatcgcagttcagtttctatagaagtcctatgttctgtttagttcacactaaactttctctcaacttccaactttccatcacatcacatctaaaattttcctacacacacataaactcttaacttttttttttcaaactatcaactttccccaaacttcttctcaatttcaggaataaacaccgccctagtaaaagcacaattcttgcatcctattttccgaatggtattgcaataagtcagtttttcttctgtaagtcaacacaatccactaattctgaactaccatactttgactagcttcggtagtcatcagcgaccaaaagaaaggagagaacccaagctttccctttttcaaaataaaactttacgcagggtctcagaaagacattgtcactagtattttttacttaaaactcattccacaccacagtccacacaatcaaaacaaggaccctatgattaacaagaaaggaacaagagaacactacaaagtgatcagtaagaaacaatgcagaaacttttggcgtcatttaccagttttcagaagcgtaaatgtttgtgggggaagactgaatgagcctaacgctcttctagtgctatataaatacagaagaaatgcaccattccattcttccatgattccatcgaagtcacaagccaatcacgtatcttacacacttccgcacctgatcttcttccatcgaagtcacaagccaatgaactattagtaactggaagactgaggaattttgttctgaacaacattcctatgttgcccactcataccgtgccggaggtggttatctttaataccgatttcaaggccaagattctagcttgccattgggccacgtggcagcctcaaaatttagctacacacctcagaaatccttccacgtgtccatctgtatagttctatacctttctccagcttattggcacacatgagccacttgaactttgagataaatcttatagggaaaaagtgtcaagtagaaaaattacagattctagatgcttccaactatctagctgtttgcaacatctaggctccaagaggcattaaactgtttcattgaagataaatcataactgttttggggtaaaaaaacataatccagtaaaaaagaaggtgcagatgaccggctattacaaatacaagtgaggcgacggagagaaaagtggcatcgaggaagacagcataaatatatggtagtgactgaaatttttttactaggagtcggaacggatatatactagcaacttccaatgaaacatactacctccgactccgacttttaataaatgataccgttgactttttatccaacgtttaaccattcgtcttatttaaaaatttatgtaattataatttattttgttgtgagttgttttatcactcaaagtattttaagcaatatttatatcttatacatttgcataaattttttgaataaacaaatggtcaaacatgtgtttaaaagttagtgacaccatctattaaaaaagcggagggagtatatacggatttagtcctctttggatttttgtactataatttcttctttcgaaatttgtatgaaaaaaatatagaatagatttttatcgacaagataattatgaagcaaaagacttaggagtgtttttttcctcttactattatggattatgaagggcatgcttcacaagcttatggtttattatttgatttgttttaaatcagtacatcaactttataatatttaatccattcatttaagctctgaaataattgttatacaccagtttcatctatagtccatcatctatcgaaacttaatgctgcaggagcatcgtcaatcgaaacttaaatactgcaggagattaggctaataggatgatatgcaaaatagaatatttgatgaaaatcgagataactcttaaaaaatcctgtaaaattttcatattctaaacacaccttgaaaaatttacacgtgttatctagcgcgccatactaaaggtgtgctctacgacgtttgacgtgacttttaaaaattataaaaaagaaacctaatgagaccataaactataaaaactacaggatccaatttttaaatgtttcaaggagaataaatataagcatgtagatcggggaagcatataaagaaggtgtgacaaaaaaagtaaggggtagcatctgacgtgatttttaagaatcataaaattaaaacatgaggatgataaggtttggtcttgcaaaatcgtaagacaatgaaatagcgatttaacaaattttaagtaaaatcatattaaaaaatagataactctgtattgttgttagccgcgcagctagttacaagtaggagtagaagaaatccgaagagcttgctaaactagccacgaggacacgcttataaccaagaaaaaaaaatacttggcagacctgattaccgtgagtaaaggaaagcttgaacaggttcgctgtcaatcttttttccaaacgttgtcggtgacaaaaatttcaaagtcaaaattccgtgtccatgtgaatgcatgcatctacagacttacggttataccaggtcatagagattccatttttccatagaccaacactgtgtttagttccacgccaaaattgaaagtttgaaaaaattgaaacggtgtgacagaaaaattgaaagtttgtgtgtgtaggaaagttcgatgtgacggaaaagttgaaagttcgaagaaaaaagttagaatcaaaacagggccactcaggtatcttcttttctttaggactacactcaggtatcgagtcctgaattctagaacaagggggaatttttaaaaatctcacacattagagttcagttcctataaaagacaaggaaaaagaacaattcttgcatcacaaatggtattgcaataggaaattatttcttctgtaagagtcaatacaatccactcatccagtaccaccatacttagacgagctttccataatcatcagtaaccagaaaaagaaaagggagaacctaggcttccccttttcaaaataaactttacgcggattcagaaagatattttcgctagtatttagtcctagacaaagctcgttccacaccacagtccacacaatcaaaacaaggaccgttctcattgaaaaaaaggataaagaaaattatcaaatgatcagtaagaaacaaatggataaacttttggccatttaccagtcttcagaagcaaaaatgcttgtggaggaagacttaaatgatccttgaccccagattagaatagcgctcttctagtgctacataaatacagaacaaatgcatcattcccttccttcttccatctctgaagccaatcatatatctcatacacttatgcacctgatgtaatggaaacaattccctgcctcatcctcttttcgtcactacagattctggcattctcttctgcatcaccagagcatacactgggtaccggctcattcttatcggtagaagaatatgagaaaccatttctcatctcacccagcaatactttctcctttggtttctacgaaacaggtgacaacgccttctccctctccatctggttcaccaatacagtcgaaaaaaccgttgtttgggcagcaaactcagaatcaccagtgaatggtcatggctccaagctatcctttactcaggagggtagcttagtcctcagcgatgagaagggcttcgttgtgtgggatagcaagacaatgctaggacaggattctcgagttgctctacttgatacaggcaatcttgtcatcactgattccaagggtagtgttgtgtggcaaagctttgattcacccactgataccttgctacctttgcagctccttaccaaggacaaaaggttggtgtctgggtactatagcctctactatgacactgataatgtccctccggctcatatataatggaccagagatttcaagtccctattggccaaacccatctgagtcaatttttgattttggacgaactaactacaacagctccaggattggagtcctcgacaatactggtcatttcacgtcaagtgatggcctaaacatcattgcttctgactcaggtcttggaataaacagaaggctcacaattgatcaagatggcaatctcaagttgtacagcttaaataaagtggaaaaaagctggatagtcacatgggaggccatgccgcagcactgtgacgttcatggactatgtgggagaaatagcatatgtgagtattctcctggtcctcggtgttcctgtcttccaggttatgagatggctgatctagagaattggagcaaaggttgtcagccaatgttcacaaacaactacggccaagccatagggcaagtcatatttgtcgagatgcgtcatgttgaattttatggatatgatacgggatttaatatatccgtttcactggaagattgtgaggaattttgttctcaacaacgttcctgtgttgcctattcataccatgccggaagtggttattgctatactaaaggtatgctctacaacggccggaagactcaatccattactggaagcacatatttcaagctacccaaaacttgcaatatctcagaggtgaaacaacatggcttgacatgcagacattcacattctacatatgaaatgcatcgacaacacggaaagtggttgtatttctatacatgtgctgcaatatttggagggctagagttgttcttcacaacaacagcttgtttatttcttcgaagcaaacagaatattccaaagtcagtgatggatggttatgaattgatgactgagcacttcaggaaattctcatacagagaattgaaggaggctacaggaaattttaaggaagagcttggaagaggtggttctggagttgtttatagaggcgtacttgacagaaagaaagttgtgacagtgaaaagattaacaaatgcaacagaagctgaagaggagtttcaatcagaaataagtgtgattggcaggataaatcatgttaatttggtaaggacttggggctattgctcagaaggcaaacataaactattggtttatgattatgtggagaatgagtcactggacaagcatctctttgagagcatagatgcaaaaaaattacttcgatggaaccagaggttcaccatcgcattgggaacagcaaggggcttggcatacctccaccatgagtgccttgagtgggttgttcattgtgatgtgaagccagaaaacatactcttgacccaggactttgaagttaaaatagcagactttggcctagcgaagctatccaaaagggattgctcttgtttgcaattatcccatatgagaggaacagtaggatacatggctcctgaatgggcgttgaatttgcccattaacgcaaaggttgatgtttttagctatggaattgtgcttcttgaaattgtgatgggagctaggatttctagtcagacaacaacagaaggggagaaactggatttgacacaaattgtggaagcactaaagcaagttgtagcttgtggagatgttacacacatagtggatgctaagctgcatggacaatttaaccatctccaggccatggaaatggtgaagatttccttatcatgcataggagaaaggacaaagaggccaacaatggatgaaattaccaaagctctgatggcatgtggtgatgaagacaagtatgctgactgcacagaatagtatgtaacacataaatgcaaaccagtctcatcgaattaatcaaatgttacttcaaaagtataaaggcgaagcaaaaggaccattcaagagtcagggatgtaaaaagtagcacaagccaacttacaacttgttcatgccaatgaatgctattactacctctgtttcaggtataagactttttagcattgcccacattcatatagatattaatgaatctaggcacacatatatatctagattcattaacatatatatgaatgtgggcaatgctagaaagtcttataatatgaaatggagaaagtagtatttacgaatgatgtatgtttgtagattaagaattctctttaattatctttttccagttagttcccaagttctatataattcacagcctgatggttcctctttctgttaccacaccacttgttttcagaaaaaaaaaagattcatttactatctttgtttcatattataagactttttagcattaaccacattcatatatatatgttaatgaatctaaacatatatgtgtgcatagattcattaacatctacatgaatgtgggcaatgctagaaagtcttataacctgaaacggaagtaagttatagcaaatcagttcttcatgttaccagatttccttgttctcagctatatgaaagtgattgggacagggagatttgctcaaatgtagaacaaaggtaatggtacagagaaaaggataattaactaaaaagagcttccctacacgttcctgtggcttttcaatgaactattaataacctatactcctatagattcaagattactgcattttatctaaaagttctcgtcccgatctcttagagcagggtaaatttgttatttcaatttctagtaaccaaagctgctaatgctgccctctcagtaaccaaatgcagcaatgatccagagcaaaaccacgcgtcggtcagagcattgcataacagcgaagagaaagagggaggcgtcacctcgacgaacaagagccagcgccgtcaacctggccggcgagacggtggccggctgggaccgcgaagggggtccaaactgctcatcccccattccccctgcgcccaagcctcgccggatggccagccccctctccgcctcttccgtcgccggtacagcgtgggggtcccgtctcgcctgccaagccctccaccaccacctgcctcgtcggcatgtcgcggaggtaggcaggggcggggattcacgcggaggcctctcgtagcgtagttggctagcggcagcagcaggccgcttctcgttcgcgcgccgccgctcggcggaggtcgccaccgtcattatcgggcgcagccgataattcgaggggttttatgggaataacaacatcccgcacctacgtttctaaatcaaagctaccaatatcagatcggacagttcaaagttagcaagccttgaaccgctaccattggttgcggaacaaaaaaaattggtggagccgggcccgccgggggtgcaggcgtgcagcgcgcctcctccgtgctccctccgtctcagaaaaaaaaaggacttaattcttaggttttttatccaatgtttgaccgttcatcttatataaatttattttatgattagtatttttttttgttagatgataaaacataaataatacattatgtatgacttatcttcctgaacagagaacagtgaaggcggattagtgaggacgacgctttgtcaagtaggtgctacaaggtaatcaatatcaacatattagatatagtattttttttatttgtcatatcatataatcgagatacaatcataaaatcaggatactatcaaatttataaataacacattttatatataatcggtcgtggctgttctgatccaattgatgaatttcaagatgacttggtggtcacgaccgatcggagtggttcttttctggctgctcttctggttggaggcagtcatgttcttttctggctgctcttctggttggaggcagtcatcagttgcacctgttgtacccagtgagctttctttgatcatggaagaatgtatggaattcttggcaattaatgatatcacccggaggggggggggggtaaagtcatgtattatttttttgaaaaataataatgtcggtatttgtttgtcgattcttttctatggtgtcgcgtcttagagttgtctttgaagggaagtctagaattgactttttagcatggcttgagcgacattggtagacaaatgattattccttcttgaattcgatgttttggagggtgttatattcctagcgttctcctgattgtagttgaacacactgtcacagaaacaaatgatatgttaatttatgtgttcttttcttccttagttagtgtaagtggataggtcggatgatttcgttgttcagtttcattactaagaaaatattatgaaggtaaatatatttgtagttgcaaagccaggtagtttagtagtaattaactagtattgttaactaactcgtactcactggcacgtgcaattcacgtgtaggcgttgaccatataaaggaaaagggttgcgatattgtgggtggaagtatatccaatcaagataactaaggttacgtttagttctctttaaacttttaattttttcgtcacatcaaatgttttggacacatgtatggagtataaagctggacgaaaaaacaattgcacagtttgcatgtaaattacgagacgaatcttttgagcctaattacgccatgatttgacaatgtggtgctacagtaaatatttgctaatgatagattaattaggcttaatagatttgtaacgcagtttacagacataatctgtaatttattttgttattagtctacatttaatacttcaaatgtgtatccgtatacttaaaaaaaattaaaatggaactaacacggcctaacgctttgttctgctcattctcttccaagacttcacagttcacacccccacccgtagaaaaatgacttcctaccctccaacttgtcacgctagctgttgaaaaagacctccattgctgcgattggtgatacttctgcttctcttatgctacctccgttctaaattaaattaagtgtaaccatgggttttcgtatttagcatttaaccatccgtcttatttaaaagttttataaaaaaactattttaaaaattagtcacacataaaatattatttatattttatcatctaataataataaaaatattaatcataaaaaaatttcaattaaaatggacggtcaaacgttgaatataaacagtgcaaaactgtatttattttggacagaaggtagtatctctttggctacataaaataaaaaaaatagtttgaatttcaatttggacggagttcattaatcatccttgacgacataccctcgtttattctaacctgtcaaatataaatcaaatgcttaaaaaaaatctgaaatttttttttgctaagattgatacgacagtcgtttattattcctccaaaaagataattttgagctcaactgatctacaaattgataaacaaaataacaaactaacctttaagtttcacgagcactatccacggttagatttgtttcttcttaacttaatcgaattcaaacttccatgtatgtaaagtgatacatactccatctgtctcaaaaaaaaagacaaaacggggtttccgtgtctaacatttgactgtccgtcttatatgaaattttttttataattagtattttcattgttgttagatgataaaacatgattaataatttatgtgtaacttatctttttaattttttttatacttttcaaataagacgaacggtcaaacgttggacacggaaacctagggtttgccttttttgggacggagggagtatataccacaaagatctatgctgtgatatttcctaagattctttttactgtccaaatgattgcaaataatgaggagatattctcttaagaggcagaattgttttttttttttttgaaaggaatcagcacagactgtgctatatcattgaatagagaggtaaaaaagtactacccctatgggtgaaaggagaaaaaagaaactgtacaaggcgaaattaatctttgcactggccattgtccaagctcgtgcctcttcttttatttttgccattaggcttggggccgtcatctctttgtgttcaaagattctcctgttacgctccttccgaccgcaggtcttttttgggcacttccttcttgttggctatcatttcccaccaatcctgaacaccctgattggggcagaattgtttttccattttgaacccaattttcacatcgatgtttcgtattagacccacttttagtttatactttcactttaattcattttcttcttttttatgttttaacaaaactgatataaaaatatttggtgattgataaatactgctagcaaaagtcgtttattgattaaaacaaagagagcaattcacttcgcccctaatgcagctcgagtttggctcgatactccctcgcacgattttagatgtactctgacgtcttctgtggaccaaaaccgtacgttctatcatcacgcaactctattttaaggctccttagaacaacagatttttaaacaaattatagaggaatttattcttatagaaactttttgtttgatcatttggattaaagaaatagctatccaaaaatcctatgaaatttctttgaattagctcaaaacagagaaattttgtaggaattttgacgtgagtttcaacctcttgaaaaaaaaatcctttgcatctatctttattttgattcctacttttttctctccatccaaacacatttgttaaatagtcccacattggttgtggaagggcaaatgacctaaaatataagtgggggagcccctcacctcaatggagcttttggggtgggaaaggccctttacgatcctacaattggtatcagagcctggctaggttaacatctctggcccgatggacacgtgtgaaggcctgatggaccgtgggtacctgcggggcccgtatacctgatggaccgtgggccggtggggtctatacacggtgaaggggcggtgaagggctgagggacaccaatgtgtgaagggggagattgttgaatagtcccacattagttgtggaagggcaaatgacctaagatataagtgggggagcccctcacctcaatgtctagcttttggggtgggaaaggccctttacgatcctacaccatttctacaatgttgtcgtgttttcaaaatcatactcccttcgtccaaagaaagatgaatttagaactggatatgacatattacattataatacaatgtatctggacaaagatatgtccagatttgtattactaagatgtgtcacatccaatattatatcggttttaaatttgacggagagagtaagattgaaggtgttagtctgtttaaattcgtagtactaaaatgtagacagattcgtagtatttgattatgtgtcttatcatctaaaatcgaaagtatgacttatcgatccttatgtactttggaaatccactaccacggactcttgctgtcactatcggacagaagatatcaaaacagtttattttaaagtaataataaaaaaagcaagtggttatcagaaaggcgattcaacgcatccatctaattcatagtctacgtacgcatgcgttgcaggacccccttgctgtaccaaataattgcaagcaagtgacagtcagaaccctcgagcgtcatcaatttctcatgtgcgatatgattatctaaactctatcgaacgtgccaacttccatgcttttttttttttgaaggaatacaacttccatgcttaattgaggagtagttttgtccggctaatttgctagtctcggccaacccacatacagctagccaccatattttaagagctttatcatgcatatatgcgatttgccaaccaattgattcgagtccaactcaagactcgtagacgaaatcgatcatgtacacaggaagtacccagctaaaagtgaaatcaaaaccagcgtgtgctctgggtcttgccaatggacaaatgttccttttgtgattattactcaagaggaatttcccttcacgaacgaaaacggtcatatcaaatcggcatagcactagtgacggccacgactagttgaggactgaagaccagcaataatgacaatcgtaaactgatgaaatatcaaagtgattgtcagacaaagcgccattatcctgtcgcttacggctgcgtatgtccaaatcaagaatactacccgtactttgatttgcataatgattgcgttgaacgttggttgcttgatcatcttttatacactttgtcccataattttctttgcctttgtagaccgtagttcaaccaatgaaccaaacagcgagctgaaacgatggctggattggtcatcggctgcctggccgtgcagctctcgctggcgtctctgctgctgtgctcgtccgcgtcgacggcgcagcacacgctcggcaccggctcctccctgtcggtggcggaccggtcgcggccgttcctggtgtcgccggacggcaccttctcctgcggcttcattcaggccggcgacgacggcgacaacgccttctccttctccgtatggttcaccgccgccagggacggcgccgtcgtctggacggccaaccccgacgcccccgtgaacggcaggggctcgacgatctcgttccgccacgacggcgagctggccctcgccgacaccaacgggaccacggtgtgggcgagccggacgggcggcggcgggcggggcctgaccgtctccctccgcgacaccgggaacctcgtcatcgaggacccgtcgaccggccgcgccgtgtggcagagcttcgactggccgacggacacgctgctcccgtcgcagcggttcaccaaggacaccaagctcgtcgccggctacttcagcctctactacgacaacgacaacgtgctgcgcatgctctacgatggcccggagatcgccagcatctactggccgttgccgggggtgagcattttcgacttcggccggacaaactacaacagctcgaggatcgccatcctcgacgacgccggcgtcttccgctcctccgacaggctgcaagcccaggcctccgacatgggcgtcggcgtcaagaggcggctcaccatcgagcaggacggcaacctgagaatatacagcctgaacgcgtccaccggaggttgggcggtgacatgggcggcgctcagccagccgtgccaagctcacgggctgtgcggcaagaacggcctctgcgtgtacctgccgagcctccggtgctcgtgcccgccagggtacgagatgatcgaccgccgggactggaggaaaggctgccagccgatgttctccgtcggcaactgcagccagccggcggcgcctgagcggttcaagtctgtggtggtgccccaaaccgatttctacggctacgacctgatgttcaacgggtcctcgataacattcgagctatgcaggaaccagtgcctgagcgattgccagtgcgtcgccttctcctacaggttcgacggcgtcggcagatgcttcacgaaaggcaggcttttcaacggctacacgtcggcgaatttcccggggaacatctacctcaaggtgtccatcgacttcgacgaatcgtcgccattggtcagcgcgcggagcgccgccggcctcacgtgcaatcccaacgtctccatcgtgacagtgcccgctgccgtgtacgggatggctccaagaaacagcgggaagtggacctacctgtttgtgttcgccggtgtgctcggtgtcctggacctcctcttcatcgcgacagggtggtggttcctgtccagcaagcagagcatccccagctcgctggaggcagggtacaggagggtgatgacgagccagttcaggcggttcacgtaccgggagctcaaggacgtgacggccaacttcaaggaggagctcggccgcggcggctccggcgtggtgtaccgcggcgtgctcgacggcggtaaggtggtggccgtgaagaggctggcggtcgacgtgacgatgcagggggacgaggagttctgggccgagatgacggtgctcgggcggatcaaccatatgaaccttgtgaggatttggggattctgctccgagcgcaagcacaagctgctggtgtacgagtacgtggagaaccagtcgctggaccggcacctgttcgacacggccgaaggcggcggcggcatgtcgacgacgacgctggcgtggaaagatcggtacaagatcgcgctgggcacggcgaggggcctcgcctacctccaccacgagtgcctcgagtgggtcatccactgcgacatgaagccggagaacatcctcctgacgagggacttcgacgccaagatcgccgacttcgggctggccaagctgtcgaagcgggaccgcggcgccggcgtggagctcacccacatgagggggacgtcggggtacatggcgccggagtgggcgctgaacgtgcccatcaacgccaaggtggacgtgtacagcttcggcattgtgctgctggagatcgtggtcgggagccgggtggcggaccagaggacggaagccggcgagcggctgcagctgccgcagatcgcgcaggcgctgaggcatgtgctggacagtggcgatgtgaggtctctagttgatgccaggctgcaggggcagttcaaccctcgtcaggccatggagatggtgaggatttctctggcgtgtatggaggacaggaacagcaggccgaccatggacgacatcgccaaggctctcacggcgttcgatgacgaggacgaacaccccgcttaccggtcatgatcatcaccaggctaaccgttagcatagttcagcttagagcagcagtcagctgtgagtttaattcagcacttgaatttcaaatttaaggattatgaaattccgaaaaattgtagttaagacttcaaatcgagtatactcagtagaagtactatagtcagtattgagctcctccccaaatattaagcaatcagttgactgaaaaaaaaaagaaaaaaaaaagaaaagcactcccagaattctttgaaacaaaggtcccatcggttgcatacggctgattaaaaaccattacggcttattagtgataaaaaagatttatgagtaaaacttttatatatgtgtacttagcgtgtcggtgatatggctcggggtatgcgaagtgcgggggagttacctcctgatccagccacgtggccctacagcttggccctccccccgcgcctcggaagacccagaggcagccagggagcctcgggtgccacgtcacacccctcgggccctcgcgctgcctcgccctgaggccctcgctcaactgccatgtggcgaggggagcgagcggggaggagactcagactgaaccaccatcaatgcgcgccgccccaactgtccctcaccgcatttaatgcggtaagggcggacgtgcggtggggcccgtttgactcacgtcaatcaggcgtgaccaaactgtgactggcctgtcgccggtcacgtccgatcggacgggcggccgtgcccccacactcgcccctgtacccagcggagtggaggcaggtatgccccgtcccatcgaagtatcatccggagctccctccacgtgagaaggaccgccacaagtcttcatccatttaagacggaatgacacggctgtcccccgtgtcaggtggggggcggcgctgtgtcccactcaaggacggactgccgcttagcttccgggcgaagacacggatcgtggtccggtcaaggtaaagtggatccccctcccgtgaaagagtaggtagaagcggtgcatgtggtatccccttgaactataaaaggaggaccttgcccaccgagaaaagggacgacgctcagtaggcctgaactctaggaggagaagagcgagagtactctccggagtttaggaacctttgtaacactcaaccataaatcccacacacaggagtagggtattacgctccacaacggcccgaacctgtataatcttggcgcccgtacgcgatctagaaaccctcagggcggatacacgatctcgacaagcgagccttttcccccggccgaactcacaaaaggggatctcacgatctcccgctagagaggatcactcctcgacatagcgacttaaaagctaaagctaaaaaagaaaatctttgaaaaaacatcaaaatcaaatattaaaattcaaattttagcattggcttataactttatatgctataaggcaaacgatgaggctcaaacatcatcatataccttagcagaactgaattacaaatagtgtttttattccttcaaatttcagaacggtatggcatcccagcgcgctcacgctgccgatcgcgcccgtcgtgcctctctccatctctcatgcgcttcctcggtgcacgctaagccaattttgttatatatttgttgataagtgtttttctaaaaatttaacaaatgaaattatagtataatcgtaatataattacattggaacttgcatataaccgtaatataacctacacgtaactttcatataattttaaactattagatttgtttcaagattcatgtaagtgaggaaggaaaaaaatcacagcacacacatatgtgagaggattcagggtgtgttcggttgggcttttcaacttgcttttgcttttgtaaaagccaaaagccaaccaaatggtccaaaagtcacagctacttttgcccaaagtcagcttttggtatagtacaaatcaaaagcacctctactccctcattcatctgcttttgggggaaaaattagccacctcggccattacacaaaaaacgcttcacttcttctttcttttttctcccatccttccccccgtgcgtccctcctcctcacttcaccttcgccgtcgccgccgctcctcctccccccccggcgccgccgctcctccttgccgtcgaggccgactccatcaccgttgaggccgactccgccgccgcctgcgtctacctcccctccgccgccgttgcacgttctgcctccccgccgccgccgtcgaggccagctccgacgccgccgaggtcgactcccgcgtctgcctcctgcgcgttcgattccgccgccgacaccgtcgaggcctcctccgccgccacgcgcgtttgccgccgccgaggcctcctccgcgaccgccgccaccgccgctgaggtctccttcgccgccgcgcgtgtctgtcgccgccaccgccgctaaggccgacgccgcgcacgtttgtgttttttctttcctcttttttttccttcattttcccctcttttccaatgggtgtatgacatgtggagcccgcttgtaagtgggactagttatttcaaaagtcacaactgttgaaccaaacgagcttttccaaaagccacaccaatattccacagctacttttcgaaaagccacagcccacagctattttttcaaaagccacagctcaaccaaacacacctcagtccccacaaccttcatttcatagaaataacatgttttggagaaaattttttaaagttgaagatacatttacattgtaattacataaaaattacaatctaattgtattgtgattgtactataattacacaataaaggtacaggcaatccccgttgagctagttggcctgatagactggagggtggggagcgtggggctgggtgctgaggattcaattggaccgataatgagaggagatatatcctaatgggctgcacactgattggatcagcccaatagatgcatatctttcatgatcgtttatattagaaataagttcactttaactcccttaaagtgacccgaatctaatccgtaaccctgaaccgtaaaaccagaaatcttgacccctaaactattaaaaccggtgcaattttgactccccgggtggtttggagggcggtttcgctgacatggcggtgttgacttagtctccgtccgacgtggtgttgacgtggcgtttgtatggcattagaattaaaaaaaatgcaggacccatttgttattcgccaaaagaaatattgtgggacccacatgtcagcatctctctttgaccccttcttcctccctctctcccccttttctctctccctctctcctcgacaggggcgcgccgttgcagccgcgggcggtgaaggcagccgtggactcggcgttggtgctcacggcaaggggacaattgaggcaaagccgcgccatcctactgcggcgccagcgggatgacgacagggagcggcactgaggagactacaggcgacgagcttcatggttggtgagttatgaggaggaaggagagcccggagcagggggcggcatcctcctcgcccgccgctccgccccacttcggtcgatgggacaggagtcggagacggcgacgtcggcagagaggtcaacaccgacgccgcagccttgggagcaacaggtgcaccagcctgcccacgtcaccgtggtccccatcatagccagccctgcgccctagagctccctcgccgagctccgtaccgctggcgcctctctctctcaccatccctccatctcttcccccgatcctcaaccctgccccaccccaatcgaaaatggcagcatcggcggctcacatctagggcagcgttgccggtggctcacaggaggggaggagccaactggaggaggatgataaggcggcggcgtacgtagcaggtgggctcgttgttggtcattggaggcgaaggtgccagcctcgcgcgcgtgaggccggccaaacggtaggtcccatgtcgcctccgccctctcgccctccgccgccactccggcccccgcccgccgctgtcactggccctgctggccgaagggagagagagaaagagagagagataagggggagagagggaggaggaagaagggatagattgacatgtgggccccacatgtcagtgtgccccttttatttttcttgtgtgaatgacgaaggggtcctacgtgtatgtcttcaattctaatgccacctatgcaccatgtcaacggcagaccaggtcaacgctaccacgtggatgccacgtcagcgaaaccgctctccaaaaccatcgaggaagttaaattgcaccggttttaatagtttagggtgaagatatctggttttgcggttcaggatcacagattaaagtgaatcaaagtgaacttattccttcatattaggagaagtccattgtaggtcccttaaatatgggtcaacttaccacgtagcacctgccacgtcacaacgtccagccacggagggtccatgccattatgttgtccatgcggcggcgtggcatcaactggttcatgacaatttggatcgtcacaaatgttatgacgatgcctgttatcatgaacatctgtatcggacgactcgttttttttgtcacaataggtacggagcttccacagttctacgacgatgtttttttttatcacaagatcgttacagaacatgatttgtgatggaatcccgccggttcttgccaaaagtgccacttcaggaaagaccataactactagtagtgaatgatggccagattctgttgatatatggaacatatgagtaagaaggaaggggggggggggtggtttatgtgtatatcctaggtctatcttctattattgtcgaggatttcgacgagatggtggtcagatgtccgccggaggttgaactcctcatgctgttcgcagatattattagggctcgtttagtttttttttttcagttgcttatctttcgtttcgttgttcccctttctcctcttaattttagccctctcttggagtcgtgtactacccataggactcattgtattctaggagaccttgcatagagatattcttggtagtctctaatttaatcctagtcgagttcgagtatgtctcctacagtattttcaaagtagttctttattccttacgtgattggaatgtgatttctaagggaaaccatcccataaatatgtaggtattctatacggtattatttctaatgctataggtgtatgtcatgctttatacaccgacatcggtaataaaaattatatttgatatttgaaaaccaaacatgttcaaacttttgacattttgaccaataattttgtggttgattgatatagttgtattaccatcaaaaatttataaaattgtgatgcccagtaagtaattggagaaaaaaaagaaagaaagagagagagggaaaaaaaaaagcaaagctagcaacctattaacttaaggagcaaacagcagcagcagcaaaaaagcagcccagtactgtgctgtaagtgtaacatcgtgagtaaccgtagtaaaatttagtcccaatcgtccagccatgagagattgtgggcatcaccaatgtatatttaccaactactccctccgtcccataatataagagattttgagtttttcttgcactgtttgaccactcatcttattcaaaaaatttgtgcaaatataaaaaacgaaaagctgtacttaaagtactttgaataataaagtaagtaacaaaaaacataattacaaattttttttgaataagacaagtggttaaatagtgcaaacaaaaactcaaaatcccttatattatgagacggatggagtagtaaataaggtgtgacctagtaaaagtaggtatttattgttaaaagttccacaatgtataaccagtaataaggtaggttccaagataatgtaaagtttatcaccagccaatcgcatgaaggaagagggatgaggatcaatacatgccaaaagaataaatgttttttttactccttactacttggttgtagtgctcttacttgatagtagctatttactggttacacaatgcttactacttggtatgaagattaaaatattgcctattacctggtttgggagcacattgtggatgccgattaatgcccggtgactatttacttcagtttgaattgtctgtgtgaagcgagaacgaaaacgtaagagagttaaaagcgtatgtatgattcaactagatgagttggatccaaaaaccaatttcaggtcctaggcattacaaaaatctaataagctcatcatattatgctaccatttctaatgcatattacacatgcctatcaaagcttatgatattatgataccatttttattgcatacctacatatgctgtgtagaaccaagcatttgaggtattgatgatcaaagttccttttttttttataaattctatcatagacatcaaatactataagatttcgggtgtagttcacaccaaaattggaagtttggttgaaattagaacgatgtgatggaaaagttggaagtttgtgtgtgtaggaaagttttgatgtgatggaaaagttggaagtttgaagaaaaagtttggaactaaactcggggtgtgtttagttcacgccaaaattagaaatttggttgaaattgaaacgatgtacggaaaagttgtaagtttgtatgtgtagaaaagttttgatgtgatggaaaagttgaaagtttgaagaaaaagttgggaagtaaactcggagtcggccttacaaacagatgtaatatatccaatcaagaaaatagaaattaggttgttctgttcattctcgtccaagaatcgacgcctccgcccgttgttatgctcatcgtcttccaaaacttcacatctccaacttgtcacgctagctgttgaaaaagacctctattgtggcgattggtgatgcttcttcttctcttttactccctccgtttcactatgtaagtcattctagcatttctcacattcatattaatattaatgaatctagacatatgtatctatctagattcattaacatcaatatgaatatgggaaatgctagaatggcttacattgtgaaacatatgaaatatctctttggctggattgtataaagagagagagagaggaaggcatctatttggtgaggcattttatctgaaaaaaacatttatatgtgtcagggttatggataccacatacctaacagtagtcaactacatcttggcaggacccaccacatatcatgtcttatacggaaactgacctcggatatggagggagatccggataaggaaagacagccagagttctacatggaaacgatatggactactcggattgtatccatattggtttccctagttctacttagacaagaggacacctatgggtataaatacaaggccccctagcaggagagggggagacaatcaacacccaccacaatcgacagacacggaacaatagatcaaaacagaagccacattatacaagctaacatacgctaagacaagacgccggatatcgacttcagagataggcatggctagtcccctacggtgtctccggatactatcaggagagatgaaagcgctatctctgatctcgtcgagcccggattcgaggaggaagactaccctgttgtcgactacgagtcagagcttcagaccaccatgtcgacaacagttagataggctaccccaaatattgtactggtgtgattatgatgaataagagcaacgatcggcttcggccaacagaatgtagggttattacctaacaattcaggggcccgaacctgtataaaaatcctcgtctccgtctcttttacctaagtctcgcgtatatcctatgtcggtgacatgggatcgggagtatcatgactagaggtttgaggcagacacaatcgcccacgtggcctggcaccctcgggggacgtcgggcccgaaggtggtgtgttcgccctcctcttagtcccccgagggggtcgggctgcacccccctcggccccgagggccgaggcgccccgacccctcgtgggttttcgctccgcgtgtatggggtaggtgagcacagtggggctcacctaaccacatttattgcggtttggctgagcgtgtcacgacgcatgtaacgtagtgcattgcactcatttatccggtctgtgaccagtcacagaccggtcagatcgcgggattaggtggcgacaggcggtctgacgcacgcctcgccccatcccgtcaggacgagggcttctaggcgctcgtccccagctggagctagcgtgttacctcccagagatgacacgttagtcctgatcagatatatgccaggcttcatcctaaccattacaggcaaaatgtagtgtgaaggagggccaacgtgcagattgctaagctgacacgtggtggacaagaatgatcgatttgtgaccattctgacaccggtcatgtcgccagcagacagccatgattttacgtcgcacctgctcccggcgaaagtggaggtaggtgcgggccgtcccatcagaaggtgactcgaacggcaaccatgcagatctccgtccatttgtgaaaaggtagggtaagtccccataaaaaagggggggatggtgcatgtggtatccccttaagatataaaaggaggaccttgcccacggagagaaggggatagattttagagagagctttttcttggactggacctttccagattaggggcccagaacaagggagaggctggctgatactttgtagctctttcatacacagatctcccaaaaacacaggaatagggtattacgcttctcagcggcccgaacctgtatacatcgccggtgtcttctgtgcttcctgtctcgcgaaccttccacatacagattgggagtttagagtctcacccagggtccccggccgaatctgcaaaggggggccagcgcggtctcccggtgaggagccccacgctccgtcatcctagtaccaacgatcctcatactatacaaacaccggaatcgcgacatcaaacatcgacatcatgaatttttaatttttatttttacagggatacatgaatttttaatttgggatgtatacttacgaggagggttagagtctcatacatggataagtctaaattttgcgttatattaaataatgagaaaatggggattataccatcctcaaaacagggcttcgctgaaatgccatcctacaattggattcgcccaaataccactttcaactgagcccaacccgctgaaatgccatcccaaatcattttcatcaaaaataaaagattttactctacttttcacatgagttgacgaaattacccctcagtcaatttcatccttagaaatcaatcggctgggagagcgagacgcatagggttagggttttgtccgcggcgccgatctgggcgccgccgcacgacctccctaccgccgccgcgccgccttgcccttccctccagccgccgctccgtcgtgccctcccctcgcgacgacgcggtgcgccttccctcgcgccgacgctccgtgtcgtcgtccttcaccagcgccaccgcgccgcgttgcggccgtcccgtggcgccgacgaggtcgccgccctcccctcacgccgcggctctcccctggcgccgacgaggtctcccctcgcgccgcggctcggccggcgccctcccctcgcgccgacgcttggccggcgcgccctcccctcgcaccgcggatcggccggcgccctcccctagcgtcgcggctcggctggcagcctcccctcacgccgccctgcgctcggttgtactgcggcccctctccacgccggtctgtcgccgtctcagatctacttgcaggagtgatgcagatggattccaatgtttatgatatatgaactcagtttgagtgattatgcattttgtggttgggagtgatctgcgaatgatctgggaagcatgctcttaatgatgcttaactggtgttgtttgaatgctgttaatgatgcttaatgagtgattcttacgtggtgttgtttaaggcacgctcggtgtggtagttcctaggatgtaaaggtccttttttcatatgttcatcacatcctgtgtatatggtactctatatcctctaaatcgaatgaaccaggggtattttggtcatcaaagttgtgagaaaagagagaaaatgattttgatttactacaaatgaagagaatggcatttcagcgggttgggctcagttgaaagtggtatttgggcgaatcccaattgtaggatggcatttcagcgaagccctgttttgaggatggtataatccccattttctcattaaataatatagggtagaattggctcaaagttttgcaaatccgaacataaaatgcaactcaatacaaagacttacttgcatgctagtaattataagagcaagtttattagtatagtcaattgctagctctaaaatcatttacaaccaatctaatagtctactccatatacaatattgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggtcggaccactcctgcctcgcccccgagggccgaggcgccccgacccctcgcgggttctactccgcgtgtatgggttaggtgagcacagcggggctcaccgaaccgcatttattgcggctcgcctaaacgtgtcacgccgcacgaaatgcagtgcagtgcactcgtttatccggtctgtgaccagtcacagaccggtcagatcgcgggttaggtggcaacaggcggtctgacgcgcgcttcgccccatcccgtcaagacgagagcttctaggcactcgtccccagctggagctagcgtgttacctcccagagatggcacgttagccccggtcggatatatgccaggcttcatcctaaccattacaagcaagatgttgtgtgaagaagggcaaacatgcacgttgctaagctgacgcgtggtggacaagaatgaccgatttgtgaccggtctgacactgatcatgccgtcagcagacagccacgttcccacgacgcgcctgcctccggcagaagtggaggtaggtatgtgccgtcccgtcagaaggatgttcggagggcaaccgtgcaaatctccgtccatttatgaagagaagaaaagtccagtttggaaaggggggggtgcatgtggtatccccttgaaatataaaaggaggaccttgcccattgagaagaggggatttttctccagattcggaacctagaacaagggagaggttggctcacactttgtagctccttcatacacagatccaccaaaacacaggagtagggtattacgcttctcagcggcccgaacctgtatacatcgcctgtgcctcatgctctttcgataggtcgcgatctttccacatacagagagagcttgggatttcaccctgagcccccgaccgaaccggcaaagggggggcctgtgcggtctcccggtgaggagccccacgctccgtcatctggcgcgccaggtagggggcctcagcgtgtgtcttctgagctctcgcactctgccctgtgcaccaagcttttcctgttcagcctgatggccgagcaagcaaaggcgcacgacctctctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcgggcgatggaaaagaacggcgagatggggagcgtcgcctcctcgtctacggcgacggcagcacgccccagggcgcgctccaagctgcgggcgcgctcttacgccacccgcctgtcgtccctgacccggagtctccagcccaacgatggctggacgacgtggccaaattggtcatgacggcgcggcagtgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcaccaagaagaaaactgcagcggaaaataaaatctagcgaagctccagctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacattgaacagcacacccatgctgcacaggcccaaccattctgaacaaccatacccggctgtacagatctaatctccaaaccaagagctaagcaaattattatcaggtataacatccataattattgtgagaggtgtgggactaatcacgaaaaacattgctcaactcgcccataaccgcgggcacggctattcgaatagttttactcgggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgccccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgagctaccattaaaccatcattaaataataatgaatcataagttatcccaatagtgtgctaatgtttctaagcatggctaagcaatcacatctaatatctagctgaaccaatatataaagctcaactagtcaaattataataacccaaggtatcaaggattaaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcacgaaccttcgcaacgacggaaacgacaagctaacacgcaaaacgaagaaaaagactaataaaaaccaaataaacagtacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcagctcggcggagcggatagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgatggcgctccgacggtcttcggcggcggcgaagcggtggacggggacggcgacgacttggcgaacccgatggtggcgacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacacgtgggacccacctgtcagcgacaccgagagagagaagagtggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaataattccttttaaacaaccatttataagttaaggatttttaaacaagaaaagatcttaacaattatacttagatcattaatgatcaaataattactgaactattctttgtattatttaagaattgagctctgaaaaatccgagaaaatttcagagagttgacttaaccatggagaatttaacaaaaattaaatccatccatgctttagatttagaaaattttatttcccacattttacttcacttgaaagttaaagatcatttaatataaattctattaataatttattaaataatttataaatcctgaaacgaaaatcaggatgtgacaggcagcgcctagatgctggtggacggtcctccgccaccaaggcctctggtgctgctaccaccggctccgcgtcgtcaagacggagggcacgacgagcggcagccgctgttcgccgttcggctgccactccttcgtcgactccttcgacccgggaagatctgcgtggggagcaggacgcccacaccagcatcgagcgccggcgtaatgaccgaagtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgctgaaaaatatgatggcagcatcaaccccgccgagtttctccaggtctacacgaccgggattgaggccgccgggggtgatgacagggtcatggcgaatttctttcccatggccctgaaggggcaagcgcggggttggctaatgaacttgccacccgcgtctgtccactcctgggaggatttgtgccagcagttcactatgaactttcagggcacatatccgcgcccaggtgaagaagcggacttacacgcagtacagcgaagggatgatgagtcgcttcgctcgtacattcagcggttctgtcaagtccgcaacaccataccgtgcatccctgcacacgcggtaatttacgcgttcaggggggggcgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgctgctcaaacagggcggcgtgacaggaggaggaaaaagaggtcagtccattccgacgacgagggtcatgtcctcgccgtcgagggcgcttcgtgggccacccgaaaggggaggcctgcgagcgacaaaaagaaggaggccagcgctcccagcagggagcgccccaccggcaagtggtgcaccgtccacaacacctccctccatgaccttgcggactgtcgcgcagtcaaaagcttggctgagcggacaagaaagtgggaggaggagaggaggcaggggcgccgggaaggcaagtccccggcggttccttccggcaatcggcgaagtgaggccaagcagagggcccccgccgaggacatcgatgatggcgatgatgacctaggtttccaagagcctggggccaccattgccaccgtcgatgggggagcgtgtgctcacgtttctcgccggagcttcaaggctatgaagcgagagcttctggccgcggcccctactcatgaggcgacgcgtcgggcgcggtggtcggaggttgccctcacctttgaccagaccgaccacccaccgtgcgttgcccggggagggcagattgcgatggtggtttcccccaccgtttgcaatgtgaagttggggcgagtcctcattgatggaggagcagccctcaacatcctttcccccgcgacctttgacgccatcaaggccccggggatggtgctccggccgtcccagccgattatcggtgtgacgtcgggacacacttggccgctaggtcatatcgacctcccggtcaccttcggtggatccgccaatttccgtacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggtgacctcaaagtcgcgcttgcttgcatggagcagcgcgtagaccatctcgccgccgcgtccaagcccgagggtggcgatgagaggcttggcgcctccgcccccgctaccccgaggcagcggatgatcacatgcgacgaggtcccggtcaaggaggttgccctgggcgacggcccgtccaagaccacgcggatcggtggtcttctgaacggcaaataggaagacgcgctcgtctccttcctgcgggcaaatgctgacgtcttcgcatggagaccggcggatatgcccggggtccccagggaagtgattgagcaccgtctcgccgtacggccgggcgcaaggccggtccggcagaaagtgcggcgacaggccccggaacgtcaagccttcatccgcgaggaggtggcgcgacttctggaggccggattcatccgagaggtcatccatccggactggctggcgaacccggtggtcgttcccaaggtgaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12562 - DNA, 606 bp, Oryza sativa
gctcccccaaagaaggggaggagcttttcgaacacaagcgaccgcttggccaacccgggaaagacgaccccgccgccagcgcgctccacaccgccgccaagcccaacggcggcctcgccgaagccaatgttccgccgccacctcgccgcccaccaacggcgacccaggccgcccagcgtcgctggtcgcgcctccaacccgccacctccgcatggccaacgcgccgttgccgccgcctacgcgcggccctcgcgccgtcccgcgcatcccaggagacgtcgccgcgtcttgggttgccgggccgagcggccgtcgaaaagccgccgcaccgctgctgccgcgctgggcaggttgcgcctgcccgccgcctccgcgcccgggctagccgcaccacgctgccccaggcgcccgccgcctccgcgctcgggctgtccctgcagagccaccgccggtgagccgcagctgccctccgcctccgcgctcgagccaggccgaccgagctgtagccgcacgccgccgcgccgcctcaagccgcgtcgcgccgccggcgcgccagatctaggcgaggggtggccggattcggccttgggggcgccggatccgccg

SEQ ID NO: 12563 - DNA, 221 bp, Oryza sativa
aggcctcgtcgatacgcttaccgattccatcgagttgggcacaggccccattaagccacgagatgtacctggccgccgactcatcgggatctccgcggactactcgaagctccctgcatactctggccatggatgtgcagcaactcttcaagtacgagttaaaccatacctcacggcctcggagcgtttccacagcctgctctttcttcacggccagcatg

SEQ ID NO: 12564 - DNA, 683 bp, Oryza sativa
cattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgggtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgcatagttttcaatataaaaagatttgataactattgatatttatataaaaaaaatatagagcacagtacaaaatccccctcccccagggcggcaagggggcccctgcaaaattccatgcccc

SEQ ID NO: 12565 - DNA, 283 bp, Oryza sativa
ctttgaaccaaaatcaattattaggcacatcgagaacaaattcaagtacaccataagctatgcaaaggcctggagagccaaacaaaaagatcattgagatgaggtatggcacatttgaagcttgttatgataatttgcctcctttgttaaccaccattgcccagaggaataataatacttactatgacctacatacatttacatcggttgaagatagaacaaagagtgtgctgcaaagagcctttttctcattgggtgcttgcatcaatgcttttgtgcattg

SEQ ID NO: 12566 - DNA, 381 bp, Oryza sativa
ttaatatttacagaaataatctatcgaccaaaaaaattgcagaaatagcccctgccgccccaatggtgggcggcaagctgacgtggcagacggtgggtcgaccacgccgtctgccgccgtcggccaaaattgcgattagaccctagggcggcaaggggctaattgcaattttggccgcccataaagagcttgcggccgtaattttttcatctgggtcccttgccgccccaatagagagcgacaagggacccaaatgaaaaaagtacggccaaaagatatttctatgttatgttaataataaataaagaagtatttattggtaaaacttgttaatattgttataaaaatgtattgaagttggttgttgcgcaatttcatatg

SEQ ID NO: 12567 - DNA, 493 bp, Oryza sativa
tgcagcccggccgcttccgattcccccttgcagtctacatactccagacgccagccaggaaaggcgatccggacgtcgccggcgcgcgagattacctcaaacggcggcgaatccggccgcctcttgtactgctgagaatgaaaatcccggggggcgctccacacggcggcaaccgagatcggcggcgctgcctgcctgcctgcctcgagagccgtcggcggcggagctcgtgtgggaactcgagagggcgcgggcgcgggccggggtggactgtggagctccccggcgctacatgcggcgcagtccaccgcagtggagcgtggagaaccgcggcgatgggaaggggatgatgaaggaagttggtgaggacacctcagactcacagttcgatggctactttctcagttactcccccggttcaaaaccggagtcatttatttttcatatttataggtatactaataatctaaataaaataatatttttttatcta

SEQ ID NO: 12568 - DNA, 730 bp, Oryza sativa
acaatcttcttacacattatatggtgcaaatggcatagaaaaaatagcatgcctgtgataacctattccaaatcagtttgatacaaagatgtcagatatcggtgttttcaggaatcaggattcagaggtacatattgctggggcatcatacagattaagatctactagtatttgtgtgtgaggattctggcactacaatacctgagtacagtgacagtcctcttgtccctgaccagcaaagccacgtttcagcgatgctacttcgaaccatctaccaaagtagcgaattgggtcaaagttcttggcagtcatacccttcatcatcaaacctgtgccgccatcatcagaagggctatcgaatttcaaaggaaccccagccttgtcgatggctgctaccacaccaacctggcacaattttggctgtacaaaggtctctgcagggatagcctggtcaactatgagagattaagagtacatcgataccatgttacaagcctgaactggtaatctcactccattttccctcttctcttaattgaaattaacaagttttatgtatccaatcaaaattgcaccagtaaaattctctcaatcctcaacagtaaaaatatcttttcttaaaaaaaactgttcttgcttagtgatccagaggttatctctttgaattaccccgtgtttagttccaaagtttttcttcaaactaccaacttttccatcacatcaaaacttt

SEQ ID NO: 12569 - DNA, 9951 bp, Oryza sativa
ttgtgcaatttccatttctagagacatactagagatcatgtcaccctaggattgctaaacattgacataagagtgtgatttactttcctagagatataattgagccactatcaccctaggtttgcaaaacataaccgagttgcttagttagagttgaccctcaccaagcctagcaacttaggttagttttgattaggtgtcatttagttttaaatcgcctattcaccccccctctagtcgacatctcgatcctacaagtggtatcagagcttggtctctcttgattgagcttcaccgcctagagagaagatgtcgaacgaggtgaaccatgtagggaaggctcccatgtttaatggcacaaactactctacttggaaaattaaaatgtctactcacctcaaagctatgagcttccatatttagagtattgtggatgtaggctttgctatcaccggcacacccttgacggagattgatcaccgcaacctccaactcaatgcccaagcatgaatgccttgttcaactctttgagccaagaggagtttgatagagtgagcaaccttgagaccgcatatgagatttggaacaagttggcggagatccatgagggcacaagcgagtacaagaatgccaagcttcattttctcaagatctaatatgagacattctccatgttgcctcatgagagcgtgaatgacatgtatgggaggctcaatgttattgtgaatgatctcaaggggcttggggcaaactacaccgattttgaggttgcccaaaagatgcttagggctctaccggagaattatgagacccttttcaccatgctcatcaactccgacatgtcaaggatgacacccgcaagcctcttggggaagatcaacaccaatgacatgtacaagttgaagaagaaggagatggaggaagcctcaccttccaagaagtgcattgctctccaagccgaagttgaagacaagggcaagggcaaggtgaatgaagccaataaggacttggaggaagagattgcccatcttgctagaaggttcaatgatctcttgggaaggagaaaggagagaggaaggggctccaactcaaataggagaagaaatagaagacccaacaagactttctccaacttgaggtgctttgagtgtggtgagaagggacactttgcttccaagtgcccttccaaggatgatgatggagacaagtcatccaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgtaaagctccaagaacaagaagatggccgttgttgccatcaaggaggctccacactctttgctcaagggctcctctaaggtaacatctcttagtgatagtgagggtgatgatgattgtgatgatgtttcctatgatgagtttgtgagtatgtttgaggagctccaagcttataatgagaaggagattgtcaagttcaaggctctaaagaaggatcatgcttctttggatgtcttgtatgaggagctaaagacctctcatgagagactcaccatttctcatgagaagcttaaggaagctcatgacaacctcctttccactactcaacatggagctcacattgatgttggcatatcttgtgatttgcttgatgatagtgctacttgccatattgctcatgttgcatcatctagcattcctacctcttgtgatgatcttgtggatatgcctagctctagctctagctcttgtgtttctatttgcgatgcctcacttgttgttgagaataatgagcttaaggagcaagtggctaatgagacaagagtttggagaggtgcttcaagggtaagaacactcttgacaagattttgagtgaacaacggtgcatccttaacaaggagggacttggattcattccaaagaagggtaagaaaccttctcaccgtgccactcgttttgtcaagagcaatggtaagtattgctccaagtgtcgtgaggttgggcatttggtgagtgatttccccgatggtaagccttctaagacatgcatgtttgattctcattatatgcttaggaaggctcatgatggtagcattgttgctagatatgtgggttcccctatactcagtggtaaaaagaatgccatttgggtgcccaaagctttggtctctaacctccaaggacccaaacaagtttggatacctaaaagagcttgatcttcttttgtaggtgaactaccgcaccggtgggagccattgggtgcttgatagtggatgcactcaacacatgaccggtgatagggctatgttcaccacatttgaagtaggagggaatgaacaagagaaagtgacttttggagacaatagcaaaggaaaggtaattgggttaggtaaaattgctatctccaattatttgtcaattgataatgtctctcttgttaaatctctaaatttcaatttgctttcggttgctcaaatttgtgatcttggcttgtcatgtgctttcttccctcaagaggtgattgtttctagccttcttgacaagtcttgtgtgttcaagggttttcgatatggaaatctttatttggttgatttcaattctagtgaagcaaatttgaaaacttgtttagttgtaaaaacttcattgggttggctttggcataggaggctagctcatgttagcatgaatcaattgagtaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattggagcttttgcatatggatttgtttggcccaacaacctataagagcattggtggtaatagtcattgtcttgtgattgttgatgattattctcgctatacttgggtgttcttttttgcatgacaagtctattgttgccgagcttttcaaaaagtttgcaaaaagggcccaaaatgaatttaattgcactcttgtgaaaattagaagtgacaatggttccgagtttaagaataccaatatcgaggactattgtgatgatcttggtattaaacacgaactttccgctacctactcaccccaacaaaatggtgtagtggagaggaaaaatcgtacattgattgagatggcaaggactatgcttgatgaatatggtgtttccgattccttttgggcggaagccataaacaccgcttgctatgcaaccaataggctttatttgcatcatctcttgaaaaagacttcctatgagctaattgttgggaggaagccaaatgttgcctattttcgagtttttggttgcaagtgttatatttatcgaaagggtgttagactaaccaaatttgcaagtcggtgtgatgaagggtttcttctaggttatgcctcaaatagtaaggcataccgggtctacaacaagaacaaaggtattgtggaagaaaccgccaatgttcattttgatgagactaatggctcccaagaggggcacgagaatttggatgatgtaggtgatgaaggcttgatgagagctatgaagaacatgtctattagagatgtcaagcctattaaagtggaagacaaaccatccaccttcactcaagatgagccatctacttccgctacgccaagtcaagctcaagttgaagtggaggaggagaaggcacaagatccacctatgccacaaaggatacacaccgctctttccaaggatcacccaattgaccaagtgttgggtgacattagtaagggtgttcaaactcgatctcgtgtcgcttcgatttgtgaatattactcgtttgtttcttgccttgagccaaaacatgtagatgaagctctttgtgattcggattggataaatgctatgcatgaagagctcaacaactttgcaagaaacaaggtgtggacattggttaaaagacctagagatcacaatgtcatagggagaaagtgggtctttaggaacaaacaagatgagaacgggttggtggtgtgaaacaatgcaaggttggtggcacaaggtttcacacaagttgaaggtttggacttcggtgaaacttttgcccccgtggcaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaatcctaaccatgtttataaactctcaaaagctctttatggtttaaaacaagctcctagggcttggtatgaaagattgaaagattttcttttgtcaaaggatttcaaaattggaaaagttgacaccacccttttcacaaaaatcattggtgatgatttctttgtgtgtcaaatttatgttgatgacatcatatttggttttactaatgaggtattttgcaagtaatttggtgatttgatgtctaggggatttgagatgtccatgattggagagttgagcttcttccttggacttcaaatcaagcaactcaaggatgggacgttcgtgagccaaaccaagtacatcaaggatctactcaagaggtttggcttggaggatgcgaaacccatcaagacacctatggcaaccaacgggcatctcgaccttgatgagggaggtaaaccggtagatttaaagctttatcgttccatgattggtagcttgctttaccttaccgcatctaggccggatatcatgtttagtgtttgcatgtgtgcacggtttcaagccgctcctaaggagtgtcacttagtggccgtgaaaaggattctaagatatttaaagcatttctctactattggcttgtggtacccaaaaggtgctaaatttaagcttgttggctattccgactcggattatgccggttgcaaagtggatagaaagagcacatccgttagttgccaaatgcttggtatatcccttgtgtcatggtcatccaagaaacaaaactccgttgccctctctaccgccgaggcggaatatgtttcggcgggtagttgttgtgcccaattgctttggatgaaacaaacattgttgaactatgccatatccttcaccaaaaccccattcctatgtgacaatgatagtgtcataaagatagccaataacccggtccaacattctagaaccaagcatattgacatttgtcatcatttcctaagagaccatgttgccaagtgtgacatagtcattagccacataagaaccgaggatcaactagccgacatatttaccaagcctcttgatgaaacccgcttttgcaagttgagaaatgagttaaatgtcatagatttctctaatgtggcttgagatggtgcaccatggttgcttcttttgcattgtgtatatttgctctcattcgcacttatgctttggatttattgccatttggttcttcattgcagaaatggagcatgtcacattaagggggagttttgcactcttgcatgtgctctacttccttttatatgtgagcaaatcaactatagtggtgctagtagtattttcaaaatgtccaagtcaacataagtcaaaacttttgtaaaataaatgtaatttgaaaactatctcttggaaaatgtttcaaaagttttcctatatgttttccaagcctcacattgcaagaaaaatgatttttgaatgaaaatgccattttggccctcttttgaagaaactagattcttagttttggccaaaatgagatttatccccaaaatgagattgagaaggaatttgagaaaattttcaaaacaaagttggtagagaagaagatttgaaatgtttttggtattcaaacctattttaaaaaccaaatcattcaaaagttatttgaaaaccaatttggcccaaaaacccctatagaccataaaaggtcacctcatagcacttaagtgagttttgttgcaaatcatcataatcttcaaatattgtggatggttagcaatatttaaactcacacatttcaaaaattgctccaaaaatcaaatttttgttgaattttattgtgtgggggttgccggcttgtgcaagggctgtgcacagccggcagggggcctggcagtctgaccggcgctatatgcgcggtctgaccggccaggtgcggcggtctgaccggccacatagggccggtctgaccggccgaggtgggcccaggcagttttgccccttttcttctccatcccacacctaccctctcccatctcatccccattcacccccaacccgaaaaactctctctctctctcacctcccctcaaaccctaactctttcctccaccaaatcccctcagtttgaccgcagatttctctccggttacaccgtaagtgattctcctccgcttcctctctctattccatggattggtttgtgtttttgttgagtttttgattcatggcatggaaccctaggtgaagcacgaggtgttcttcgatttgcaccaatagagggtagtttcttggtgtgattcaactccttcaaccggtaaatcactctccctcttgtgcattcactcaaatcgatctatttcaacctctagggttaagggtagtttcctcttttggtccaatcttgatgaaatatgtccaaccctttgatattcatgttccaatcctatgctatattgttccagcaaattttagactcaaatgtgtagatgtgaaaattttttggatgcttgaacttgtgggaggaggtctgcccggagccacaggcggtctgaccgtgggtcagccgccggtctgactggcgtgtgcgccctgtctgaccggccagcagcctcggtctaaccggccaccagtgagcggtctgaccggccaccatgggcggtatgaccggccaccatgggcggtttgaccggcctgatgctgtcggtctgaccgccctactggctgcggtctgaccatccctccactggatataggcaaattttcacctctccaaattgtttctagaattattgctaatatcctatcatcctttgctttttgacagtgatgcctccccgcactcgccatggttgtcgtgcgcccactctggatcccatgagtgagcctgaggaatcgagcggagaggattacgctcaaagtgatgaagaggttgaggccaatgttgagggggctagtgaggaggcaagtggagatgatgtcagtggaagtggagaggatgaggatgaacaaagtgatgagatgaacattgatccctccatccagtttgtggtgaacatgaggaatccatcgcagtataccatcttaaggcatcatgatcagttcttgaggcctcgggacaccccggatccccattttcacaccgctttccagaagactgtgtatgagcaggtttatgcagggaaaacatttgtagagcataagtggatttcttggagagacatcaatgagactccagagtttgagagcttgcatgatctcttcaagactgttggcattgaccggattgtgaccctcaagcaagactacaatgaagatttgatccggcagtactatgctacagtgtgggtggctggagactagagtgagatgaagtggatgtccgacaccctccagtgttctatctctcgaaggcaattccggcagctcctcaacattcgcttggactttggagatgatttgcatgaggagcacactcacaatccgctctccatagactatctctctcagttctatgaagatggagtgcggtacacacatgggaaggttgccggcttgaggactatccccagtgtggttaaaaggattatgagagccactatcctccctcgccttggcaacaatgatgacattaggggggtggcttggcacgtcatcgatgcaatcattcagggccgtcagttcgacattgtgtctctcatgatgcaagagattgctatcttcaagaggacattcactcagggaatctattatgccccttacatcatgaggttgattcaagacaagcttggggctgctgggcaaaatttgaagaagcacaagcagtacaagccccgccttcagcctagagctccccgtgctcctaggacggtgccctcttctcaccctggagctagctcaagcccagcacctcctcctcctcatgggtatgatccaaatgcttctttcatcctcactatgcttactttggaatgcaacccaatgaatacttcaacccggtacttggggctattaataccttaagtgaaagcattcaacgcttgtctaccaggcatgaagcattgcatgaggatgttcgtggcttgcgcaccgatgttggagacttgaatgcttccatggggagattgcacactagagtgggtgcattggattctcgagtccaaatgttggagagcacccaagcttttgtatatcatcgtcgtcgtgatactcctaatccttcctctttggcgcttcctccttctcctccacaagaattaagacctttttggtacttgatgccaaaagggagagaaaaatgtccttaggtgtgctttatgtattgtgggttgggactaatggtagtgaggttagtgtcctcatatctaataggttaaggtggtttgagctatattatgtatgggtatgggctgttactctatattgtgtgttctttatcgttttgttgaactctatgtcatttggacccttcgtggtcttgtaatagcctatgtttatttgtgagcccttttaggatgatttgtgacttatgtgagttgaatggttaagtgatgtgaacttgtgcaatgatggatggtgtatgtgatactgatatatatatgaccatcttatgctcatggatgaatatttcttgaagttcacattgagatattgctcttgtgtttgtgatatgttgaattgtgaaattgaaatgtgcattggctccatatttgccatttgtgattgttatgcacatgtttagggggagcttttgatttcctttacagtatatgtccatgtgttctatgtttgattatatatattcgtggtgtttgttatcaattaccaaaaaggggcagattgaagcatctaggccctcgttgttaattttggtaattaatgacaagcgctaattgtggactaaccgttgctattgagatatattttaagttaggtccacgtcatgtgtgcgcatggatgactatcgatggattaaaatttgatggcgcgaagcgaagaaaagaaaacggtaaaactagtgctttagttttaaaattagtcgaggtgaagggcgatcaaatttgttagtttatttttttgtttcgccgtactatcaagggggtaatgacctagcaatgagatgatttttaattgacacattaggtcattatgcatttagacttgtgctcatatttcatctcacacacacaatcttttttgttttcactgggttcggcatgaccaggggcagtcagaccggccacatagtggtggtctgaccggcgtgccctggccggtctgatcggccacgaaacggcggtcagaccggccctctagaggctgggatggtgctgctcggggtggtcaatacagagccgacggagccgtattcggtcagaccgagctgatggcggtctgaccggccactcaacgtcggtctgaccggccaggccgatggggccctctgacagggttacaacggctagttttctagccgttgcagagtagcacggtctgaccggccacatacctccggtcagaccggcagagcacagagctgggggatttcgcccccaacggctagttttggttggtgggagtataaatactccccttccagcagcaagggggctctcttggcacccaattcaatt

SEQ ID NO: 12570 - DNA, 684 bp, Oryza sativa
ttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggtgcaggttgcgttatcggcccgccacttgaagtaactctgactgggtcaatccattgtacgaaagtgtgttgtcgtgagcataagttgttctagcaccatatgaatgaaaagaact

SEQ ID NO: 12571 - DNA, 604 bp, Oryza sativa
aaccgatgtaaatgtatgtaggtcatagtaagtattattattcttctgggcaatggtggctaacaaacgaggcaaattatcataagaagcttcgaatgtgccatacttcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagcttaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgtccaatgcttcaccgcctccttcatctcatctttatgagcataccttgcaccttcaattacctcgttctccttatactcatagggtacatgatcaccatctgatataacaagtccagagaagtcctcatttgcccaatcagaggccattaca

SEQ ID NO: 12572 - DNA, 563 bp, Oryza sativa
caagcagagataaaaaatattacttgtgtagatcaactctagttgagatgtccttaacaagacattcttgtctcttcccaaactatcgcatgacatggtacggaaggtggtactcaactgcccagaaacaaatcaattggcactggtacatgaagtaatcggagcctcgattgcacaacgagatcagtgtaagacttgtagcctcagtggtgtggtatggtaaccactcaatctataaatgttgaagagttgtcgtaggttagtatttcaatcatataagtaaatgacgaattagaagtgatagtggaagtacttatatgtgtaggctgtaggcagtccatcacgttgatgtactgcttgtatgcgacgtcccggtgagcatgtgcagtggctatactctcaaataggtaggccactgtcttctccatgtctggctcattgtagggccaaagggtaaagctttgcctccacttatgcttgccaaccggttgtcttagccacatccacatctgaatcaccagcacacaaccacttatgttggatgatggggcctggcgacaacc

SEQ ID NO: 12573 - DNA, 5678 bp, Oryza sativa
  unsure (1)..(5678): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttccacctctacaggcggtaaaggtttcaccgagttgggtcaatggcgcaatttgggaaaattgcaaaaaccacactaaatgtcatcctgattttgaaattcccctaataagattatttgcaaatacacagtcctaattcaccttgattcgatattcctcaacatttgccgttgttcgcattttttttccttttccctcatgtgttatatgacttagcgcatctaactcagtgtgacatttgggattgtttttacaatttttccacgcaaacaagatagcccatgtgttacgcccacatgtgcgattaggtatgaccgaattaagcaaaatgcccatggtcgagcgccctcctgttccacagctacactcagggccggtcctgggattttgaggccccagggcaaaaacttatatggaggcctctatatatatacataaactaatatatacatatttatatagtcttataaacacacacacaacatttaatattcgatgtgataaaattatctatatataacattttaaaacttcaaagagaaataaatagcagtagcgagcagagaaggtgaccggcggacgatcgacacgagcgtggctactagcgagccgcgatttgccgacttgttgtttccgtttgcaagacgccgagaagtccttgagagcgtaggagcagcgagcggcgtgatgtgatcgaggcggcacgatgcgagtggcgtgatgtgatcgaggcgaagcgacaggagagtcagatgaagatcgcttcggtttcgctgaaacaagcctaacaatggactaaaattcattttctgtattcggctattcagctgcctaacttaatatggacccatggcccatggactttatatactatatgtgtacaggggcccctagatttggggggcctcgagcggccgcacggcctgaccccctcccccccacccaaaacacacacaagggccagccctggctacactcaacctcccacaactctcctctccttcccttgctctaaccacttcattagcaaactttaaatgttttcttctaaattatttatttttcaattaaacccttctattatttgcaatttcatctttataacaatatattggtcgacgggttatatctgactatgatatttgagggacgtaggatatggctcataccaacatatgcatgagtatggaataaaaacatgggagacatgagttttatactggttcaggctctcgtaaagggtattggacctctccaatttatatgtattgagctagggtatatcacaaaagaagaggaagcaggctagctaatctagcctaccaaactaatctcgatgagcaagacaactggtaatactcggtggctagcagaaaaggcttcctcctagtgtgaactcgatgtggcctgatggaaagcttataattcgatacccctcctcggaggccctatatttataagaacatgacccgttgtgtaagtagaactcaggatcccaaataggatatgggcagataagaccttatcatccatatattggactacactgtccctcattaagtggatcagattccttcattgtccatatttttattcatacgtaggaacaccatatcgtataagaatagataaatacggtattcctggtgataataagtgcaagtatattaggtatgtcatatctacaacattgacaatatcacacaattatatcccgctgaaaatgatataaatatttcaaccgttataattcgttaaaattcaatgttccatgtaagagagtgtaatatttcaacataaatactaatatgtttcacacttaatgtttttgtagtgttcttttggatatttcaataactattttctatgttcttgtggttcctgtggatattttataatgtttcgacaagtacaattcgatgttttcatgtataatataaaatacttcaactagaaacataataattttttatccaaaatatatttatgtgagatcttactgtaaagacttatttacaataatagaacagtgtagttagatctcatatcagatagacaatatagtaaaaattagtttaaattttgcttaataaattattaagggaaagaagagagagaatggaagtggagacaagccgtgtgtgagaagtatgcatagcctgatgcacgcagaagtcatcatgcaaagagtggatagagaaagaacaagtgcagggagaggggtgggacaaatatttcgtgtttttattaggccaagtgtgtaggcgtctccgtgaattaatgagcgagatgattaattcgtgttgtgactagagtcatcaggccttcatgcccatatacatgcaatcatttagaatatattaaaagttatctaaataaaatttctatttgcaagacctttttgatatatttgaaaaagaattacaatattttagtcattactgaatatttttaaaatttgggtaaaattttgtaatagatactttttccaaaataaagtttcattttaaatttacaaaattcaattaattttctactaaaattttaaattttcaactcagttgttgaaactttcaactcaaaactcaaaatttgaaaaactctacccaatagttgattcttttcactccaaatataaaactttctaactcatattttaaaacttaactgatatttttaaaataactactatccgttgaggttggaaatggaatcggtattggtatagcgtcgaaaagtctgatgcgcagtcgaacacggtcacaacaagagggggcgaggtggaagaggagccgcactgctagtatgggcatgcataggtcaaggttcacaacagctgcggagctggaacagaacggaggggggtgcaccactttgccgaatatatgggcacattaatctaacagatagtgttttttttcatacatagaggggataataatgctctaactaatggtattttttttctgtagcagcacattgctctaactaatagtattcttgtacaacttttaacataaaaaattgaaatgtgataagcaagaaaaattcttaccaaaaataaagggtagaaggaagcctcgaaggaaaacaccatgaagagaaatttagccagtgcaggttgcaaaagtcctgaagccaggggcgaagccaagataaatgatcgctagggtcattactaaccgggtctatgttttcaaccagaacggattgaaaacaacgcaatttcgatgttccaacttgggacaaaagtagattttgagtgaaatttggaatagtttttcaagaattcaaatttgaaattgtaaaattaaaccaaattaataaaaaaatatcaaattttggtaaaaaaaaaagccatattgctatatttggaatctaattttaaatcgaattggtgaaccctgatacaatctgggtgtgttcagacctagctacgggatctgaacccttccctcccagcacgcaaaatagagcgaggttaccacatgattaattaagcattattagcttataaaaaacttgaaagataatagattaatatggtttttaaaacaattttctatagaaattattttgctagggaatttgaaaagttacgagccgctggccttatgcatggtctcaaatctcaaaaactcaaagtatatgcatattcggctgacatataaccataaatgctaggtaattttctatttgctgctgctagtattgtttctagttgtcaattggaatttaacacaacaatcaacaattaatgtcaccggggtctaatatttgttttcaccggggtcatagctggtaaaataaagaggatatgagaggttaaaataaaatcatcggggtctactgaccctggtaattgactgtacctttgcccctgcctgaagcagatgccttcgtttataatcttacaccagttatttaataaccacaaatttagatgttcaatagttcaaaccctaacctataatatggataaaacgaaaaagcactatcagtattcagtaatcacaataccttttgatttttgagatttatttggaacaaaaagtaaattagattagaagaagagtagaaagtcgatacctttcctgaaaacttttggccttttggagataacactagaggatgtcatgacgagttgagattagagaacacgatgatggagatgtgtatagcttgagatgtgtctaaccacgagatagcaattgatttccactactcggcgtcgacggcgatggccgatcagggctgctgatgtcgaatcgacaagcatcgggtcggcgacaggaaacgattgaggagagcgattcaagtggtatagaaggaagaaaaggagaaaaaaaaaagagaaaggtgaatgggcgggcggggcggggcggcgcgacaaagtcgcggggggatcgaggcgtcgctgccctctctggacgaccacaagatttggtgcttgcgagcccatgcaccagtgccttttgcttatgggaaaaaagtgcacttagactcctttaattgttcaccgaatctaattcgttacccttaactgtaaaaccgggtagaatgactccccgaattattaaaaccagtgcaatttgactcctccagtggttttggagagcggttttgcttacgtggcgctaatgtggcagtgctaacccggttttcattacacgtggcgcttatatagcatttagaattaaaaaaatatatgtggggcccatccgccattcaaacgcaaaatatatcatgggacccaccgacatatggaccacgtgtcatcctttttccttcccttcttcctcctccctctctctctctcccttctctctcttctctctcccccttttctcttccccctttcgaagcatcggtggcggcggcagccgggggctggagtggcgacggcagggtgcgggcgagggctggagcggcgacggcctcgccaccgcctgccccgtctccaagcagtcccgccgccactccccctctaggcccggccggtgctcggatccagcgcgaacccggatgttggaagcaagcagtaattatgcatgtgctacttaattgaatgtggaaatgtagatgaaatcgattttttttgactgaaatgaaatcgattgtgaaaatggatgaagaagcacacaaacctgtgagctgcagctgctgacgcagcgggcaatccgggagcagacagggacgacgagcttgtcgaagtggtgctggtcgaggatctcgacgatctcctcgagctcgtcggtaagcagcacctccttctggcaggtggtcgccggccagtggcggaggaagatgtcccggacgacggatgc

SEQ ID NO: 12574 - DNA, 2742 bp, Oryza sativa
ctgggggagaaaccctttgtagtcacggttcgtaacccccctttagtcccggttttcaaaccgggagtgccaatccgggactaaagatcgctatctttagtcccgggtgaaatacccgggagtaaagatcgatctttagtcccggttggtaatcgatctttagtcccggttggtaacaccacccgggactaaagatcgagctgacctttttttttttgcatgcccctgttggtgcatggtttatatatatatatatatatatatatatatatatatatatatatatatatatatatataaaccatgcatatatatgtttcaatacatatatatgcatacatatatatatgtatttatacatatatatgttatgcaaatgcatatgtatatagatatatatatgaacaaaatatatttacattatagaaaatatgtacacatgcatatagaaacatatatagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttactttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagagtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagtcgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgacttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactaggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtagcagcacgaggaggagtcggtgcaggatcctgaggagtcgatgctggagcctgaggtggagacggtgctggcggagcatgaggaggagacggtgcaggatcctgaggaggagatggcggagccagaggagatggtgcacgagacgccgcttgtcgcccagggaggatgatgtaccgcctgcgccatataataatggcatggcatgtgtttcgtagatgcgtctcaccgtctcctccagggtaatccagctcgaggtcctcgtacgcgcattcgaccaactcaacttcgaccttggagtatcctgctggaatcggcctgcagtggtaagtacctgaagggtccgttgggatggccatgcccgacgccaccttcatgttgtgagagattatttattagtaatcaacatatat

SEQ ID NO: 12575 - DNA, 2380 bp, Oryza sativa
cgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatctttgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagttgtcgcgcagcctcttgtatcttatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatcaacaaacctcgtcccagtaatccctaagtttgggaatgtgtcgaacttcggtgtctgccccttcagtataaacttctgggacagatctcctttaaagctctgaaactgttctgccattttcttcagagtccaccttttcactttgtcctctgtacccgcagaaagggtgaatgtctcgagcattgtggtccacagcatctctttctccgaatctgggacaaagctctcatgatctccgcttgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaatggagggttgactaccactagcctcctcctcctggttcccctccacatccctttccacgtgcccctgttggttcccctccgcatccctctccacgttcccttcctcgttcaagtactggtttggatcctcgttcccctcttcttcattccagtactggctgcttccctccgcgattgtatcgtacaatatctgttcctcatcacggtcagccatctgttgatacaagaaacatctgttaagtcacgagacatttatgttttaacaatctaagtcatgtatgctaagtgtaaatgttgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatatatatatatatacatatatatacatgtatatacatatatatacatgtatatatatatatacatgtatatatatatatatatatatatatattgcatttcacgttaacgttcgtcctcgttcgttcgctcgttgacgttccctagctcgttcacgttcgttcgctcgttctcattcacgttcgttcgcttgttctcattcacgttcgttccctcgtt

SEQ ID NO: 12576 - DNA, 20192 bp, Oryza sativa
attaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaataataattagcatatgaatgctagtaaattaaaagttaaaaactctaattaacatacatatgaaattgccacctgtgtgatttaaaacttttaaaaattgtaagtatcacatataactagcatatacatgatttaaactttgttgaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtaaaagggggttgcccatccaactgatcgtaatcctcatcagtcttgtcctcaactccgacgatttttcttttgcctgggagaaccacttgacgcttaggctcatcaggccctctgcccttctttcctttactagacatgtccttcacgaaaaagacttgcgttacatcattggcaaggacaaaaggttcgtccaagtatccaaccttgttaaggtcaacagttgtcatcccactgtcatcaatcattacgcctccaccagtcaacctaacccattggcaccggaacagaggaaccttgagaggaccatagtcaagttcccatatgtccttgatggaaccgtaatacgtggcagttgttccatcgtgtcccatggcatcgacacgaacagcgctgttctggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttccttgcgcgaactagagccaagcgctcctcgatgtaaggagctaccaatgaagagtgttgcagaacagtgaaatgagctttacggaataaattgttgtctaccgtctttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtaccttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttctttcacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatctgcggggtgtctcagcatcccgtcctgttgacgctcttcagcgtgccatcgcaacattctagcattccccttgttcctgaacaaacgccttagccgtggtattatatggaaataccacatcaccttagcaggaattctcttctttgtaagctgccggtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccaccggaagaatgttcttaatgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctagcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcaaaatactccttctgattcttacacttattgcatggacaacaaataaaacccctttgcctgttagcttcggccactctcaaaaaatagtgcacgccgtcaataaactctttggaccgccggtcagcgtacatccatttccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaaccggggctaaagatcaccgggatctttagtcccggttggtaataccaaccgggactaaagttaagatctttagtcccggttggtgttaccaaccggggctaaagatcccgggggggcctgacaggtcctgacagcattcgaaccgggactaaagatgatgtttagtcccggttggtaacacaaaccgggactaaagatcaaatatgcccgtttcccttttgaaccgggactaaagatcatctttagccccggtttttattgcatccgggactattgtggaaatcggccgaccgacgaaagatggtttctccaccagtgcacgatccacgggagcagcaccatcacggggacctcgtcgtcgagcacgtcggacggcggcgggagcgacgacgggtaggcggacggcggcattgcccagaggtaggaacaagttggcggcgaccatcttgaccagcgccaccatcacccggtggtccagcccctgcagcggctgcttcttcccgctcgccacgtcagcaccacgtgagcaaaaccaccctccaaaaccgctggaggagtcaaattacactagtttcaataattcagggagtcgtcctacctgattttatagttaagggtaacgaattagattcggtgaacaattaaggaagtctaagtggactttttcctttcttatgaggggttcccatatgacaaaaaggagggttaagcacaaaaaatttaaattgggccgggtgcctgggaacccctgagcctattgagctccaccttggttcacaaggtttgtcatgccaaccccaagccgacaacctcctgcagcaccaccaccgccttcttggatcacaccaccaccaagctcgagcacacatagctctgtttatgcatgaatatgaactcgtgcatggaccagccaccattaatctgagtacccagtgcaagcatcgggaattggggatggggtgcacaatgatagaaaccacatgagattggaacaattcaacaacataaaacgcaagttttgatgttgtggatcggtagcttttctgaatctcgatcgatcggtaggcactgatcgcactaccgctgcttgtgcgtgccacgtccttttgccacatgttaccatcacatgatccagggcacgttatgcacgacgctacaagctccacgtgaacgcagctggttaacaaattgtgcacttgatcaagaaacagatctgcaagcgaaaacagagcaaaataaaacttggagtaagcatgcagagttattccaagacgggattggagttttgggcaagcctcccgattggtttgaaccaaccaaggaggaaacatgatggagtggccagcatgctgagtaggggattgcgagaagtgcaggccgggggccagatgggaggctttggagctaaacgtatgctcgtggacaaggggatcgaaggtggatgaaaagattggatggcacagaagagaagccctgtagcaacgctagttgcactgagattcatcgtggcactgttggtggggtcatgaaaactaaggatcccatacgatatctaaagtcttcaaaccaactgggaaatgcagcgccctcagcgttttgcgctgccgtggccatcacggggtcacgacgcgtggacacgcgctggagagcggatggatttcacggccttacatgcgtccgcgtcgcctctgcaaattttgcagaaaagccctctcttttatagatattttgttatacgtcctctctgttcttttctcggtttaaaatattgcgtttaggcccttcgcatcctacgaaattcaatacataggagacaaaaagaggaaaaaaggactgcgccctgaatcctggaaactgaagggtattttcacaaaatttccttttctttctctctctctccccttcgcgagaatcccaggcgcgtaaaaaaaaggaaaaaactcccagccgccatgtccctctcatctctctcgctctctcctgcgcggcgcctggatttggcttggccgtggccgccgctgggtgtcctcccagtgccgtgaccgccgtcgggtgtcctccctacgctgctgccattctccgctcgaaggggatcgatgttgtggatgggtggtgtcctcgcagcaccctcattgccggtgctctccttgctacgccgctgccgacgcagactcgaaggggaggctctgggtgttggatgcggcagccgcgatttctttgccggcggatccggtggctcatcaatggcgtccacgccagcggtttttcctcagtggtgagctccagagggaaagggcaagctcacccaccctttctttcttcacaatttccctctctgtctgatccagatccaaagctgatgggaaagttcgatttaggacattcagggttgtcgggtgtgttgagctcggtggtggcggcagtgagaaattggacattatgccactgctaagagtgggtttcgccaaaatatcattccgccgaatggattcgttaaaatgccacgcacaagagatactaaacatttattttgccatttgaaccaattttctccatttccacccaatttcgcacccgggctgaccaaaatgccccttcgagctgcttcgttctccacctgccgtaacacctcctccggctgcgttgccgccgactgcgcggatgacctcgcggcgcccagcggcgctggcacggaccagtactctgccgtgatgcccgagaactcctccgtcacgttcggcgacgacgaggccgacaacgggtcgcaccgcagcgaaggcgacgagcccgaagccaagcgctagtgatattgattcatggcaggagtgttgtgttcaaaaagacatgtggattggggatcatatactagtgtgaagcgtggactgaatgtagcaaattgaaatttccatcctccatatagtgtaaaagctcaacatggattctcccccacggcatgcatattgtcttttattcagaaaaaaatttagttagttgaattgttgagtaattgattaagatctgatctagttcagttctcttctacatgtcatatcagatcatgcaacttccgatatttcaacccttgcgggagaagtatcaaacgcacttcagttcatggttctgggacaaggtttttcctctagcaggagatgtgtccttgaagaatttcggtataggagacgctagactggctgaagatataaggaaagaaacaaatattattgttcacatggctgcgacagtaaacttcgcagaaaggtaaaacaaggttactggttactttaagatttattcaagttattaacgctaatcataagtgcagatatgatacagcgttggcaataaacactatgggtgtgaagcatatgatagattttgcatcaaaatgcacaaacctagagctcgttcttcttgtgtcaacaggtgaaacctaaaatttacctatggctatgctacttatccaataacaatgatttcttgttaaatgacatatttgtttctaaatttcagcttatgtcaatctaatgaaacaagcttatgtcaatctaatgaaacaagggatcatgatggagaagccgcttcaacaatggaggagttatgatggtcgatcagatctagatatttcagaagagatggcatttaaggatgaaaagttgaaggagctagtttacaacaatgcttcagaacgtaccataagacacaccatgaaaaagataggcgcacaaaggtttcacacataattttattcattgctattcgctagacttctagtactttttatgtgatacatcattaggaacaacattattaagacaaccgtcgcatgatgactaaatagagctaagaagtttggatgggcgaatgcctatgtgttcacaaaagcaatgggtgagatgctggcatatgaacaaaactcacggctcccaattgttatcatccgtccatcagccacaacaagcacatggaaggagccttttcctggatggatagaaggagccaagtcagtccatcactgtccaggaccattaattaattacttgcattattaatcaacagcaaactcactttgaaatacaccctgtggatttggtgcagagcaattgacacatggatcactaactatggtaaggggacactgaagttttttcctacagatgtggcaacagtcatagacattgtaagatactatcttcctgtactattgggcataaggaattgatcgattggtgtagagcaagactaggatttaggctttgtttgaaagcgggtttaatttttacttttttgccgcacgtgaaacataaatatcattagcgtacgatttattaactattacaaacttgaaagatttgtttatttgattttttaaataaattgatgaaaatacgtagtacaatttagcaatttgaaaaaatgctcacggtaaacaaggaaatttcaaaagttaaacgtggaaaggaatggagccttagtgtaccaccatcatctatttgacctatataattgtaaaatttaatacatatggactcaatgtattaccatttttgagtaatctatccttgcaggtacctgcagacattgtggtcaatgcgatgctttgtattatcagctaccatcctcaaggaacagcagacttcatctatcagattggttcttccatgagcaacccgatcaagcttggccagatgtctcaaacaacgtacaaatacttctcgcagataccattcgtcggtgcaaaaggagatgtagtcaaggtgaaacaaccgaattttctagcaacaatggccagcttctacgagaccatggataaacactacaaaatgcctttgcaggttagtttgttcttgttaaacctcacttcgacaatgtttttttggctactttctcacagagtgggtcattatttccgcttgcaggatatgttgcgccgtgggttatctaccactgaagaccgtcatatttacaaccatctcaagagagagtatgattttactgttgccgtggcagaggtatactggccattcacaatatccaaaacgaggtaatgtagatgtaactccaagaataaataaaaaagaaaagatttctttgatcaagagctggtcccattttgtaccctttcttgtaggttcgatgactcgaaaatgcagaatcttatgggaatggttactgaaagagaccgagaattgataccctgtaatataaagttcatcaattgggacaagtactttatggaaactcacatccccggtgtcatggattatgagtcaagggaattgacaagagctaggctatagaagttcctcataaagctgcaagccttctctgaatgccacatagattgaaataaatcctttcaggtgcaccactcaccgttgaggatttatccgagacatttatatgttttagtgagtcgatgtttgtgatgtactcctcccttcccaaattatagagtacctttattttaagggaaaatcaaacttgatattttttttactactgattatactaacaatatctatgccaagtattatgcatgttatatcactaaattcgtagtttaaaatactttcatttcaaattggttacctatatatgaaaatcaataattatggcgctctgtcttttcctgtcctcctcggtggcgattccaatggatcatggcgtgctgtaactccgagcaaagggaaaaaaaatgtgcactgagaaaaaatgagcaaagggaaaaaaaatgtgcactaagaaacatgaaaccagctaggcatgcatatgaagcaatcttagaaataatttgtcatactctctggcagctagcaagtggacccagacaaacagagaaaatatcaatagttgttccaattaatttgggggccaatttctattcatattaacaacttctcggaaccaatgatggcaagagtttataacagtaaaataatttaaaactatagaaggaccctaatccaaacagttgtcaactggcacatgcaccaactaagatggtcactgatattccccgcaaaaaaaaaagatggtcactgatatgcatgttcttggaccaaccagaaataatatttttttcattcaatcagctcctatttacaaggaaaactctttgagaaattgagaccatggacacaggaaacctacacacaccaagttcaaagggtatacacacaaaattcactcaaatccaagaataatcatcacttatgcaccatttatgtaagaatcagcacctatacatcacatatacacacaaaattcactcaattccaagaatattcatcacttatacaccatttatgtaagaattagcatctatacatcgcatatacctcataatttgacttctctacaatcaagaagcacctaattgcgtcaaataaagataaatattgcaatacttcttttaaaaactgctttttctacataatactgtatgaatcaggaaggacaaatactgaacatcacatgcccaaattttgatctttcccagaaaacatataggaataagaagtttataaattaaaatctactcccttcatttcaggttacaagacgttttgactttggtcaaagtcaaattgtttcaattttgactaagtttatagacaaatatagtaatgtttatattactaaattagtttatcaaatcaatattcgaatatattttcataataaatttgtcttggattaaaaatattactatttttttctacaaacttggtcaaacttaaagcagtttgacttttgactaaagtcaaaacgttttataacctgaaacgaagggagtaattctgtaaacagatattgttgcctagaatatttctttaaacaccatcacctgtatagttgtaagaatcatttatatgacaccaccattttatatgaggcggcagtgcagcacctaaacatacctcctaaatctacttctttagaatgaattagcacctaaatgtcctactgcagcctgcaggatcacaatagtaccagaaaatcacaatatctctgttgtgtgtcaacaagtgaaaaaaacaaacaaaaacataccagccttatatcctcctctgttgatagtacattttcctcttaggatcaacagcagcttctggggaagcagtcacacggtgacggcgtgcagatctggagctcgaaggctttgccttggctgtgtttgggggcgatggaggtggagctggcgggcccggcggctgcgtacagaagggggaaaacgatggaggttggaatgggatcaccgggtgtgaggggaaaggagaaggctggctggcagattgagataaactagccactaagttcggaccttgcaaaaaatgagcgaatgcagcagccatgcttggatccatcgcaacctagggtttacatcacgttgagaggggaaaaaaaatcaaaaattgaagaatcaattcgaccaaatgatttagggttccacaccgacgtacctccgtccgcagcgagtaccccggcgatgggcgaagaggcgggttgctgcgagaggaagggcaatggtgagtttgtgaccgagggcgagcacgggaggggggcaaaattatggcacgcgtggaagggcgtctctgggcccggtaggggaaatagaatgcaccgagtgcccagaaggccgagcgggggcccggaaaaaagggtgatggcgagggcgagggcacggaaagggcgaatccgggatgcggaggtcggtgcacgcgcctgggacgaggaaaagccattcgtcccacagcgcacccaccaccctttttcctagttgcgcgcggcttcgatatcgcccaagaacacgttgcttcagttggacgcgtggacttcattttggtgggcccggctgcaaacgtggcatcgatgtcacaccgggagtttccttttccgtagtttctaattcactaataaattgtctatagaaattgttttggttaactaggagaaaatacaaattaacaatgtgtctaataatcggaattatcaaggagaatttttttttaattctctttgctctgaaatcattaacatgacttaaagaggaatatccagagcatcggaattaacgttgttaatgtaaattcataagatttgaagttataatattttttctctcccgtctttggtctcgaatcgtgcccaattcactcacctctctgtccgcggttccattttgcaagacaagtcgtgtctgtttttgttcgcgggttctatttccgttcttttcctaaaacggcaccgtatttcttttccaatttggggaagttcctttactaatccttttcctatttttcctccccctctcccctctgccgcgcgccgccctctccctgtctagtccgagttagcctcctcctctcccccctctcccgactcccctctgccccacatcctttagtttttctcctcacctatataagttagaacaacccccccccttttttttcctatttgttttgtttgtccctagtcctagctagccgctgccgccgcctagccctagtgccgcgccgatgctcaccgctgtcccaccaccaccggtcagtgccgccacctcccgtcgtcgccatcatcaccctagcgtcgccggtaatccattttccttctctttgtcatggctatcaccattatctatccggttctaatttgtctctgtcttaggttttgatctaacctcgccgtcgtctccacgtgttgtcgctggaccgtcgttgttgtctcctcctcgcagatcatctcggtttggtgaggaatctatccgtaatctcctgtttagggtgttaattctttttagtgtcgtcgttgaaaccctagttgtttagcccatcaaaaccctagccgccctgcaccgccgctgctggttccgttcgccggtttggttgaccgtttgcatggtcccgtgtcacgaaggattggctcgctgagtcgttaattcgtgagacttgcttaccggaggtttatttccattgatctattttatctttgggcaataatatgtaataattgattaaggtttttcggttattagtaataacgcagctcatattgtaaaattcataactaaataatccgagctccgttttaacccattcaaattgcagtgaatccattaaaatgtatagaatccataaaatcggtttcttttgttgtttcggtagccttattgcttgtatttcttctgtgctttgtttgtcatttagatttcggcaattctggtgatcacgtttacttcgaattggtcgccatggttcagtcagctcaagagcaaggcaagttatacatacatcattgatcatgtgaagcctattttataaaatctcctgctttctatcaacttgcattgctttagaatgtcatgtgggatggatgcctatcgtactcagcctgttgaatatcttatgccgttgataacttgggttataattgattggattcttggtttaggaatgcttacccatgcttagatctattagctcacaatgggattcattataatttagtccttaattatattatgatgtaccaccatggttatggtttaattaaactaaaatatgctttaatgttgggttgtgggtacatacatgattttggaagtcgtgcccatgacaattaaggaccagttcttgggaatcctaccataggctagtgtgggctccaggctaaatctagagtatagcttaacctagctgacattccatggcaagggtagaggcgatggtgcagtttggacctggatattggtctctgttgtagccggatttacctaggcacaagagggattgcccgacttggaataaggagggggtgaaacctgaggtgggtatgtttggttagggagagttatatgacgggttttgtcacgatttccctctttgcagtatcgtggcggtactttggggcatggtaacatgtgtggaatcgtgtcttgttggttaagttgtacacctctgataagagttaaaattattcgaatagccatgcccgcggttattgggcggtcaaccagctcaccatgattagtcccactataacaatttgacctatagaactggtgtagttcagatggtttggttgggcctgttgcaacgtggttttagcgttgaacagtgatgatttaataatgcttttacttattcaaatgatttataaatcctgcttttattgcaaatatccaatgagccattcctttgagaatacccttgcatcataccttcctgttggtatgactggttgagtgttgacggtccttaaatcataatatttgaccgtcaatacttgcatataatgaaataaaatatggtatccaacttagtggtagggtttattactaatcatttccactagtgttggtgaaatatgtgtatgcaggtaatttgaggagaaaacacatatgtcatgtgacaaaatgcacctccccgcattcaggacgcgtttacacggattggagccccaataagtcaataaaaaccatttagaattgggccaaaacatagcccaagttgttgggggccaattaagcaacctcctagccgaaggagaggccaggaggagtgtttttgggttcggccgaacctttcctgccgcttctcgccatctgcttccacgtggatggcttggattccttcccaaaggcggttgcagggtattttggtaatttcccatgcctccaaccatcatttggagcctatataaggaggagttcactatcatttccgacatacaactttgagctgaattacaagaggctctattgtatcttttgtacattagaataaggtagagagtgaggggaagctctggaggagtgcccggaagtttggcgctcatccgtcttctacctcgacgagtgtagcttcctaggaggaattcgggaggagtaccggagctgtcggtacactctgctccgggttcggagaacttctataagtgttcctttcttatgttatttaattactttgtttaagtaagatagattttcatctttacgggttcattgtttagtatttatactaagtgctctagtactaggactctagataaagaaggaagttcttgtacaagtattagagtagtaatttgacggagcgtggggctcctcaccgggagacagcgcaggcccccctttgccggttcggccgggggcgctgagtgaggttcttcaccctcgatctgtggaatgtacgcgagagagcaaacgcacgagacacgggcgatgtagacaggttcgggccgctgagaagcgtaataccctactcctgtgttctggtggatatgtgtgagaaagagttacagagagccggagagcaagagagttcaagctctagaacccctcttttttccttctcttctcagagtcgtcccccttcctttgtgggcaaggtcctccttttatatttcaaggggataccacatgcaccacttctacctactcttcttttgggtggggacccaccctatcttgaccaaatcttgactcgcgcctccgcctggaagctaaatcaccgcttgtccttgagtgatgcccagcgccgtcactcgtcggacacaggggatcaccctgtcatctcttcattaatgggcggagatctgcaatggctgctgtctgaatgaccctccgatgggatgggtcatacctacctccactccgccggaaacagatgcaacgtgggagcacggttgtctgccgatgacgtgaccggcgtcagtccagtcacagaccggtcattcttctccaccacacgtcagtttagcatgccgcacatctgcccttcttcaaacagtgacttccttgcaatggttgcgatgaagcctggcatgaatcgagccgggactgacgtgctaactccaggagttaccacgccggctccagctagggacgagtgccaagaggctctcatcattccgacgggacggggcgaggcgtgtgacaggccgcctgttgccacctaacccgcgatctgaccggtctgtgaccggtcacacactgcgaccggtcacggaccggatatgcgtgcgccgtgctgcattaaatgcggcgtggcgcgcttgtccatcccgcaataaatgcggttaggtgagcgccgctgtgcccacctaacccacacacgtggcgccaataccacagggggtcggggcgccccagccctcggggccgaaacaggagcggcccgacccctcggggagacagaggagggggtggccacgtctccctcgggcccgacccccccgagggggtcaggccacgtgggtgaccgcggctgcccaagcctctagtcatgatacccccgatcccatgtcaccgacagtagcccccggcgttatgccagggcgatcgcccccctcgagggaagcgctcgggcgtgacgccactccttaggtctggtgacaggtgggaccggtctctacaggcgggcaggaacccagcggtcgcaaatcgtgcgcatcggctaggaaaaaacgaccgataataatgagtggcctcttcaagaccgctacatttctcgagtagcgcgcgaatcgggaagagccggttcatttcgcctggagatatgatgatggcgcttcggtcggcgagcgtagttaacgcacgcacgatatgccctatctcgactgccacggccgcacatccgcctcgtgcgccgcaaacgggcgagtgggattagtggaggcgtgggcgcgagaaacgagggggcgagatagtgggcgcgggaaacgaggagccgggaatagcgttggcaagggtataaaggcgccaaggaagagattcgtttccttcctctcgccattattccccttgccttcgccgcttgcgccctaactccttgtttcctgtgccctaccctcgccgcactcactcgttctcaagctcctcctccgccggcgtcatggcacggggctccgcaccgctcgacggtagcgtgctgccgccttcctgcatcgtgagcgagaggcaggccgggctgccgtgccgattcatgccggcatctgccgccggccgggaggtggtcgagctgggcgagggacgcccggcaccacactacccggggcggtccgtcttcttcctccctttcgcaatggcagggctggtcccgccattctcttctttcttcatggatgttctggagttttatgatctccagatggcacaccttacccccaacgcagtaatgacgttggccatcttcgcgcacctgtgcgagatgtttatcggggtgcgcccatctcttcggctgttccggtggttcttcaccgtacagccagtgtcgccgccgtcggtagtcggtggctgctacttccagccgcgggggccggtgctgagccgctacattccctgcgtcctccgcaagaagtgggacgactggaagagcgactggttctacacccccctcgccgacgaagcgcgcctccgacttccgagccagcccccagcgcaggtctccagctggcgggcgccggtagatctgggagacggctacgacgccgttcttgaccgcctggcgggtctgcgatcccaggggctcacgggggccatggtgtacggcgactaccttcgtcgccggattgcgccgctccagcggcgcgcccggggcgcctgggagtacaccgggtccgaagactacatgaggacccaccagggggtcagatgggactgggcccctgaggacttcaagatagtggtccaacgggtgctgaatctcagctccgtggaggcatccctcatcccccaaggagttctccccctctgcagcgatccagatcgcgccacgatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcagccgccccgccgacacccgggggaagaggaagcaggaaggaaccccttccccatctcctccccgagggggcggggcggcgcgtgccagcagcaggcgcccggagggtgccgtgccgacatcgcaacccgagggggagcgaaaaaagaagcggctccgcaagatgggggagactgaaccataccggggaaaccttatctccccccaaggtggtcgtttagccgacctcctcgcaggtttgtccccgcgcccactgcggccgtatttattctcccatctcccaaggcaagctttcactcacccgtttcttttgtcctctggtttttcttctgcctcagcgagattccatcgcgccccccccccgccatcccaagttcggccagtccgaggccgtggagacggcgaccgcggaggcccggaggcgggaggctgaccggcgagaagccgcagaccgcctccgggaagccgaagaagctgcccaggaggccgtccgagttcgccaggctgaggaagccgctcgggaggaggccaaactccgccgggccgaggagtccgtccggaaggcggaggaggcgcgcgcacgccaagcggcctgccaggcccccgacccgactccgcccgaggcgacgacgacttccgaggccacccacgacgaggccgcgggcgcaccgctcgggcccgacccctcgggcgacgctcgggacgtgccagcttcgggggacgcccccgagtccgccacgtcgatcggcgggccgtgccacgcggcgcccgcaccgaggcggctctctccttcgccttccgctgccccactgaacgcggagcccctcctgcaggccctagccgccgcgaacaccacggtgctggacgggctaggtgcccagatggaggtcctgcaggcagagtggacggagctcgacgcggcgtgggcgcgcgtcgaggaggggcggcgctcggtggaagccatggtggaggcgggccgcaaggcacaccgccggcacgcctcagagctcgaggcccgtcggagggagctggcggagatcgccagggaggtggaggaggagcgggagactgcactcatcgccaccgccgtgctcaacgaggcgcgggtcgatctctacctccaatacgggagccgggcggtggagctagagaagaaactcgacgccgcccggggagtccttgacgccgccgctgcacgggaacggcgggcggcggagaacgaggcggcgtcccggcggcgcgaagaggcccttgaggctcgcgccaaggcgctggaagagcgcgcccgcacgagggagagggacctggcggaccgtgaggccgccgtcgccatccaggaggcaacgctggcggcgcacgaagccgcctgcgccgaagaggagtccgcactccgcctccgtgaggacgcgcttaccgagcgggagcgagctctcgaggaggccgaggccgcggcgcagcggctggcggacagcctgtccctccgcgaggcagcgcgggaggagcaggcgccccgtaatctggaaggcgcccgcgccgagagggccgcactggatcagcgggccgctgagctcgaggcgcgggtgaaggagctggacgcgagggtgccacgcggcggggcgccgcgggcgacggcgacctagccgcccgcctcgcagctgccgaacacaccatcgccgatctgcagggcgcg

SEQ ID NO: 12577 - DNA, 7428 bp, Oryza sativa
gtagggcccggcatgcttcgggacgccggctcccgtatagatcgcgccgggcggcaggcgggcctctggggcgagcggaccgcgaagtatgccgccaaccaggggggcctcgcccagcgtctctcagagatggccgggaccctccagcggctccccgaggagctcgaggagacgatcaagtcatcctcgagggacctcgcccggggggcggtggagctcgtactggcaagctaccaggccagggacccggacttctccccgtgggcagcgctggacgagtttcctcccgggaccgaggacaacgcgcgcgcgcaggtccgggacgctgccgaccacatcgtccacagcttcgagggtacggccccccggctcgcgttcgccctcgactacgacgaagagggcggtgacggcggtgcgggcgacagcggcgatgaggccggcgacccgggcgtgtcgtaatgagcccccaggcccctgccaaccttatagagtttttttctttcttcttccgaggctttcgggcccccttcttgtatagactaacttaatctgcaatcaaataaagaggaaattttttgtgtcaattctatttgttgtgtgtatgagacgaggatggtctgtgccgcggtccttctgtgtctcggcttgaacaagggctcgtgcccaggtcccagcctcaaacggcgcgggtcggggctagtgcctggggagatccacatgttgagactggccaggccgggagcgtggtgaccgggggttatgggtgacccgattgtgggcctttgccgattcccccccggagttcaccacgccccggggcacggctcggttctgggccccttttggcgattttagccggcccgggccaccgagggcagaatcgagcacgagcgtgctaattcaagtcaagattcagcaaaaggaaacaatggcacagacacagtccttaggaaatcgaaaaatgcttttattgaaatacagaagagaaaaaagataggtatatgcatatgtggtagcccccggccaaccctgcacgccccggggggggtgcggggttggcccgagcccgagacctgacacccgacccctactaggggtagaagcgacgaaggtgttcgatgttccacgggttaggcagctctgtgtcgtcgcccgtggccagccgaacggagcccggccggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctgatagcgcgcggctcggagggccgcgcgccgccttcgctcttctaagtagtcgaggtcatctctgcgaagctgatcttgatcagcctcgcaatacatggtggcccgaggggaccccagggtgagctcagatgggaggaccgcctccgcgtcgtagacgaggaagaaaggcgtttccccggttgctcggcttggcgtggttcggttcgcccagagcaccgctggtagctcctcgatccacgagtcgccatgcttcttgaggatattgaaggtcttagttttgaggcccttgaggatttccgcgttggcgcgctccacttggccgttgcttctgggatgggcgggtgaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgacgaccggataagcctcgggccacttagtgaacttgtcgatagcaacatacagatactcgaacccgcccggggcccgcctgaacggacccaggatatcgagcccccagacagcaaacggccacgaaagaggtatgatctgcagggcctgggccggctggtgggtttgcctggcgtggaactggcacgccctgcaccgccagaccaagtcgaccgcatcgttgagagccgtcggccaatagaaacccaggcgaaaggccttgccaaccaaggtgcgtgaggcggagtgggctccacactcgccttcatggatatcggcaagaagctcgacgccttgttcccgaggaatgcacttcaggaggactccgttagccgcgcgccgatagagggtcccttccaccagcacgtagtgcttggagatgcgctggacgcgttcactcccttcgcggtcctcgggtagagtcttatctgtgaggtacgcctggatctcagcgatccaagcgatcaatctaagggagctgggagcgctctcctcgggtcccgaggcctggactccgacgggcctcgggggccgttcaggcgcgtccatctcccctagggggtcaggtcgcgccgacggctgggcaagcctttcttcaaaggcgcccggtggggtctgggctcgcgaggaagcgagccttgagagttcgtcggcgaccgcgttatcccgtctgggcacgtgccgaagctctttcccgtcgaaatggcgttccatacgccgcacctggcgcacgtaagcgtccatctgcgggtcagagcaccgatactccttacagacctggttaacgaccagctgggagtcgcctaacaccaggaggcggcggatccccagtccagctgccaccctaagtcccgcaaggaatccctcgtactctgccatattgttggtcgcccgaaagtcgaggcggaccaggtatctgaggacgtctccgctcggcgaggtcaacgtgacccccgcaccggcgccctgaagagacagggacccgtcgaactgcatcacccagtagacggtgtgaggcggctgcgaggggcccgagctggcctcggggatggagacgggctcgggagctggggtccactctgccacaaagtcagcgagggcctggctcttgatcgcgtggcgtggttcaaagtgcaaatcgaactcagagagttctattgcccatttcaccacccgtccagtaccctctcggttatgcaagatttggccgagggggtaagacgtaaccaccgtgacccgatgcgcctgaaaataatggcgcaacttcctcgaagccatcagaatagcgtaaagcatcttctgggcctgagggtatcgggtcttggcgtcccggagggcctcgctaacgaagtagacgggccgctgcacctttcggcggggccgatcctcttcgccaagggccgcatctccagggcgcttttcgtccgagaggccgcgcggggcgcactcggcttctgtgtcatcgacctcggggtcggagggcgacaagcgcggccttcccgcagtggccccggggccatcctgggagtcgggggggcctggcaccgtcggacaagcgggcagagggccagctccggccgtcgggggcctcgggccgccgttcggctcgggggcctctcctccctggtctctcccgggtcgagtcgacacagagtgggggtgcgcagagcgagggttgtcctcgtcgcgctccacgaccaacgccgctctgaccacctgcggggttgccgccaggtaaagtagcaacggttcatctggtttcggggcgaccaggaccgggggagaactgaggtacgccttcaactgagtgagggcccgttcagcctcctccgtccaggtaaacggcccggaacgtttgaggagcttaaataggggtagcgccttctctcccggcctcgatatgaaccgacttagggcggccatgcagccggtgacgcattgcacatccctaagtttgctgggggggcgcatccgctctatagctcgtatcttctcggggttggcctcgatgcctcgggcagtgaccaagaacccgagaagcttgcccgcaggcacgccgaacacgcacttgtcggggttcagctttatgcgggcggagcggagactttcgaaagtttccgctagatctgagagtaaggtctcttggttgcgcgtcttcacaaccaagtcatcaacataagcctcaacgttgcgtcctaactggctacccaaagaaattcgagtagtacgttgaaaagtaggacctgcattctttaacccaaaaggcattgtcgtataacaataagttcctatgggggtgatgaatgcagttttttctcatcctccctagccatgcgaatctgatgataaccagagtatgcatctagaaaacacaaaaggtcgcaccccgcggtggagtcgacaatctgatctatacgtggcaaggggtaagggtccttaggacatgccttgttgaggtcggtgtagtcgatgcacatccgaagcttgccgttcgccttggggacgacgaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacatgatcatccgctgcctcggggcggccgggacgaaggcgctgagcctctcgtcgccacactcgggcttggacgccgcggcgagctggtccgcgcgctgctccatacaagcaagcgcgacttggaggtcgccatggacggtgatggggccaccagggcccggcatcttcatctggagataggcgtagtggactgccgccatgaacttcaccaacgcgggtctccccaggaccgcgttgtagggcagactgaggtccgccacatcaaagttcacccgctccgtgcggaaattggcggaaccaccaaaggtgaccgggaggtcgatatgacctagcggccaagtgtgccccggcgtcacaccgatgatcggctgggacggccggaccaccatccccggggccttgatggcgtcaaaggctgcgggagaaagaatgttgagggctgcacccccgtctatgaggacacgccccaacttcacattgcaaatggtgggggaaaccaccatcgcgatctgtcctccccgggcaacgcacggcgggtggtctgtcatgtcgaaggtgagggccacctccgaccatcgcgcccgccgcgtcgcctcatgggtaggggccgcggccagaagctctcgcttcatggccttgaggctccggcgagaagcgtgagcgcacgctcccccatcgacggtggcgaccgtggcctgaggctcctggaaccccaaggttatcgtcgccatcgtcgacatcctcggcgggggccttctgcttggcctcacctcgctggttgcggcgggggcccgcgggggccttgccatcacggcgctcctgtctcctctcctcctcccacttacttgtccgctcggccaaacttttgaccgcgcggcagtccgcgaggtcgtggagggaggtgttgtgcacggagcaccacttgccggtcgggcgctccctgctgggagcgccggcctacttctttctgttgctcgcaggcctcccctttcgggtggcccgcgaagcgccctcggcagcgaggacgtgcccctcgtcgtcggaaagggccgacctcttcttcctcctcctgtcccgccgccctgatcgagcagcggacccgggggcggccggagctgccacactggaaccggaggagttccaggtccaggcctcctccttgcgagccacacggtccgcaagctgaaaaagctccgcggtggtctggggctccttggaggcgatcttttcgagcatgcgattgtgccgcacgccccccctgaacgcatagatcactgcgtgtgcggggatgcatggtatagtgttgcggacttgacagaaccgctgaatgtactagcgaagagactcatcgtcccctcgctgtaccgcgtgcaagtccgcttcttcacctgggcgcggatatgtgccctggaagttcatggtgaactgctggcacaaatcctcccaagagtgtaccgacgcgggtggcaagttcatcagccaaccccgcgcctgacctttcaggaccatgggaagaaattcgccatgaccctgtcgttacccccggtggcctcaatcccggtcgtatagatctggagaaactcggcggggttgacgcttccgtcgtatttttcggtgatggtgggccggaaccttgggggtcaacggacgttccgaaggctcgccacaaaggctcgacagccggcaccgccaaccggggacatgggaggctggcccccatgcccagactgaagtggcgctccggacgaggaagcgcactccgttgcgtgggcagcacgacgaccattgcgtcggcgctcaatattgaggcgggcatccggccccccacgcacatcttcttgggtcggaggcgtcgacgagggaataacggacgaacggcgggtaacggccgccgctcgccgcgccctccgcattgacgacacggagccggtggtagcagcgccagaggccttgggggcgaaggactgcccgccggcgcctaggcgctgctgtgccgtcatgaccaagttggccacatcatccagccaacgtcgagctggagtctctggatcggggacgacgggcgggtgacgtaggagcgcgcccgcagcctggagcgcgccctggggcgtgctgccatcgccgtagacgaggaggcgacgctccccgtctcgccgtccttctccatcacccgtgggtgacgaagtcgcggatctttcgatcccctcgagcgcctccttccgcccaagacttcggcgaaagggggacggtggagtacgagctcgacggcgcgggttctgctccctgtcgtcaccgctagcgctcggagagaggttgtgcgccactgcccgttcggccattgggctgagcgggagaaacttggcgcacacgaaagaggacgagggcttagaaaagcacacgcgccccctaccaggcgcgccagatgacggagcgtggggctcctcaccgggagaccgcgcaggcccccctttgccggttcggccgggggcgctgagtgaggttcttcaccctcgatctgtggaatgtacgcgagagagcaaacgcacgagacacgggcgatgtagacaggttcgggtcgctgagaagcgtaataccctactcctgtgttctggtggatatgtgtgagaaagagttacagagagccggagagcaagagagttcaagctctagaacccctcttttttctttctcttctcagagtcgtcccccttcctt

SEQ ID NO: 12578 - DNA, 4321 bp, Oryza sativa
cggtcattcttctccaccacacgtcagtttagcatgccgcacatctgcccttcttcaaacagtgacttccttgcaatggttgcgatgaagcctggcatgaatcgagccgggactgacgtgctaactccaggagttaccacgccggctccagctagggacgagtgccaagaggctctcatcattccgacaggacggggcgaggcgtgtgacaggccgcctgctgccacctaacccgcgatctgaccggtctgtgaccggtcacacactgcgaccggtcacggaccggatatgcgtgcgccgtgctgcattaaatgcggcgtggcgcgcttgtccatcccgcaataaatgcggttaggtgagcgccgctgtgcccacctaacccacacacgtggcgccaataccacagggggtcggggcgccccagccctcggggccgaaacaagagcggcccgacccctcggggagacaaaggagggggtggccacctctccctcgggcccgacccccccgagggggtcaggccacgtgggtgaccgcggctgcccaagcctctagtcatgatacccccgatcccatgtcaccgacataattaataacttagacgcggtgtctaggttagaggttacctttgtttgttgtgtatcccacggttttgtcagaggtaggcggcaggtggtgacagccctgaattctatcccagtgatcctccacgttcggatacatcatagagctatagctggaaccacgctggcagacctgcaggatcggtgcccgaagcagcagataggaaattaactttgcttagcttagataattaaaacccatagaaagtcctctctagcctagcctgcctatcatcagttgttgtccttggatagtcttagccttaggtagattacacacgttccctgagttcgatatccttttggggtcacccgaaggtgaagtgctacagcggtattccgtgcgcttgcggatttatctgtggtcataagaatgaggacggtggttggtactcaatcttactttatcccctccccctccccagaaagcagagattggatcagatgatgagttctttgatgtttgagcttgttccggacgtcaagtattgcctgtggtttatggaggaagcttcgctttggtcgtgaagattaagtctagttttatttgtttttctgctgcgtatgtgagttttattttgttatttttgtaaaacatagatctgtctatcaaattgccgtatgtatactctggctgattctgaacagagatttaatacacattctacttaaaattcgtgttagcgaatttttggacgtgacgaccgatttctcaggatttgtcaacgtttgcggctcaggttgaatgccacggtgttgcactgtaaagaggccctaatacccatctctgctagcttactgcatgtaatttgtcaggttcattctatgaccaaaaaaaaaaatcttctcacacataaagtccacaaattttgaacttcatattgaccatcaggtggcacaacttcatatttaatcccttcaaaatacgattattttttatatttttgaacttttaaaatttttaatttcaaaaataaacacgttcgaaacttatttccaaaccttttggccacgctagttggacatgcatggcaaaacaatactgtcacactggtctggctagcgtggcatcattatttggtcatgcatgtctggttgacatggcggcgttatttggcgacgctggcgtggcaggataaaactatcacgcctgctataggtggcgtattattttaccaggccaggtgagctggcgtggcccaaagattcagaatgtggaaataacttttggaagggtatatttttaaaattttaaaataaaaaagtttaaacaacaaaataaattatcaaactacttgtacttcatatctattgcaattttaagataccgataggaatgtccaactcttgagcagcaactccctaaggtcatacgtgtttattgccagttcaagcagcaggaaatgtatacagcttagatggaatatctgctttgcctattcagtctttgagaaaaaaactcaatgcaattagtaataattacattgttattggcattccatatattcatttacacaagatttaactcttatatttttcattacttaagggaggacctatacaaagcagctcaactacaaacaaaaaatatcgatttcaatgaagactccactgagcaaacgaaaaggtataccctattttgggaaaattggaaccatgccattataattttgcaaaatttgagatattactacatacatcttttcttatcctcttttactataaagttatagccctctaatttccaaagcttaacatgcaaagacaccacatcatcatccactaacaactattacatttaagtataatgcaagcacactatattatctataatttaataatttattaaattttagagatttaaaatgtaagcatgttaaatgattccacataattcacatagtctttcaatatatctctccattattttttttataatatcctatacatctatatagttcatcctcacttagttcatgttgtttttctcttctctcattaagtcatatctcatcaatttatttttctagtccttatatgattaatctatgattcaaattatcccttttctttttcttctctcgttaagccatatcatctcaactttttttagcccttagatgtataatctaaattatcttccttctttttttttctttcataaagccacatcattttactttgacatttgaattatcattctacatattatttaaatttaaatcacaccaacttatgtaaacttatgtttaggtaagcttatgttgtttaagatatctaacacattatgtcagggttacggataaggcatacctcctatcctgcgacttgtgaaatataccgatatggtatacctttacgtatatggattatttacatatacatcgtatggaatttacttcaaattaaggaaaatatctttatgggtcaagtgatttctaaagtcctactcgtaagggataaagtttctgttataccgtcccaggtccgatatcctcaaaacctttcttggggtcaagatgacccacggtataaaagaagaccccttgggagaggttcggatcatcgaatctcttcgccaacacacccaccaaagcttacgaagatggagtacacagaaccaactcgccgggagatctcgtcgaaacctcgactacgatctcgtcgggatcatctttttcgactactctctttgtaatctgttctcatcatcatcaatcccatataaactagactagggctattacctgataaggggcctgaaccagtataatccttgtcttttgtctgttttgatgtcgtactacgtagaccctcgttccaacgtaccccaatactctactcatccggtccacgagtatcactcgtcgacacattatttttacttattgttatcatagtaaacttcaacagcaacgcgtggagtttcacctagttattttaattttaatattttgtgacaaacaaatataggctcaaacccttccttatagtaatttttccctttgtagtaccaaagaactgttattaactattctcaagtgttagaaggacgagcatgtactacttctaacacccctcaaaataacaaaatctaacagaaatactgactgcaatctcttacgaactagtatttcatacagcacatacctctattagcactacaaatctacgcaaaaagggtaattattcttcacattgctaaagacttgctgcattatcatgcaagcatatcctactattttatattaatactaatacattgttgaaccaaatttacgggtcagcatatcctcctcgacctatagaacccatatgattccatacaattacatccttcgattattccaaattatttgtttttttagacatcttctatttttattattgtcatgactatctttcgaaacttacatgtaaccaccagcgaaatatatgtcatattcaaaattttgtttgcatgttcaatggaaacacaagggattcatctggaaatgcttacaatacaaactattgttctcaaaatatttctaaaaattcctgcagaaacgtcccactagtacacatgtgattatgctggacggcggcggctcattttggttccaggcgggccataaatggctccgcctggaaccaggcgaatgtcggggtcgggcagtgggccgcacgggataatcgattattccgtgcggtccgct

SEQ ID NO: 12579 - DNA, 4051 bp, Oryza sativa
gggggaaggtttttgacctcaaatctttgattgggttccatataaaagtgtagagctcgttctcctccttcatttgcttccatttttttcagttttcatcggtggaatacgaagaaacttgcacttttatgaatggaatagtgtaggcacctttttgtttttttattttttaagcaaatacatattgcaatcttttacatgtttataaaagtaattagcacctaaattgaaacgttgggtttgcctcttaagtttattttcatttggatgaaaaaggacgaatatttttattttttagaaatggttagacaatattctattaatgcttaaaattgatgtgcggctgtttaaatagtccgttcaactttaaattactacgtgattagttccctccaatttaaatacattcgtgtttgaatcaggcatggatgtattaatggcaagctttattgtagatcatggatcggacatggatgtacaacacgaaaagagctcatccaacgttcttgaaggaagcagccaaatttgttgagctcacaaaggcacatgctgcgagggagaatttgaggagcattttttgcccatgtaaagtttgtaagaacgagatcttgctgcaagatccgaatgaagtattgtcgcacattgtagaacgaggatttaagaagggatacgagatatggacttttcatggggaagccggtggtcgtaacgaagagttagatgatttatgttttgatgatgcagaaaattttataatcgaagacatgtcttagggaaacatcccggaatacggtggctcaggtatagagaatgaaggtattgattttgaactggaagatatgttgcggcacgttgaaccagaggtcctaactggtacaagacgcgggttggacaattgggaagctttggaaaattcagcgaaggagcttctgtacgacgaagccaaaggatacgacaaggactattcagtcctgcgctcggtgctcgaacttctcatattgaaggccagacatggatggttggacacgagcttcaatgatttgatggatcttttgagagtaatgcttcctaagccgaacctgctaccgacgaacacatatcaagcgaagaaattgatatgtccattgtctctaggtgttcagaagatccatgcatgtgaaaatcattgcatactgtaccgcaaggaattcgcggatttagactcttgcccaacatgtgggacgagtaaatacaagacgggcaacggagcctccgatggagaggtggtcgacaaagatgatgcactggtggatgagaacaaaaagatttctaggatggtgatgtggtacctgccagttaaagatcgcctgaagcggctatattccaaccgagacgacgccgagttgatgagatggcaccaagagggtaggaaaattgacggtaagatccgacaccccgccgatgctcgacagtggaaaaactttgatgcactacacccggaatttgcaaaggacccgagaaatgtcaggtttgcattgagcacggatggaaagaacctgtttggtgacctaagcagcacacacagcacctggccagttcttctaacgatgtacaacttgcctacatggatttgccagaagtgaaagtacattcttttgtctgtccttatataaggtccaagacagcctgggattaacatagatgtgtttctggaaccattgatggaggacatgcaagaactatgggaggaagggttacgaatgtgggacgagtaccgtagggaacatttcactctgcatgccatcatattcgttacgatcaacgacttacaggcaaacttttcgctctcgggccagtttaaggggaagttcggatacctcatatgtatcgacaagacgtcgtacaagtacctcacctcgtcaaccaagggtgtttacatgcgtcatcgtcggttcttacctcagaggcataggtggcgtgcgaaggccagattattcgacaatacagtagagaactttctagctcctgaaacacgtacaggtcgttctgtcttcgatttgacaaagaagaagcccgtcaagaggaagaaacgtacggatcaggacacaactgatgcacctttagaggaaagtaaccagtccttcaagaagcactcaattttttttcaggtatcttgattactggaaagacctggaggttcggcatgccatcgacgtaatgcaccttgagaagaatgtgtttgatagcaccattggcactttactggacatcccgagtaagacgaaagatgggttcaagtcccggaccgactttgtcaatttggacataaggcatgagcttcacccaaaagagctgccaaatgggaagatcgaaattcctccggcatgctactcactaacacctgacgagaaaaaatctttatgtagatgcttgcatagtgtgaaagtcccgactggtttctcagcgaacgtcagaaaacttgtatctttgaaagatttgaccatctctgggtacaatgctcatgattgtcacaagatgttaacagtcttcctacccattgccataagagtggtcaagccagttcacactcagttagtgataacaaagttgtgctaccttttcaatcgagtatcacagaaggtttttgatcctgaagagttaggcccccttcaaacttttgcaatcgagacagcatgccagcttgagatgtttttccccccagcttacttcaacatgatggagcatcttattgtccacatcgtacctcagattatcgagattggtccactatacctacaccagatgtgggcgtatgagaggtacatgtccgtgctgaaagggtatgtccgtaaccgagctcatccggaaggatcaatgatagaggggtacacaactgaggaggtggtcgaatgctgcatagattacatgaaggacgccaaacccatcggtgtgaccccccctttacacgagggccggttagctgggacggggatcgtaggcaagaaaaggttctacgatgaggacttcaaagatgtagcggaagcacatagcagtgttttgcaacagctcgccatcttagagccgtacattcaggaacacatgaacgagataagagcctgcaaccctagaagaacgaacatttggatttgtaaagaacagaaatggaaatttcctgaatggttgtaggagaaagatctgccgttgggtgattcgctggaggaaaaaactttgcgcaggctagcaaatggcccaactagccttgtgacctcatggcaagggtacgacatcggcggatatagattttacacgatgttcaaggacaggaaaagcgcagctcataacagcggagttcgggtggaggcgtttgacgcatcaggtgagaagaagtcttactacaggatcatacaagacatttgggagctggactatggccttaacatacagatcccggtgctacgatgccaatgggtcagagacacaacatgcgtattcatcgatgactacggcctgacggttgtggatcgtagcaagctaggacacaaggatgatccgtgggttcttgctgagcgggttgctcaggttttctatgtcaatgacccttccgatgataagatggccattgctgtaccaggaaagcaaaacattgttagcattgatagcattgaagacgtgtcagattacaaccaatacgacgacgtccttttgtttacagattttcctaaccggatcaccggatcaaggaagttgagacaagccttgacgaagatttgtttttgtccgcgcggaaggatggtgtttccaaaattgtcaaacattagtgagatgtcgatcctgtgtactacctattttgtaaacgattactggatgaaacttatattgcgaatgagatagggtatccatgtttatccgtactatatgtcgttttgaatttattttatggtccaatattttatttatattaatcatatcgatgaataattagatgcgaataaaattcatgtctgttttaattctttgttaatctatatttgtgttttgaataattcgtggtttaattaacccaaaccaatat

SEQ ID NO: 12580 - DNA, 2568 bp, Oryza sativa
cgatccaggtacccctctcttcgccgcccctccttttttggatgatgcaatggtaatggatggaatgatgcagtggaatggatgaatgatgcagtggatgatgcatgcagtagatgcaatgttgaatgaaatttttgaatgaatgaatgatatttggttgaatggatgaatgatatgttgatttgtgatgttgagatgatgatgatatttgtgatagatagatggttgtttgtgatagatagctgatatgtgagatgatgatgatatttgtgatagatagatggttgtttgtgatagatagatttgagatgatgatgacatttgtgatagatagatggctgtttgtgatggatagatgatatttgagatgatgatgatttgtgatagatatataggacttgtgctctttgtgataaatagatgtatgtctacatgggatagatggatgttttatgtcactgtgggctgtttttttttctacacatgatgaaatatatgcccctgctgaaatattttgctaattttgcaaatgatgctgttatgcccctgctgatgttgtgcatatacatgatgaaatatattttgcttctatatgtttatatatatgtgatgtacatatatgctgtttacacttgtttgtactgtatattttgggctgttttatgcctcattgtggttgatacatgtgggtgattgttgtgggtgatatatgtgggctgatttatatgtgggtgatatgtgggctgttttatacttgtggctgatatatgtgggctgttttttgttggtgataaatggccaatgatgaatgcttaagaacagatcatattgtgaatttttttggggggcacttcacttgtttatttatcctcaagaacagaacaactacacttgtgaagtttttttggggcacttcacttgtttatttatgctcaagaacataacaactacacttgtgaaatattttggggggcacttcagttgttttttttgcttgagaacagaacactacacctgtgaatttttttttttttgggggggggggccgcacttcgcttgtttaataatgcttgataacagaacaactacacttgtgaaatattttgggggcacttcagttttttttttttttgcttgagaacagaacaactaaacttgtgaattttttgagggggcacttcacttgttttttttgggggggcacttcacttgttttttttgcacataagaacagaccatctacacttggggttcatgatgaataattgctgagcaaaactgaggccatatgctttcatagtgtgcatagtgatgaatatccttaccaatcttgaaatcgttacccatcttacgttccttaccgatcttgctttccttaccaatctcctaaaattagatataggaggtgtagttcgtacgttatcatgctgctataatacgaagtgttctggttgccaagttctactagtcggtttagttgctggacgcaaccgactagtacaaattggaaaaacagaacatttcgtcaacatatgacatgcgttggtcatccataaaatgtgctagcacgtatgttgaaagatagacctctgacttgtacatgcgtcggcctcgtggatggaccaggagctcgacgttccttaaggccgttctttccgacccatacaaggttccgtcgcctgcattgttccaagagtgtcttggacgaaagcaggaagtggaaccttgttaaggtcggaacgaactgccttaaggaagtcgatgctttaggtccgtccacgaggacgacgcagctaggagttagaggtttatatttgaacacacgagctagccatgtgatcaaaacatgtttttattttgctgttaatatgatagtttagtttagtggttatgatagtttagtggatttgaacgaatattaaattgtaagaacgcgaatcgaagatgtcgggcaagacagctccggcgggcacagaaccgacggtcaataaacctaatgggtaggacagctccgtcgggcacagaaccgatgtcactaacaatccccaacacgaagaagatgtcgggaaggtaccgacgtcgagcaaggaatcgtgatgcacaccgagcgactcgtttgagctagaactagcgcaattgcagtatgaaagacctgaggatgacccggattatattcctatcgagcaggcggtaataactgaatcctgtcgaaatatatatttggaattaaactttccccgatgtagcggtctaatgacttaaccgtgcagatggcaacccgtcgtcggtcaaaactaagtgccgtcagggttgaacctgattcagacacaacgacctcgggaccaccgcgaacggacacgacgatgagtgggggagcttgtccaaagaaaaagcgtggcgagaagggcaggaacctcatgccgaaggagacgtactacattgctgctctcgatgttgacggcaaacccgtcgagccgcaacatgtaagggtgaagtttagcaccgcatgcggcgcgctggcaaggcttcatgggcctctcaacgtggacgaatggaagcatgttagca

SEQ ID NO: 12581 - DNA, 13158 bp, Oryza sativa
aactacggaggaaaagtttgcggccgaaggcaaacctttgattgtgcagcccctagataagcgaactagaaattgggtgtgggcaagaacttcgagatgctgttggactgtccagacatccagaacgtgaccacgtctctccaacagatcgtccagaaggagaagaccggtgagtttgtccctcgacggcagcatgatgagctgaccgaagctttgagaactacagaacactccggtaggttagaggacagtcgtgcatgacgaattggaaggtagggtttccacaggaagcccaaagttacaagaagcgcgatgcctacaaggccaagatgcgccaggaaatcacaaatcaagtcacacaacaagtcacccaacagttctacagtcttgccgcacaacatcctcaagccttccctgacctggttcctcatggtttgcagtcgacacagatcctaagctcagtcgggtcggtagaaaatacaacctacccagtagatagtataactggtccgacaccgtgcagctttgtcgttccgatagggagagcgggaaaaacgaaggaggttgcgtctggattggcgataccggggagacagttccataacagcctaattccggcggactacgtaagtgttcaggtcgcacttgttcatggcgaccagatgtcgttggagcttgacatcccaacaccagaggggattgaacttctcagggatgcggttaaccagttcatactctggcatcgtcgtgacatcatcctcactggacagttcatgtcgatgacaccagctccatcggtgccaaatacgtctgcacctcctgcaccgccgtcccctccgatctgcactaccccacccggatctccactcccacagatatcaccacttagaggtccttctccacctccacaacaagtagcacctaactccccaactaccctacctcggtagccgtctcctgctcctcagtcctatcttgctccaccccttgacgaacatgtgccacctccacagccagatacatcaaaggagcagccaaaaacctgtgaagcccgcaagctcatacccgttatggtatccacatacaacaaggagaaaatggcagagtgtgagacgcggatggttttgcaatctttcaagggtcgagggggtccgctaaagccagttggacctgatcagtattcggacgcacagaagagcgttgtaggtcttgctgacaaaatgcaatcttggacctccaatgaagtgcctaaggagtatgaatatggcaagccgtttttgccgttcaacttgatgtgtgaactcccatggccaatgaggttgatgcatgagtggtacttgagggcaagtgagttaggtctcgggatgattactgtgcatgtcccggaaggcgctttcaaggatggacctaacgcaaacttcgcctttagtttcaaggacctccacgcactctttaagatggataaaatggatatcaatctcgtcggtgcgtggtgcctataagcattccatgtacttcgttattccaatgtgtgccaatataattgttagttattctaacttccaaatttcctcatgtcacaatgggtagacgctcaaagaacggggaccttaatcggttacgtaaatccaacgatggtttgcgagacggcccacactgtgcggatatcggaggatagtgcggtactaaagaataagacacctcaggagaaaaaagattacatcgagcgtatgcgtaagagaaagatggctgaggtgggaaattacttggccacctcatttctcgcacactccgacaaacgagtcatcatggtcccctaccactttgggtaagcaactttgacatatttccgttcacatattaataacagcgcaagaaaatgtcttatgtaatttcataatccgtgttcacagcgaacactacatactattcctcgtctatccaacggaccaaaccgttgtagttcttgatccggcggactatgacaaggacgcgtacatggagttcctatgcttgctgaacttgtaagttcgaaacaatttccgtaaagattccaactttccgtaaagatcattaaagtagatttatcataattaattaatttatttttgtagagcacacggccgttataagaaacgtggcgggtacgttaagaatccaagtagagagaaactgtacataaggggacactggccggtatgtcagcatttattcagtacgtacatcacgattgtcacttcttacttctgacgtgtccacttgtgtatgcagtgttataagcaacctagctttacgaacctatgcgattattacgtgtgcgagatgctcagggtcaatgggagatacaattgagtttacagatgtaagtcattaaactctccttagatattgcaaatagttcattaaacctgactgtaacacaaatcatttgtcttttaatttcgtagctcccgagtatcccttatagtgcaagccggttcgatcagaaaacacttatcaacttgtgcgtggacttgtgccggttcattcgccgcgacatctgcaatcatttaggagagttccatgatcctcatagcgaacttgctacggaccccaaattcaagaatctaagagagtgggagaggcaacatgctatggactaaatggatgtatttgtcgtgggggatgcttgtaataaacactatactttttatgtaatatgatttaatttgatgtttcggctaattttcggctaattttctatctattgtctcgtgaggtcaaattatacaaaccgcacgggataataggttatcccagatggctagcacgtgctagccgtggggggtaacatattatcccgtgcgggccacttaatttgaccgcacgggaaaatagattatcccatgcggttggccttattgcacaggggataatcgattatcccgtgcggtcggcccgcccgcacgcgaaaataaagattttcccagacgatgagctgcaggcgggccgggcgaccacaggggataatctatccaaccgcccggaataatgggtattgtcgtagtgtccggtgtaccatctagtatatgtaatcttttgtctaacaagactctagctggatgatttctaaaagtaaagagaaaattcgatccatagcacaggaaagaaagcggtaccaaaaaatagcacaaaaaaaattccactttcgatccatagcataggccactaatttttcttcgccccgtagcactttcatcgtatttggaagtaacggcgttagatcggagtggagaaaattttcgtcggactcatttgccctttgttcccccacgttcccaccacgtctcatcttctgctccttcgtggatggcggtgcggtgccatcagcgtgccgggcaaccgcctcgtctccctgccaccgccgagcgagctgcgacgtgcactcttcaacaacgtggacgcgtggctcgccgttgccgccgagtcgaagaccttggcattgtggtgctcgtcgaggaggatgttctccggcttgatgttgcagtggacgatgcagtcgcgacacttctcgtggaggtaggtgatgccacgggcggtgccgacagtgacggcaaaccgcgtcggctacgacatcttgcagcccggcgcgtcggtgaagaggaaggcatcgagggagccgttcttcatgaactcgtaggtgagcaggcggtggcgtccctcggagcagaagctgatgaggcggacgaggttgaggtggtgcgtgctgctgatggtggccacctccatcctgaactgcttctccccctctcgatcccctccagctgcttcaccgccaccaccgtccggttcgccatcacgccgtggtacacggcgccgtacttcgggctgtgccggcacaacacacaccacaacgctcactcgcacagcaccagcccggacaccacgccgagcatcacccacctgcggacgccagacaccctgctctacagcgagccgccgccgccgaggggcaggttgggtatccccgggaagcagaccttgatgaacgacgtgctgggcagcgccacggaccggtacccgctgacgaagttggacaccttgaggaagcagaggctcgagccgccgtagagcgccatggaggcgacgcatgagctgccggagaggcagttgaggcggcaagcggtgatgccgacgaagaactgctctgtcgtgatctccagcagtaggtgaggaactgcgtgttgtcaagctggagcatggtggagttgcctgggcagttctggagctcgatcttgcgccggcatcaccctcatcgctgcgtcgacacctcgacaccctcgtcgccgcgtcgttgtttggcgacggcgcctctatgtcttcctcctctccgttgcaaatggtgggcggcgctagcgtagttcagctcaacggggtggctggggacggggatggcggcagcgtggctggggacggggatggcggcagcatggctggggacggggaaggtggcgcggcggctggggacggggacggcggtggcgtggcttggggacggggatcgtcgccgcatcactgtttggcgacggctccggcgccgtcgttgtgggcacgacccgatagaacgagatgacggagattatggcgaggaagacgaagggcaaatgggtctaacaaaatttttctacacttcaatctaacgctggtaactccaaacctgacggaagtgctatggggcgaagaaaaaccggtgcctgtgcttctgatcgaaagcgaaaaattcttgtgctattttttggtaccgcttttttcctgtgctatggatcgaattttctcaaaagtaaatgtcgaccttgtgcataaggcttttacctagcctgcctttctagactatatatgaggattcaccttttttctcattgaacatttattgattgtaatcccatctatttgtcggacataacgtttgtaatttgaggtttcatgaaacaatcatgtgtctcaaatgtaattgtaatcattattaattattattgtgatttaggccccaattggaactgttgaatatagttcgatcgcccggcctggctgaatggcagattatttcattcatgcttctaaacataccttttttaaaaaacaaacattcaactgactcccgtagaccacattagtaaactatttgttattttttaaaaaaaaatcaatttaccgcaccaatcaaatagaccatccatttcgttttatcccggtttcatcactttgcaaccatccttaagttgtattcgttacctatggttgaaaacaaatccatacagcgcaaaaaacagaatgacctattagagcataattaattaagaattagctaaaaatactataaaaattggataatatgttctttttaaataaacttttctataggaacttttttataaggtgcactttaaaaaatatgcgcgttaaaaatgatgaagtgaagttgggaatgtgtcttaagctagggttagagtaaggctaataatacagccgatttgttggctataaagttctttgcagacttttcttaacccacacatataatagattaatagttagctatttacaattaatacagagtctacttgtctctcatataattttttggttcttatgcccaagtcgactgtaagtttacagcccgctttttctctctcctcgtatttcctccacctcagtatttagccgacttacagcctcctattatacttgctcttagggtatagagtatcatttcgagcaagctttcgctttttctcccggctgtctacaacttgacatcaattgcatggtatgagcaatgagttacagctagtgtgaacatgtttcccatattgtaacgtatggccactcggcggctagtaatcttaaaaaaaaaaggagagctgacatcaattgcatggtatgagcaatgagttacagctagtgtgaacatgtttcccatattgtaacgtatggccactcggcggctagtaatcttaaaaaaaaaaggagagctgatgataaacgtaatgataggcgtaggacgccatcctcccctgccgggggactccagtccacagtccgcgaggaattcctccaatctccaatctttttgcggcttccatcccctgccgggagcagaggcgcatcggctagctagagctttcgcttgtccatcttgccgtccgtttcctgagctgtacacgaggacgttgctgtgctgcatgcgtacgtcagtcgatcggtcagttcgtccagctctcgctctcgcatccatccgtccgccgttcgtgtcgcctgtcatctcgttccaaccgaccatgagcgaccggataaacccaacctgatcattcttcccccccgggaatgattgcaccgtgccgtgctgtcccaaaatatctcccgcagaaatgttgcaagattttgtttttcagctggtgtaatttgctcgcgtttcttatgtaacctgtaacaatggtggaataattcgatcaggagtaactgagaggaaaaaaaattgatcatttcgcctctctgttcagagcagagtaccatcccgaagcatcatacagcatgatattcgttcggtaatgacgccgctaatgatcaacgtaactcaaaacagcgacttggttgcttttggcaaatagtgccggtgcagtccccctcctttttaaatattgcccatcatgtaagattgtacttgtcaaaaaccaaatcctttctgctcaaccacagagcccaacatattgcagaggctcccacaagtacaagcttactccttttcttatccaccccaaaaaccaaccatcaaaaagaatattgtattgctctccatataaagtttgcataatggcaatccatgttgaatattctcattttacataaaaaaaacaacatcttaaactactattccaattccgtcttactaaattgtctttggttaacacaacctctttaagtaagtaccacatatatatacaggtaattttcagggcaacatattggcttcggtgttgggctcagctacaaaggtgtgatgaagatggcgagtttatgaaggttgcatgccgtaggcttgagacgacagttatgcaactttttgtcaattatggttggagatttacaaatagacttcaataacgtgttctccttatcttagatgggttattttttattttaagtgcgtgttctcaatgttttgttgaactacactttttttagtgtaactttgtaataattggctgtagctcgttttgagtaaaggctgggatattctattccattatcttaaaaaaattgtaagattgtactgaatttctacatttgctaagatgagttttcgagcaattggaatccttcttcttacttctctatttttcaattatgggtttgttccacttttgcgactataccatgtacgatgcacctaggacaaaacgcagatatgaaacctgctgtccgcgagtgtgtgccttggccgccagcgccactagatagcgcggtacggcccgcgcgggctaaacggccgccatgcagacagaccagcgccgccgccgccgcaacgtgtgtacgcgccgcaacgtagagtacgtacgtacgacgtacatgggcctccacttcacggtcacgaggaggcgctgcatggagcgcacgtgcgtccccacttcaccgtcatgttgccgggccggtgcatgcacgcgcgggccctataaattctgctgcccccacaggccacagcccgttcgttgtagggtcgggaatccaacaggccgcgcgccgccgccgtcgccaattcgtcatggcggcgcgcgcggtggatgcgagctgagccgacttgttgcgggtgcagcgtcatcaagattcacgtgtgccgcacggcacacgtatcggttttcaagtgtagtcatcgtgcgtgaatcttgatgatgctgcaccagcaaagagccggccgtatatatattgttctattagtattgtttcaggaagcatatgtgtgcatggttgtctacgtgcaggcaggcaggcaggcaggattagctttttggccaggtacagtatacattcaactctccagggtttctttaaaagtacgaaattctttttgacaggttttatattccttgttcttataattaatagcattgctgtcatctgttctcttatttattatatctgtctttgtttaaaaaaaagcactcctcatttaaaaatataagcatttctagctagataactgtatattcaaatttataagttattaaagttatatatttgaaaaccgaggtagtatgttcttaattttataatggcaacgttgtcatatcgttcttataatgcatatctccagtttttttatgatctaattaattattaactagtgttaccaattttcatgcatgttcatcgtggagattcgaagggaaccatttttggacgtacttgtatagggatgtcatgtgaaagcggcagtccatcccatactgatgagtgatgacaccacacactccccaaaacgaaaatgcattatctacggtccgtgctacttgtggcgacgacattcgggcaagatcagtggcagctagctaaatatttaaatagtagactatccgagacactggctttgctgtctgtccgacggccaatcggtctgggtacgagctcagttcacaatatatacagaggatggaccaaacagcaagggtgtgtttagctcacgctaaaattaaaagtttggttgaaattggagcgatgtgacagaaaaattaaaagtttatgtgagtagaaaagttttgatgtgatggaaaaattggaagtttgaagaaaaagttgggaactaaaccaggcctaaactcggcctaattgggaggtagaatttgttaacaacggttgtgtttagttacacgctaaaattgaaagtttgactaaaattaaaagtttgaagaaaaaaattggaagtttatgtgtgtagaaaagttttgatgtgatggaaaagttggaagtttgaaaaaaaaaagttataactaaaccaggccaacgtcaagtgtaatatttggaaactggaacgtaatgaactacatcaagctgtggcagtgcaagtatacataaagttaataaaagttgtgtaaattaaagaatcaggactcgattggagcttaaacatgcacgcataaagtagtagcaaataatatagtaaatgtccttttggcttcactcgtcttagataataataacgacattgactgaaatgtgacatgaccatttttatatggtttattttctaaactatgtatactacttatacatatgcttttacaccacactatctaaaatagcgatgcttgttatatatttatactccctccatccctattttgcttctgatgttcgaccactcgtcttattaaaaaaattgtacaaatataaaaaacaaaaagttgtgtttaaaatactttggataataaagtaagacacaaataaaataaataataattctaaaaaattttgaataagacaaatggttaaacagtacaaataagatgtcaaaatctcttatattagaggacggagggagtacaatgttaagcgctgcagcctgcaggaactgtgaggcaagcaaaatatatatataaaaaaaagcagtgggccggctgcaggaacagtgaagaagcaaaaaaaaaaaacacagtgggctggctgcagccggctgctgcacctgcgtgccgaacaggtccatatgttgttgaatttataagcacaaaataatttaatttattccataactaacataatcgtatcatacaatctacacatgtaaaccagacattatagcatgaacagatcgaatatgcgaaacatattgaaggcgtaccaagggatttgcaaaaccggctgctcagcgggaaggactcgtggtaccgtgcgttaacgatggtgcgcaacccgtgagcgaagaggaagaggagccgttgtggatgaacaaggagcggtcgtgtaaagcacttcccaaaaacattattgctgccttctcccggtgtaggacatcgaaggcgaaggttccggagacctgctctcccgatcgcagtacagaggaggaggcaaaccctagattgatttcgcatatgttgcatggaggcggcggctcaacttgagcgggatggagtagactacaagtgacggtgcagtacagaggaggaggcaaaccctagattgatttcacgtgtgttgcgtggaggcggcggctcaacttatatagagatatcaggacgcatgcacaatctccactccacgtaaccgtactaccgcgtaacatatccggactccacgtcgtttcacgtaccggaatattcggagtgtttccgaaaaacaaatccgaatttccaggccaggcgagcgagcacgtacgtgtgttccacctattctctccacttcacatgcctcaagtggctaggaaagcatcttcccttataaggaggtctccctctcctagaataggcaaggtggcactaaattcctcatgcatgccatcccatgatgtgggcttttatgattttccaaagaattaatcttgaatgggttaaggctcatctattaattcaaataatcccccaccaaatctcaaaatcccactgagatttgccttttctcaatgtactgtttatataccagcggtttgatggagaccaattaaggctgaatatccacctagaattctaagctacacttatttacaacttgaacaatggactatgccttgaattgcaagtcttttgcaagcaagtttcacttagagtcttatgtggtactaccgtactagaccgtcagtagactatccctcgtgtggagcgtataagtcatactccttgctctcttagtaagcttcctagaaaattcatccaaaatctccatagactacgaccactccagctcacaaaggtgcgttctttcaagaatggtctgcaggatagcatcttcgctaattaaagaacttattaagacataaccaacatgccttgcagctcatgagagtacatgcaacttcagttagagatggtttagattggtactcccctcaagttaaataatagcttgttcgtcccagggtctaattcacgggatctccaatcacataattatgttaccgtcatagtagaactcacatgggtctcaaacccatctccttcgatgcattgtctatcatatttcgtcatagtcccttcgtgaagggatctgccaggtttggatgtaattcaatgttataaccccaaagtttctcaaattcctgaatgacttcaatcgtcatttcacatgtctaaacgatttcatgttatccttagaactattcactttgaaaattaccatttgattgtcacaattcataagaatagccggccccggtatttcaaccacaagcatatccatcaatagatcacgcagccattctacctcaacagcagcagtatctagtgccgtcagctctgcttcgatggttgacctcgtcaaaatagtctgcttacaagacctccatgtaatagcagcaccacctagtgtgaaaacatatccactaatagctttgatctcatccacatcagagaaccaattagaactgctatatccctccagtaccgcgggatacccagtatagtgaagctccaagtccatagtaccttttaaatggtgcatcactcgctcaagagcacgccagtgatcatctcccgggttagaggtaaaccagctcaacttgctcatagcaaagaagatgtcacagcccagaaattcataagtaatttccaaactaatttgtgcattaaatcctcgtctagaaatcagctaaggtacataaactgacaatttatacaaattcatcaaaataagcaaagcgataaatacttacataagaggcacttagttctcaccaccaagaaaactgcagcggaaaataaaatctagcgaagctccaactccactcccacaggcagctcaactgggatctaaaccaaaggtcttctccttctagatcctttttcttcaactgagatttggtgtttattgcaaggtgagtacatggaatactccgcaagccacacagcaaatatgcaagtgcatagggatcgataccaaagaatggcatgatgtaggactcatttgcaaaagcatcatttagcaaagagttcaaaatttgtaaaatagtagagtaattaattatcaatattaatccaatgctatacaacatacctgctgcataggccctgccaaacctgaacaaccaaccccggtcgtacagatcaaacctccaaatcaggaattagccattccaaaccagaagttaaactaattatcatcaattatcacattattattattaacgagtagtgtgagactaatcaaaacattattagactcactcataaccgcgagcacggctattcgaataattttactctagccagagatgtaccactgtacgcacaagacacgatttcacacatgttgtcatgccccgaagtaccaccacagcactacaaagagggaaatcgtgacattacccttcacataacacaattcataacagtgcaccgttcctggatcataatcaccccctcaagagccagaggtatggactccccagcgagcctacggacttatcgccgctttacagtctggtgtctcgcaatgaaacacactgtacaaaaggtaaagtcgttgcccatactggcttgtggttgacacggttaatgtttcacaacagtagctcgcgaaccggtccttaattgtcatgagcacaaccatcaaaatcatgtgctcacaactctccattaatcaacttttagtttataattaattatcataacacgttgaccatcgtgagctaccattaaatataaccataagtgatagtgaagtataaattatcccattaatgagctaatgtttctaagcataactaagtaattacatctaatatctagttgaaccaatatataagtctaactagtcaaattataacccaagttatctaggaaaaaagagaaagctatagataaagggagggagtgcattggacttatcaaataaaaaaaagcacctaccttatgcttattttcctttggaacaaagatgtaccaatatcatttcatacaattttacaaatcttgttacttg

SEQ ID NO: 12582 - DNA, 20779 bp, Oryza sativa
agaaagtcttacaatatgaaacagagggagtattgaataacaataatagttttatttttattccagagatatcatactgaattattttttatttattttgtatttttcatgtatcaacaatcttatagagatgtttttatgcttttgatagcatttggcaattccaaaaatcccatgtcagactttttttgcaagttcaaaaaatgattcatgatcattcttcacattcagtcggtgaactgataatcaattgttctttcatggattattaaaacacttaactaatggtagactgattcccttttgtacaatttgctgtgcaaataattgttgaattaccgagttgctcctatgactttttcactgtgccaaaaatgattttgtgagcacctgcgggtgctggtcctcttgaagatggcaacgctatttgtcgatctggccaaattcaaggtgggtctaactgaatgcagaccatactatctctaaaagtgcctttgagcctatagtaagccaacttataataacttatattaaatttggaatgacagtgttttctttttgtgggtttattggcccgagtgaaatctagccagatcaaggccatgtgtgattttggtttctaaataaaagtaatggttatgaacggtatggttttccctttcttctcaggattgaatctttgaaatatgcatgaatggttagctttgaatgaacatttgtactgctgtattatactattaacaagtgcaacttttcaataatgtgacttgggatttagaaattaaggattaaaagtttgcacagaaaaggcatagagaagatattggtagcatttagctaactccaatagagggatggttgtgcaacctataagagagtagttaaaggaaaattggaaattatgtgtataactctgctgcttttcgatgtcatcgatacatcagaaagtaagaaagatgaccaatggttgagatgatgaacagtcattctgtgcatggtttcaaataatcaattattttcaagttatacaaattttaatttgcaatgcttttaaatcctcttttagaggaaccttgaagcagcaatgaggtgacatgcaaaatgcattttgcaccagaacaccttgaactaaaacgggataaatttctgatggtaacactaataggatgttaatttatatatttctcaagatactgtatagtaagagcaagtctccacatttcagaaaattgtgctttccttgcaacaaacggcacttggctagtgtacatctaaaatatcatttctagatcaccatctgtatcgctcgtttagtatgattacaacaatatgcaatttcccccagcaacaaacacaaaaatttggcactgatactactatatcatcctggtttcttctactgttctactcctaggattcaagaaagccaaaagaccgttctttagcagtaacacagaaactaatcaattccacatgaacaaaacaatagtaacttgctaagatttggaccatattatcacggtttcttctactgttctactccaaggcttcaagaaagccaaaagaccgttctttagcagtaacacagattagaaactaatcaattccacatgaacaaaaaaataactaacttgctaagagttggaccgcatcatcctggtttcttctactattctactcaggcttcaacaaagccaaaagaccgttcttgaacattaataaaggttagaaactgtagtactaatcaattccacatgaacaaaactacaattaatttgctaagagttgaaacatcagttaatcaagaaaggtagattgaaccgaacgcctcacctagcaggtttcttctcggtagcaagacgcgtcccgctccatgggaacttccccacttcctctccggctctgtctttcaccttggtacctccattcctcttcttccccagcctcccggggttgccgtacaccaccttgccgcggccggccctggagaagcccaccttctcatcctccatccagtgcttccccttgccctccccttccacctcggcgccctccaccgccttcctcctggcggcggcggcgctggccttgcgctccctctcgccgaggacaagcccaatggggaagaggtcgggggagacggggagcggggcgcggagggtgacgtaggccttcttgtagtcgggcttggcggcgaggaaggggccccggcgcagcttcttgccctccatgttgagggtgcggacctcggcgacggagaagccgtacatggactcgaggcagcggcggatgtcgaccttggaggcggaggggacggtcttgacggcgaactcctgtacggaggagagcggcgcgggagggagcatgagcttgagggggaggttggcgaagtggatcacgcggcgacccagccggctccccatggctggctggctggcgacggcggcgggaggttgggtgtgccgcctgtggccgtgggtggccagcggcgggaggcgtagggttttaggatccggcgggtccgctgtctagttgcggtgtgactttagcccatatccaccgtccggctcatccgacggaggacgtttggctgtgtgttgtttcgaacgatgtttcatgcgtcgtgcaaaaaaatgtttcatcgataaaaataaggtacataaacttgctcggcgagtgtaaataggtataacaacttgtaaattgctcgttttaatacaatagcttgtctagtttatacgaacctagtacaaaacaacacacatgcaaaattgatctaatgtgtagtactaaataatcatagtgagacatatccacgctagcagttgtttgtacttgtgcagacctgagcacactagcttaattttaaacatatcagtcaacaacgatactatattacaatctcttgtaggctgcatgcactactgtaggatcaagatgtcgactagaggggggtgaataggggatttaaaactaaatgacacctaatcaaaactaacttaagttgctaggcttagtgagggtcaactctaactaagcaactaagttatgttttgcaaacctagggtgatagtggctcaattatatctctaggaaagtaaatcacactcctatgtcaatgtttagcaatcctagggtgaaatgatctctagtatgtctctagaaatgtaaattgcacaaatataaatacaacaagtaaatgagacaaggagacaagagatttttcaccgaggttcggaaactcgccagtttcctactccccgttgaggcgagcccaactccaccgctcaaccacgaagccaccgcacgcccccttcgtcaagggatgggcaaggcgggagccggcccacggagaggactacccaagcctcggtcactagggtagttcttccttcactccgaaggtggtgaactcaaaaccactcacaaaccggcgccgggcctcctccacaatcttcttagagagatcaccgggcaactcctccacaagccgtctaggaggcggcaacctccaagagtaacaagcaatgacccggcgtggagatgatcaatcaagtgccacactagctctacaaatggaagcaaatgtacttgactcttgtctagagcaatctcaaccactacaatggatgaacactaagctcaaaggtgtgtgagagaggtgcaaggggtgtatgcaattgaattgggtgccaagagagccctcttgctgctggaaggggagtatttatactcccaccaaccaaaactagccgttgggggcgaaatcccccagctctgtgctctgccggtctgaccggaggtatgtggccggtcagaccgtgctactctgcaacggctagaaaactagccgttgtagccctgtcagagggccccatcggcctggccggtcagaccgacgttgagtggccggtcagttcggcctcggctcggtcagaccgccatcagctcggtctgaccgaatacggctccgtcggctctgtatcggccaccccgagcagcaccatcccggcctccagggggccggtctgaccgcgcatgtgccgccggtcagaccgccgtttcgtggccggtcagactagccagggcacgccggtcagaccgccactatgtggccgatctgaccgcccctggtcaggccgaacccagtgaaaaaaaaagattgtgtgtgtgagatgaaatgtgagcacaagtctaaatgcataatgacctagtgtggcaattaaaatcatctcattgctaggtcattaccccccttgatagtaaggcgaaactaaaaaataaactagcaaatttgatcggccttcacctcgatcaattttaaaactaaagcactagttttaccgttttcttttcttcgcttcacgtcatcaaattttaatccatcgatagtcatccatgcgcacacatgacgtggacctaacttaaaatatatctcaatagcaacggttagtccacaattagctcttgtcattaattaccaaaattaacaacggggaactagatgcttcaactactagagtacggattatatttttcaaaacaaaacaactactagtgcgcaaaggtgttagctggatgcatcacattagatcaattttacttgtttggattattttggcccatgttcacacaaattagtcaagttattgtaccaaaatgagcaatttacgagttgttatacctatttgcacccacatcataagttcatgtatcatgagtgcaatttactcaaatatattatatgttcatacgatttcttttacgtttcgtcagttaaaactcacggcttgtttgggaactcgagagaagaggattgggagtttacatgagggaattgatgatgagattaagatgaaaatttgatttctaatctcaatatcttatttgatagaggtggtggaaattgataaagagtttagttaaagattaggtcattaatgaaaatggatagttgacatttgtttaggcaaagtaaagaagaaattaccaccccctaccctgatattagaaaagagggagttcattcctcaattcccctccccatcccaccaaaattttcatgtcactcaactatacaaaatagttaataatcttatccctctaatctcctaatccctcttaaaaactgcccccaactaaacgggccgtcaatgttttgtagtggatatccatattatagttagtattttttaaaatattgcatttctgtaaaacatttcacaaagtggactgaaatattttgatcaagtgatgaaataattttctgtaagtggtacaacactgttttgaacatatatcttttatcaaaatgtaatcgtgtgtgatcttgttgttaaaatttaactaaaagaaatttaattgtgcaattagatttagaataaaaaataatttaaagtttactaatatgtgcataggaggagagagctcgtaagagatggcttttacgttagttgtatacatggagatatgtcagacatgtgtgactgagtctgggagtgatgcagctagtgcatgcgctatggagacaaaagggagtaggcatcaaaaatttacattaacgaacgtccgatacatggttgtgcccatgctaatgttatggttgcggccaggggcaaatccaacgtggggtgctggggggctttgagtcccctaccctcgttggatcccaatggagagaaggtgaggggaagggggaagaagaggaagatgaaaaggagtagggggactgaaaggatgaaggagaatatgagccctccctccccccctcgaaatagatctatactagggatgaaaatggtcggaaacggtcggaaaaaccctctaccatttccattttcattttattttctcgaaaatggaatcggaacggtatactcagaaacggtaacgatatcggtaatgtcggtatatcgaaaacggaaccgtcggaacgggaatctaccgatgtctgtcggaagtcaaaaattcatgtcggaaatagcaaatcgtggtatcatcccacatttaactatgtatgaagatgaccttataatttcacccttgcatgatcatgctgccacaccccacacaacaccgttatatgatgattaataagttgacaataaggtcgacaaacaatataaacaaagttcaatgatacttcaacatcaatgtggctaaagcatacaatgtggcttacatgataggattactgcataactaatattgtccgactttttttaggatatagatttgaagtcttcgagaacactgaacaccaagctcacaagctggcatggcttcagctgatcagctccttgtcaaacatcattcatcatttcatcatcaattgacatagctacatcgtcgtcctacagtggcacattgcataagaacttttatgttgacactgtataactaccattggaattaagtttcacgctagcaaagaaatgaaatttgtacttacctcaataaccaatttgtttgccataagctcagcaagctcaagatcaaccacaattgactgaatggcaacacgatctgaaaaaaaacaaatagaaatatattagtaaaatagttattgattgttgcacataaataaaatgtctaaactgttgtaattcttacctcttcttactccagctatccaatctttagtacaaatcaatgcttgtgccatttcagaatcaagacgactgcaatatggatcaacgacacggccaccagcgctaaaggccgattcagaagcaactgttgaggcttgcatagccagcacatcacgagcaagtaaggagagaacatgataagtatctttctggttcttccaccaagctaaaatatcaaatgtactttcatttgctttagtaaccttcaaagtttcttctgacaggtacttctccaaatcatttacttttgaagaagtgttatgtgtttcagcacgatatagatacttatcaagtgcactaacaaactcagttggatcttgatttgcatctggtgtatcaataggttcaaatgcattatgatttctaggaggtgcagcagaagcatagcagtcatacatgttccggatgatattgagaaattcagtaaccttaattggatgcatatcctagtgtatgaactccatgcaaaattgtactattctcatcttgaatctaggatcaagaaagcttgccacagcaagagcagtgttagacttattccaatatttgtcaaacttagcaagcatagcagttgccatccttctaatagtaatatcagaatccttgcccttactccaatcagtaagtataatcttaatgtcacagaatcctttgtaaaacaagtttgctgtaggatataaagtaccagagaaaagctcagtaagatcaaagaatcttttcaagaatgcgcgaattttcattgctttctcccactctgcagctgaagggcacattttctcatacctgcgccgatcataggatgtaagcctgtcaaaagcagccctataatagatagcatctgccaacatgagataggttgagttccaccttgtagaaacatcatttaatagtcctttggttgtgtccaacccactttcagaagcacacttcattaactcctcccactgcaacggagagccctttacagcattgacaaaggatttaattttctcaattgttgattcaatttcttgcaaaccatctttagcaaccaaattcagtatgtggcaggcacatctaaaatgaaaaaacaggccaatacatactaagggactgtgcttcttaagttcagaaattatatccttaacagcaacaaattatatccttaacagcaacatcatttgcagatgcattgtccaaagtcaaagaaaacattttcttctcaacaaaccatctcagcatacttgtagtaaaaccctcagatagtctaacaccagtatgacgtccttccacatgggaaaaggtgacaattcttttctgaatacaccaatcatcatcaacccaatgcagtgtgatgcacatatatcctttgttttgattggatgtccacatatccatggtcgcactaatgcggcatttcacagttttgagatattcatacaacttatccctttcctgcatatagatgctcaatatttcttttctaactgttacacgggatttcaatggaaagttagggcgcaacgatgtaatgaaatcacgaaaatattcatgcccaaccatattgaaagggtactcatgcatgattattgccacatataacttcctcaagctagcttcctcatcatacttgtaaggttcaacaacgttgatgcccttctcttggtccttctgagctttgagttgttgctgccctttgacaacactgtgatgtaatttcagatggctccaaaatccgcttgttccagtggcactctcacatctacctttgtaagtgcaattcttgaatttgcaatgtgcccactcctgtttatagatcttaccattctcatctatactcactttttccttgttgaagtactgccagacttctgatgtcaattttttccttttcacaggacgctcatcattgtcatcaaccctattaacatcagcatcaatctcaattgtttgtgaggtacctgtggcaatggttggaggtaccgctgattcaggtgtagatgatgatgcagtcacacccacatgatgacttccactggcacttccagatgcagcagattgagattttaaaaaaatgaggaagtgattaacgattaacacaaggctcaagctatacatctaaaaaaaacatgctcaaggattaagctgtacatctacagaaatcgtgcttgcacacatcaacagaaaatcatgctaaaaaacatcaaggctcaggcattcatctatacatgtaaaaaaatcatgctcaagcattcaagctatacgcctatacggctatacctggtggtggtggtggtggacctagcaaacacaacggtggcgaactcaatgttcctctgtctctgttgttgccgtcggatggatccagaagggtgcggcgttttcctccggcaggtgccatcttgcttctccggcaagggacgcggcgaggcgcgaggatgcgacggctaggactagcaagcggcggtgtggcggcgtggacacgtggttgcggcggtggcggtcaccggaggtagaggcggcacagagctgtgcgacagtgtgagacagcgagagtcgcgagacagggagagtatgagaaggataagtgacacgccggctgacgccctagggtttttcttcccagcctaaatgcctaatgggctgctcctgctccagctatacaggcccagccggcttccttctttagaagtttgtcgaaaatttgacggaaattaccgataaaaatggttaccgacaaaacggtcggaaaaaagcccatatcatttctactaccattttcggaagagattactgttttcatttccgataccgacaattactgataccgactgaaacagtcggtgcaaaccggaaacggtagccggaattctcggatatttctgtgccgttttcacccctaatctatacgatagttgattccttagttctacttaaacaaggggatatctgaaggtataaatacaaggccccctagaaagagagggacgaaatgaaggcatatctacataaatccaatgtagaagccacaaaaaccgacatgagggatttagagctaccttcaatctcgccgagttcatattagaggaagaagactacactagccatcaaccacatgtgagagctccatgccgctaggccgatagggattagattaggtcatcccatattctgtactcgtgagatattaatatacaaaggcaacattggctttgcccaacaggaacagggctattacccatcaagtagtgggtccgaacctatataaaaatccatgtctaatgtcttttttacctcaatctcacgtataccctaacaccaacgatcaccattctctttgaataccataggcgggcatagtctgtcagcaataacttgtatgtaactaacaaataatggcgggtatccgatttgctagcagctttgcactgaaaaatctcaaggtcgtgcgcttgaatcctcttgcctgcgcaataaatctagcaaaaaccatttgataaacctggctaacatgcataaattgcatatgatgtatctaatacattttgttttattttccacatattcgttttggaggaattttaaaaaatttaaatttctaaagattaattcctataaatgctgttcggttcataaaaatgttgacatagaaaaaccaaaagaaaaattcctttcctacaagttgtacagaaaaactataggaaggttttcatccactcaaacctcttgaaaattttctatgggttgaagtgtgcatacattgttgatctttttttttctccaattcctttggaacgacttggcccttgctagccaagtcactttgacaccttgacccgattcaaacaagggttaattggatacatgccattaaaaatttgctggttttaaaatataccactagtattcatgtatttgaaaatatgccattgtaatttcacacatattcaaaagataccactacttacctcttggatgcatttccagaaaaaaaatagaccaaactgccccttttcccttcttctttcttcccctttctccttcctcctctcttccttctcagcggcgcgttggcggcagcagcagcagatgcggcgcggcgacgacagcagcagcagtagcagcatcgatgcggtggtgcggcgacgagcggcggcagcagcagcggcgtggcacagcagcagtggcggccgcggcggcagcagctgcaacaaaaggcggcacggcgacgagtggtggcagtagcagtagcaacatcgacgcggcggcgcggcgacgagcggtggtagcagcaacagcggaaccagttggccatggcgctctcggcgttcggcagcgtcgccgcggggctcgtggcagtgccggtcactgtgttcggcactggcatcgacgaagccgtgctcgccaaatcattcaagaccgatgtgcccacaatccagaagctcaaggtgaacctgagtacctgactccacccaacaagccctaattaagcacgcttgctaatcttctctcgccattgtcgagtggctgcagtagtagggccacggcggcagcaatgagctgtagcgacggtgagcggcggcatcgcgagcagcattaggagtggtggggatggaatgagcggcgcagcgaggggaaagagttgaggggtagaaaatggggaagagagagaggtagaagatgagagcattttcattcaatacatgcaaaatacgtatctcagtgacaccactaagatttcaaacaagtagcagtggtatcgttacaaatatagacaaatagtaatgttatatttcaaaactgctaaaattttaatggcatggatctaattaacccttcaaacaatgccccttttcccaacccctttctctcgttttccgcgcgcatgtttttcaaactgttaaacggtgcatttttttaaaaaaaagtttctatacgaaagtagcttaaaaaataaattaatctttttttaaaaaaaattagctaatacttaataaatcacacgttaggccatgtttagttccaaaataattcttcaaagttccaactttttcatcacattaaaactttcctacacacataaacttctaacttttatgtcatatggttccaatttcaaccaaactaccaattttggtgtgaactaaacacggttattgccccgttttccaggctcaagcagaaccagcgaacacaccgtccttttcttacagaaaaagcctgcaaaactgcaacaaagtagtcctccaactccaatccattaatctcaaccgcatgtaaaagcacattcaaaggtcaaaatatgacaggttgctttacatcacgtcagtttagcctttaatttaacgttatctgttcttccattcccattaatccgccatcaatatggagcttttcgttaatcaactccaaagctaccatctcgtccgtccgatcggtacggcgatcatcgtccaccactagatcgatcagtgaggcagagacctctcaatctctcgcgtccctctcgctctcttcccgctattcttctcgtccagatctggacgtcggagcaccgcccaccgctcgtccccaccgcggccggtgcctcgccggcggccggctcgcccgcactgcctctaggtcgtaggagcactgccagctcgccagtgcggccgaagagcggcacgcactgccccctcgcttctcccctcctgccctctccgcgcacccgacatcgccgccccccacccaccacagcctccacggccgcccaaatgtcggacggtgaggagaagagggagatcgccgtctggttcctctccaacgcccccgccggcgagatccactacgtcgccaaaggcaatccccccaacccctcttcctgaccctcgcaatccaagctgtacagccccgtgtgtttcgttgtttgattcctcttcggcgtgggcgcgcagatgtgcgagcgctgctgggggacgaggcggtgtacgaggccgccgcggcggaggccttcccggagcacaacaaggcgcacctcgtggccctcgagctccctgaccgcagcggtgatgtgagcactgggccatctcctctccttgccgacttttgccgtcgcgtgttctcacgtgctcgaaattgagtgtgttctatctactgtagggttgtgcttgttgtagctcgtaaatcagcggttaagacttagcaaatctggcttttaggtagtgattaataaatcacttgtggctattgtgtttgttactttacttttattaaattcagtaagctattggtgtttctcattggtatgtttatgagcatgagactataggatgatgccttaacactcgagggtgggtgcttgctggccagacattaaaacaatgtgtcctcgcgcgcagataattatcacaacttatggggagcttgacaagaacaattatctggatcctaggactgctcaagttgctacagtggaccatattaaacaggtaatgctgcagactttacatctgcttatcctggatttagttcttaagccagctatgcatatttaacatagaatcttttaaagtaagagaacatatataactactaaacaatggatggtcatcttaacttatggtctatgaactatatgaagcagtttcacgtctgtaatttaatatgcacagtatcttgagcttgatggtttgactattcttattcatttgatgaatattaattgagaaatggatccaatcacaggatattgatactgaactatctttcttgaagaacatgttacattgaatatagtccacatagattagtattgtaactgaactctgcatgtaaaagtttgatcccacaagtttctactttttttatttacagtgttaactgaggaataaattatgaccataattatgaattttctggacatagattaagttacctattttcaatggaatagcatagatgtaggtaaaagagcttttcattatacctcaaatagtacatccagcagcagctgtattaagcttcagtaactagtattacaggtttctgcccaatccattttgtattaacttgtgttacctctagacaatggctttcattctctaacaccgggttagattgagatgtttggttaagtatttgtttttgaaatgtctatagttttctttgttcatttgaaacatgatgtgtctgctttaatttaagtcaccatgttttttgttttacatgttaaaagaaatgtacaaaattgaggccagctgctgatgaggagcttccttcagcatacattgaagatttcaggtaccataattatgctattcttttccccaaatttcttgaactccacattgccttgctagtcaatttatgttctgcaccttttgttatgggtgcaggagtgccctggatgttgaattatccaaatatgttggtgaagcttatccaaaaggggtgtgtgctgtttattgtaccagcggaaaagatatagagggaccaggagttgattttcgttttgcagcagttatttctgctgctaaacgcagcccacaaaacttttggtatgttgtctgagtctgcattttctctgttgttacagatacttgcctagttttctctaatcttgaacttgtttatatgtccattttatatatctcttctatacattttagatccttattgaggtttctagaaaattttggcattcctatgagaagctatttcatattcaacttctggatcataggtttgcacatctgtgagtgtttaattctttattttccctttgaactaatcatgtgttttgtgggtaccctctttatcatcttcccacaatattatggtgtctttagtttttatgcagaaaagtttagaattgtgctttggctgaatccttgcttcacataatctgttactagagtcgcttaagtcctctcgtcatagtttgacatttcattatttattcactgatggagacaactttgtattgagtcatccagcaacggcaattggcgctcaatttggactctggaattcatagatggattacagcttgtcgaaattaaagggaaaatacaggtttgcttttacttagctagcgctaaaacatggttaattattgttattgtaattgaagttggtaactaagatacatgtgcatataccaggtaggtgctcattattttgaagagggaaatgtgcagctggatactaacatcgattgcaaggattccaccatattgcaggttagttcatacaatacctattttttttatcctggcatgttatgaacgattgatggcatctgcttcttttgacctcgtgcagtaatccacacactatttcatcgtttgttgttttgctgctttaggtttacgtgctaagttcattctactgttcaatatattttggagaaaattttctcctgctttggtatgatttgctactgagttttagagaattatatatacatgtataccctgtaaacttagttgcgcatgcataagtatgtgctctgcattcatggatgaagtacagtttatgttactgatagattttcatagaaccttaaaaaatttatatctgcactatgcttaattgtgttgggttggtgcctgatactttgagttgttgtcgatattctattgatgcaaactgttaaaacaaacaaagttgaaattttatttatcctttttatttcctggggtgaactgaaaggatcaacttatgattgagtagattttttaatataaaaattgcacgggtaaattttgcccctatttcatttcctttttggttctggagtttttgcatgtgcttgtccggagcatttgtgtatgttaagcgtaatgttttgtttagagctgcattatgcttgcatcattttgcttgctttgtttttgcttgtttttaatcttcaccaggctgaaaaatgcgaaacccttaactgttcttttcatgtgctattactcgtgtttcagtctcctgaggaatgtgcagtatcaataactaacatcattcggcatcatgagtcagaatatttgtcatcacttgaggttgaaacctgtccctatttgtttattcaagcttatatgttaacataatgagtaatgccattcttttcacttgtgaacaggaatcatacatgaatttgtctgatgcaaccttcaaggtacaccaaggaggcagtaacaatttaagaatttgcatgatagttataatgctagtaaattttgttgctacttttacctatcctctgctcagttgtgtttactggttatatatgtgcacaggatcttcgaaggaaacttcccgttactcgtactcttttcccatggcacaacacattagccctcagccttacaagagacctcaccaaagaactggctataggaaaatgaagcttgtggaggtcagttcattagattagctttgatatggatttttttttatctccatgctatgtgttgttctgtagatcctgcaattcatatcctgtagccagcaattctcttgttttgatttctgggcttccacatatcagtgtaaatcaagaacatgcacttcttgtgaggaagttacatttcaagaatatatgatatctgaatgttgactgtgtcaactcatgttaactcttgctgccgtcatgaaacaaaccgggcaagcctaaatcgattctttgagatttgttgtatagaacattggtattatttgcttccgaaatagtggggtttcctgccaaaaattactgtgtttttacagccccattgtttcgcttattagcaaataaagaatcttttgtgagtaaaatttttatacttgtggctttagtgactcaaaagcaaatgctataaaataaactatgatgaaaaaaaaaaccaaagaatcataatcaaaattaagtttaaaattcaaattttggcttataaacataagtataagaaattgcaggttttagggattagccatttattatcttttcactgccgccgaggtgctgagccaaatacgtcaccacaccattgctgctcgtacggacggtcatacgtcccaaaggctcaagcctaaacctccaacgatcgtcctgcacgattgttttacccaccatttgttttggtatcattgggctgggccatgatatttgcagcggtgtcaagcatccgacatcaacggcggctgcgtagattgcatatctcggctgaggctctgccgtaatttcagccccgtgtagctatgccgttaaaagcacttggctgaattcgaggttaaacagttgtgctcacagtatgaagttatttttgtgatactgtgtgatcaaacaattcagcatgaatgcattgatctcatgaaattgaaaagatatatatcctgatgagcaggatgaggctcgtagcaaccagcaagctaggatcacagggaacaggaaaacaatatgcttttttcccctttaaattcacaagatttggtctcacacaagttacacacgaatcaaatgagatattatcagacaagctcatcatatcgtacaacaaatatgtacaactccgaatatgcaagcagagacacgccagacggccggccggcgtcgttcaagcagcagcggtttccgggtaaggatcggcccaggacgcgtccgccgccacggcctccttccatctccggttgaatatctgcatctcggcgaaggatcgccgcctcaccgcgatccggccggccgacgccgaccacccgccgccgccgccgagcgaggggatgcccctgtgcatgacgtactcgctgtcgacgacgccgaccttcatcgtccggtcgccctgcgcgcagtagccgagcttgtagtcgaggccccacccgtggacgagatcgttctgcaccatgccccaggtgcaccgccacgccgcgcgggagaacaccggcaccatcctctcgacccaccccgtgcacggcggcgccgtgctgccctcgtcgcaccgcggcctggctcgcctgtagaaccgccggtgcacgtcgccaccttctcctcctcctccggccacggtttgtcgggcggtgatgccgtggtggatctccgagccgcgcgccagcgccggctgcgagacctcgagcccctccctcctgacgatggcgaggtagcgggcggggtcgaaggcgtcgacctcgacgtcctcgtcccacaggaagatgtagtcgtactcggccaccacgtcgggatggaggaaccgcttggcgaaccaccacttcgtctgccccgccgccgccacgtgcaccgcgcggccgtgccactccaggtcgccccactactcgaccgcgccgtcgtagtggaacagcatcaacgcgaactcctcggcggggaacttggacaccagcttgtcgacggccgccttgttcttgatcccgacggggatcgccaggaggctcttcgacgccttctgccgcccgtgctccgggtcgccgaccatggactccatctccaggttcgactcgccctgcacgatgcccctcgggagaggctcgctacggccgccgccgccgtcgctcgacgcggctggcgcttcagctcgcttgtcgtcgcgcagcatcttgcgcgacagggtgatcttctcggctgccgccggtgaagtcgacgggctgatcgggcgccggtccttgtggtgtaccgtgacggccgcgccggcgacgaacaggaggacgagaaagacgagcgccgccaccaacatgtgcggagtggaccgcttcatctgcggccgcggcggcgacgagcccatggctgctgtcaagtaatcgtcgccgctatgttgcaccatgattgccatagagtccatgcattcaactttatactgaggatagggtcttggaggccgactccgaactggacacgtacgacgtacgcgacataagctgactccgaacgggatttggactactcttaagtaatcgactgataattctgtcaaaaaaaaatcgactgataatactcgccatcggtataccgatcgctcgattattatcgggtgctccaataacaaattaagcaactgctctttccactccattcatacgtatctcgctctaatttactttttttccctgagcttatttttttgctttgagaggtttgtcaaaataatctttctcctaaattatttatccaacatacgatttgattacaccgttatattcgttgtaattaaaatctttacattaagatatcacatgatcatattatgatgaaaaaaaatatatctttcaatccatcaacactcgatatttcatatgcaatagcaacatgttttcaatgtgtgtttcaccatgttttataaaatttacccaactagctacttgcccctactctcacctctctctccactgcatccatccatacatgcatacatttatgatgctcaaaacaattttttttctcctaaattacttatccgatctagtccaatcacacgttgtatttcttttaattcaatttttacaaccagatatatattccatgattatattctaataaaaaaaatcatatgtttcaatctgttaacactcgatgtttcatacgcgatagcaacatgattcaatgtctttattgtgttccacaaaatttttaaatgtttcattttttttatcaaatataacttaatgttttaccgatggtcaactgaaatatttgaccgtccttttctttgacacaatcggacatccgatttggagtttcctcctaaattgactactaaaaattagaaaaagtaaattttattttgggtcaaatttattggagtttcatgatagaagtaggtacaaagtactgcctctgttcacttagagcgtatatattttgactgctcatttagaacgtattttgatttaaaaagaacatttggaatattttgaccaacactaataaaattacaagtatattaatttacttacaaaggtgaccaataaattctcacttcaatgtgttttcacacaatattgctttcataactatttaagatgacaaatcagtggtgaacgtttgcccttgaagatgttttggaatcaaaatatgcgttacaacaggcttgctaactttgttgctaaactcgtattaaaatttctaattctattatatgaaccaagggcttgctaacctactacgaaaaccatttttcgtggcggccattttagatttttgctggcggaatttgcagccgacacaaagcaaaggccagtgaagatcaagatcttcgctagcggttattgaccgccagcaaaaatacattttcgctggcgttggcttaagacggctgccagcgaaaatggatttttgctggcggctgtgttaaatcggccgccaacaaaaatggatttggggaacaaaaaaacacgcatgcagctgcccagccgccagcgaaaatacccatgtagccacccattagttcattaattttaaatttcaaatctacatctagattcgctgctcatttccaaattcaaacacgaaatacaaaatcatcatcagcacagatcaaacatcatttacacaatcaaacatgatctacacagatccaaacatgtgcatcatctggaacaacatgcaaaaagaaaaagaaaaaaaaaatcaaatctagccgacggcggagcaaggtcgacagtggcggatcccgcctccccgcggcccggtggcggcggatccggcctccccgcgggccgccgcccgctcccgagcgccgccgcgcccacgcccacgcccgcgccgcctcccgctgccgtcacccacccgcctaccgccgctgccgcgcacccgcatcgcgtcgtcgtcgccacgccgaaaccgccgccgccaactatggggtgggaggagctagttagtgaggatggatggcgccggcgccggtggagaagagacggaggagagacgcgagggagagaagggagggaggggagctggagagagggggcgggtgggtggtggactggtggtggtggtggtgggccgcgtggtctatattaatagatgatggtccatctatgcaagcggtccttctaccgccagtggttgcttaagtgggccgccagaaaaaataattgcattttccctaccggtctgtataacacgaccgctagcaaaaattatccatcttcgctggcggcacacttaagtgaccgccagcgaaaatagacgggctgca

SEQ ID NO: 12583 - DNA, 5085 bp, Oryza sativa
tgaaaaatcttttttctagtagtgtaactttgttgttacttttaaccctacaaaatcgaatttggtagaattagatgtgtgtcgacggactatacccgcagacgatatttgtagagtatgatgatcgttggaaccagggtatacatgagattgaggcatatgagacgaaagacagagatttttatacagggtcagaccccttaactggcaggtaatagactaacagccatactcctattggttgaaaccggtgttgcttttatatatcagtatcatacaagttcaatatttgggatgacctaatctaatctagtcattgtcggcttggaggcatggagctctcacatgtagtcgatagctagtataggtttcttccttgaatatgaactcggtgaaattggagatagctctagatctctcatgtcgacctctgaaactcctacattgggtttgtctatttctgtattggcttgtattccgttgaattgtcctctcttctcctaggggttcttgtatttatagcgaagatcattttcctctctaagttgaacttgaagaaatataacaggatatagactaaggagaccttatcttccccaactaggattctaacaccttttatttcaggaagataatttccttctttatccgccgtattttcttaatcaaagtatatcttctcatatactattagatatatagtatttttgtatatcacgaacccatgtataagaggtatgccttatccttgacactagccatgtgttcttaaagtcttatcaaagtttttaaagtttttaagagtgaacttttgaaatttgataaaatatcaatattaagaatgtgtttattttgttgccctaccaaatttgaaagtgaagttggtaacaaagtgaacaacctgcaaaggattaagcaattcttagttaaaaaaccagttaaattagtggttatgaagcctaagataattgataagagtgcttaaagtgtacaaccgaataaggccttagaaattaaacaactcctatttttttttattttaatatataccctcacattatattggctttgttcggatgatatagttgcagtagcgttgcggctgtgctgtagccagctagccagcagttacatgagttgcttccatccagtattgagcagttgcttcttgcagctgtgtgtctgtgtagctgaatggctagaatgtataacataggctagaacgctgcaacaatggtctaccgaacaagcctattatgtttaaagatttctagctccatttttgttttttttaaatcactcttacaattttcagaataggttttttttcatggctatcttaaaaaaattaaggctcacgacaatgatataaacatgtgaaagatttcatttttttttataagaaacaaatcactacctcatgatgtaattctttggcaacgtgtaagaatgaagccggcaagaagcgaagctcgatggtcagcaacgacaggacacggctgctattccgcttctttccgctcggaccagcccactaccggcccactactgaagtgaaaccaccctccgccgccgccgccgctcgccgtagtcacctccgccgccaccctctcttcccagtgctacctccccgccccgccgctttgccgcctccggctgaggcgaatttccagtatccaagccagtcggacataagtaagggcggggaggaagccgtgcctgcgagtttcgaccatggaaggaggcggcgagcgcgcggcggaggcggaggagtaccactgccacgacttcgagtgggaggacctccgggcggaggtggaagccaaccctgccttctcctaccacctctccccatttcccacgaccgtcggcaccccggagacgccgccgccgccgccgccctcggaggcctggacgagcttccaccgtcgccacacatgcggcaagtttttcaaggtttcaatctccgctctcctccctgttaccctgcgcagatctgtcgtctactttttttttccggactgcgcaaatcgttaggaattaggatttctattgtgcgagatagatgttcttcgtcgtggagacctccagtcctccacacttgttgaagctgcgttgttgttgttgtgatgtgagctaggtaggcaggagatcgagggaatgacagtgccaccgtgttccactgtttctcgaggcatgaaattagaacggaactccccatggtaatgcaatcccttgcatagatcgacacgatggcctgtaataaattccatacatttgttaccagatcgtccaatcggagatgatggtttggaataatatgctgctctgtttattctcccatgttattcatggcttgaggggcatatatcatgatggatattacgggccttgtggacctcttcgcagcgcagcatcttgttcgtatgagttttgactctttgagtcctacactagtaactcataccacagggttgctatttacatcaatcgtgtttcctttgtgttaggtgatctagtgtttttctccacattttccacagtttgctgctattgtgcttgggtacaatgatatcaagaaaatgtgacctagactttttctgtgaataggtaaggataatatgaattgatgtagtaagacactataactaaattttaaggaaacaaataagtacttttaaggaaacaagtaactaacctgatcatctcattttgttaggaaagaaggtatttgctaaaggaatttccagaacttcttaacagcaaggatagtgcaaaggttttagaggtgggttgtgggaatggaagcactgttgttcccattttacggtaatgtcctccaaagcattgttgtatttagtaaaaaaatatctatttgtagttgcaaatgcaaatcgttcaatgcttattttttttgttatagagtaattaaacattgatgtaggattatagccgcaaatatatttggtactttggttatcaaagtaaataatctagacaaaataaaaagagaaaaaaaacaacatgcactttttaacacgcacactggtgattaaacagctaatggtcactagtttgctagtcaaattgccagtatgctggtcagacacatattctcgtgacatttcttacctgccaacgtgctgcataaaagaattgtacccaatacaaacaaaagtgatttcttgctttttgcttagacttcttggaattccatttccatgttaggcatgtgcatatttctcacttaagaaatcatccaatccagcacaaagtccatgaagtatacttcaatctccaccgatccagcataatatcaaagcaaatcaagcgatctccatgagatgcttttaatcgctcgttgccattggcatgcagctgatgtagtctggttctgaattttttccttgtttaactgccagttctgtactgtttaactattatgctttctagctcagagttggtttggaactttggatttgtcaagttcatgcatctttgaggataaagaatacttttgcctatgggcatttgaaaactgttgacacccagcatcaacaaatacttctcctttcaatttcttctgcttctgaagttatacataatcctggaatgtaaaattttctgtctttcttttctttctttgtttgtaacatctgatgatttcagtttactatatcatactttttgttaactagaaaacttgttaaatttcattcttttttatttttcccctgaaaagactatttttggtttgccacttttccaacattctgttctgtgcatggtgctttaatcagtactagtgatgtatttattaaggaattttatcgcaaactggatagctcaataatgctatgaacaatcattgtaatatcttcattgaagtgatgcatattggatcaactttcaattagcgatgaatatgcaactcaagcactttatggattaacacttatggcatgatactctaattatgtatttataattgggcgagagcaaaaagaatagaattaccgctatatacaaccttttaggagcatacatatatgggatggaagttgcagataaacttcagagttgaacgtgcttgccataacttgaagtttatgtagttcatggtttaagtgattgcctcgtcataactactaatgatgacatcgttgctatctactctttctacagctctagtccaagcacaactgtatatgcttgtgattgtagcaaagaaactctggagaaggcaaatgagattgtttgcagcacaaaaggagttgaagtcaaggataggttccatccttttttactggatgcttcgaaggaaacttttccagattggttgttctgcaaatcctgtcgaagtccatgtgcgaaggatgttgaccttttactagtttaattaattgttttgaaattttcttttacccgaattatctactccaataatgtttgattcgatggtaccttttcctttcaggctcaagtaattgtaatatgatagaagaataccctgcctttctcagagacaatccatgttgtgttgatggtgtggattttatcactatggttggtagcactatctttaccctattttttgtcaaagcacttccattagcattataatgttgccatgctgtgagttctgaatgtatattgtaaaagtcaaacctccactatttatgctcttgtttacatcaagtttgtatgtacgcttttcagatattcacattatcagccataccttttgacaatatgctagctacactagagcgttgtgtatctgttctaaaaccaggtggccttgttttgtttagggactacggtaatgccctggccatactattgtattatatatcattgatcaataatcttgctgacatctctttattgtattaggactctatgacatgacaatgcttcggtttttacctcaccaaagagtgggattccgggaatacatgcgctcagatggcaccctttcatacttattcaattagatacagtgagagaactctttcatgcctaaggaaaactagaggtaactgggattgttttgacatgttctcagttttatagtaactttcc

SEQ ID NO: 12584 - DNA, 259 bp, Oryza sativa
cgcccccccacccacccccgaggacttctgcctcggccgaattgctggcgctgcccctcgaagcatggcaccagcgtgcttggcgctgctcccccaacccgtagatcttctgccttgggcgggtggatggcgctgccccctatagcacgacacaagggtgactagcgccgcccaccaccccccgaggccttctgcctcgatcgatttgctggcgccgccccctagcacggcgccagggtggctggcgccgacctcttcc

SEQ ID NO: 12585 - DNA, 49767 bp, Oryza sativa
  unsure (1)..(49767): unsure at all n locations
tatatagtacacagctttacatgtgagattacaattgcgctctttgttgggcccacatgaaattacaatcgtgcccctgccatatcaacagaccctaagggcattttggtacattatgggggtcattatagtcttttggtgcaagctagatggagtggttgagtggtccctgggaatattctcttggcatctttattgtccaagtcgccttcttcatggccaagagtctttttcaccaacatggatcttctcctcgaccaagggtcttttccaccactatgggtcttttccatggcaaatagtctttaccatctcgaccaccctttccgacttatccgatagctgacctgttattaactcatgaaaaactcaaaacggataatgagacttagtgacaaggactcactcgaacggtattttccgactcgaatagtgttttccaactcgaacaacattttaccgtttccttgttcgaatgaccatttgccactcggatacttagaataaaaactcaatcttacccaatctcttcctctacagtgttttgggccaaatagagaggaacggtggtgacccctagctacaacataatttcaagaaaaatcctgaaaatcccgagaaaattctagagagtataattaaccacaaagagtttaataaaaattaaatccagccatgctttatatttaggaaattttatttctcacatttaaattcacttgtaaattaatgaacatttaatataaattctgaaaataatttattaaataatttataaaacctgaaacgaaaatcaggatgtgacagctcctcatcagagctagctcgatatcatcgatacagcctaaagggggtcctgggatgctcaagagcatgtccatcatgagagctgatgtaatttccccgctggtttggatcttgtctacaaaaaataagctaatcggcaattggcctattccaagctgcctggcagcgctcgttggatgatagaactcatatgaaacctaaatattcctgccttgatggatgccgacagggagtatgcagggggaaatggctgctgtaagaacttcatgattgatttgtcaaatctaaaattagccggaagctcaaaattttcggaatgatcataagcaaaccatattctggagtccctggatacccatcacaaaaattaccgaaccaatcagaaaaaagctcagccgacaactctgatccagcataagatgccgcctctccaaagnacatgcatcgactggtggaacttttatttccgtcatcatcttcagttggatcgtcggcagaaggaaatcttgcttcagtcagggctgacctttttgataccttgatggtatgcaaattcaaacaaacttggaaaagccaccagggaccaccagtgccgatgacggtatcgacaacagtcttagctgatgcagaaccaagagtttgatacagagccaccaggaggtacttgcccaaaggaagttgcttcttgtccactagagccacaccagatgctgccagttggaggtaggcccacaacttggaccacaaaacaggaacttttgtaaccacatcatcaggaaggccacatgttccctaggggttacaagaccagaccccatgttcgaagtaacaaagccagaccagcctccaatgctcttggttttataggaaaactagcttttggtgctcaaactgattgggttggctgacgacgtgacatccaaactcgtaatcatgacaacgtccaagagagttggagtcatcggtccctggccgaacaagaaggcattcaaggtattggaccagaagtaagcggctgcctacagcatgggctcatcatttttcatatcggctatggtgaggggctaggcattgtgaaatcccaagctcatcccagtgagtctgttcgctagccaatatcctcctataccaatccggtcaagttttgacattggaggaaggccaagacttgaaggtaccagtccaatggcctaaaatagggttagtccgtctaaagaggactttgttggtcttggcattgataaactgagtaggatctgtgtcactgattgggtccaaaaagaattggtgctggttttgcaagctaggaactgcaacttgacgggataggtgctacaatagaaggaagaagagatcagggaagggagcacaaagtggtaaagagacagaaagggcctagccgatggtgcttacctcggggaactcgaccaccggagcgcttgagggattggcagaagacattgccgaagtcgggccgccgccgaaacaagggatcgcctgcagagtcgctgagcgaattactggagtgattgggggaagtttttggccaaggcaattgaagcgggggagacgccgtgaaattttcaaggtggttgacactatttaaaagggcgcgttgacggccgaaacagaaaagaaaccctagatgcaagcggaaacaaaatcgagcacatccgcaacatcgcaaatatcacggacttgaggggcatgtgttaatgatcaaaattggtaaatcaaagattggatccgaagtcagaaccaaagtggatttggtggaaatctgtagcctcagaaacagaacccacatcagctacgggttgcatcggctgctaccaaatcgggcaaggaggagccgatataactgatcccggcaaggcgatcaggagattgttgtctagatcggttcaagtgctacaccagtattgccaagtgtggattgagtccggagaaggcaattgtacctattaattaggatattctaatagtttccttatagatattttcagtaagagtccacaggacttgttcgtatttttgagttgtaatagagatagagtcgtgttcggcaaggacatatcatgtattttgggtataaatataacccaggaccctgtaaacaaacaacatcagttcgataacactttcggcgcatcgccacccttttttcattgtttcgacgagttcttgctttcgagttgggctgcatagttttcgatctccgacgaaaagtgtggagattatggataccccatacctacacggcatgtatatccgactgggtatggggtgccctgtatagatagaatatctttaaaaggactcgggttaattaccaaacttgtatgtcaaggaaatacccgggatcctagtcggttacgattgtattttatctggaattatctattccgttagggatatggtttgtactttgtaatacggaccccttcccctatataaggaggggtccgggtgcctctaggggcacgattttctcccagatcatacgatcaataatacactctgcggatcaatccccggacaggagtagggtattacttcttggttaagaaggcctgaacctgtataaaatcccttgtctctgaacccatccacttttccagcttgatagccacccccttttagtattgccgaaatcttgtttcgacagttggcgcgccaggtaggggcagcgtcaagttcttcgccgactagtgtgatgggttccgtctccggcatcgacgacttcgtcttccctcccggacaggcgttccggttcggcagcctcgacttcatcaccaacgacttcggcaagatttctctcctcgactcggattcgaaccagtcgggaagaggtcagatctccgccccgttcggtaccccgaactcggccgaggtctaccccaagatcatctctgccgagttggcttcaaaccactcgtacgagatccaatctactcggacacgaccagatcaagatgatgggtcctatcccccaatcctgatgagacttcccgatgatctggctgctgtcttcacgaccaaggcatctcccacccgaagacctagacgggatccggcttcggcttcgatccaatctagttctagggaggtaggcgttatatttcagcctctcgggacggtctcgacggaagaattggattgctacctcagctcccccggcgtcagttctcgaccaacggagatcctcgagtacgacgacttcggctatcgctacgactacggtaacttcgacgacagctacgaggacgactacacgcctctctttttcggtgtattcatggccaacaacgagacggcagaacagtgctgagcccgagaagcggaagaagaacgcacacgacaagaagctgaatgtcgccgactggaggaagaatgacaacgacaagagcgagaacgactacagcgtgaacaacaagatcgcgaacgggctgcaaaggaggctgaggatcgacgacagcgcgccttggaatccgggcgacgagcacgagatctcatcgggcaacaagtcgtcgacgggacagcggttttccgcacaccctaacagaacgcggttgcagcgatcaccctcctcgacaccctcctcaaggaagacgcgctcaatcaggctgatcacgtcgtcaacatcttaaaccagacaaagaccatgatcgccgcctcggtcccggctaactccgcaagcacccgcacgccgactggcagccgagttccccctcttcgatctcaagactatcaccaaccaagcctcagcgtcatcggcgcgggatccagtcgcaggagcaggggtcacgacgagcgatctgtccattcgcctcccgaacgacacagggagcgtcgagttgaacgacctcgtaggcaccccatcgatcttcgcgataccatcaaccagcgccgcgcggcaagaggctgtgctcccaaccattcaccagaccgctacgacgacgacgtggatggagttgctgccttcacgactgacctgcgtcgagtggattggccagccggcttcaagccgagtggaatcgagaagtatgacggcaccactaacccggagtcttggctcaccgtctacggtctcgcaatccgcgcagcaggaggaggtagcaaagccatgatgaattatttgcctatggccctagcagattctgcccggtcctagcttcacaggctaccccgtggcacaatcggatcttgggcgaaacttcgcgaccacttcatcgccaatttccagggcacctttgaacgccctggcactcagacgatctctacaacgttgtccagaagtccggagaatcccttcgagattacatccggcgtttttccgagcaacgcaacaagatctccgacatcaccgacgacgtcatcatcgccgccttcaccaagggcattcgccacgacgacctagtcggcaagttcgggcgcaagcctcccaggacggtcaagcagatgttcgagaaagccaacgagtatgccaaagccgaagatgctattaccgcgtccaagcagtcgggcaccacttggaagctgaagaaaaatatgccgaacacaggggggagtggaagtaccaatcacaaggatcgcaagcgtaagcccgaggaacttgtggcaaccactacaccatcctcccgacaacgttcgcgcgtcaatacttttgataagatcatgaactcccaatatccgcatcatccaaattccaatcacgcggccaaagattgcttcgtctacaaacagtttgcagagcaatacgccaagaacgcacgcaagaccgctgacggagatcaaagcacgtcaaagaagaaggatgatgaagacgatgccccgactggttttcaagaccatcgcaaggaactaaaccacatctttggcggacccctggcttatgaatccaagagaaagcaaaagttgactgaacgggagatcaatgctgtccagcccgacacgccccaatatcttcggtggtcagagacgacaatcaagtttgaccgctcggatcatcctgaccgagtggtccacccggggcggtaccccctggtactagaccctgtggttcgcaacgtcaagcttcgcagatccctcatcgatggtggcagtgcgctcagcatccttttcgccaagactctggacaacatgcagatccctcgcacggaattaaaaccgagtaatgcgccctttcacggagtcatcccagggctatctgctacaccacttggccagatcactcttccggttactttcggcactcgggagaacttccgcacagaaaacgtttgttttgaagttgctgatttcgagacagcgtctcatgccatactcggacgcccggcgttagccaagtttatggctgtcccgcactatacctacatgatgatgaagatgcctggtcctcgaggagtcatatccctgcggagcgacattaaataagccgtcacatgcgacaaggaaagctgcaagatggcccagacccgcgagatcaccctcgctcgagaagaaatccgactggctgcgtccacagcaagcgaaggagaagtgcctgcaaccaaggtgccaaagagcggagaaagcgacgccaagaccaagaaaattcctctagatccctctgatcctactaagactgctgtaataggcgctgagttagattgtaaataggaaagcgcgctcatcacctttcttcaaaataataaagatatctttgcgtggaaaccatctgatatgccaggtattcccagagaggtgattgagcactctttacatgttaaggaagacgctaaacctatcaagcaacaactccaccgtttcgcacaggataggaaggatgcgatcaaggaagaattgactaagctgttagcagcgggcttcatcaaagaagtccttcatcccgactggctggctaacccagtcctggttcggaagaagacggggcaatggcgcatgtgtgtcgattataccgacctcaacaagtctagtcccaaagacccttttgggttacctcgcattgaccaggtagttgactcaacggccggctgcgagctactcagtttttttggattgctactcaggatatcatcagatccgactaaaagaatcctactgcttgaagacttcattcattacgcccttcggggcctactgctacatcaccatgccctttggattaaagaacgcaggagcaacttatcaacgcatgatccagagatgtttttcaactcagatcggccgcaatgatgaagcttatgtggatgatgtaatcgtgaagaccaaacagaaggatgatttgatcgcggatctagaagagacctttgcaagcatccgcgccttcaggatgaaactaaaccctaaaaagtgcatcttcggagtaccgtcagggaagctgcttggatttatggtgtcccatagaggcatacaagccaacccggagaaaatcaacgccatcctcaacatgaaaccgccgagctcacaaaaagatgtccaaaagctgactggttgcatggcggcgcttagcaggtttgtttcgcgactcgacgagcgggggatgccctttttcaagctgttgaagaagacagacaatttccagtggggactcgaagcacagaaagcctttgaagacttcaaaaaacttctcactactccaccagtcctagcttcaccacatccgcaagagccgctgttgttatacatgtcggcaacttcccaggttgtaagcacagtcctggttgttgagcgtgaagaagaaggccatgttcaaaaagtccaacgaccaatctacttcgttagcgaggttttggctaattccaagacaagatatcctcgggttcagaagctattatatggtgttttaattaccgtccggaaattatctcactacttctaaggtcactcggtcacggtggtcacatcgtttccactcggggatatacttcataatcgcgaagcaaatggatgaatcgcaaagtgggccttagaattgatgtctttagatatatccttcaagccgcgaacttcgatcaagtcccaagctttagccgaatttgtcgccgagtggactgagtgccaagaagacatgcccgaggagaagatggagtattggaccatgcattttgacaggtcgaagaggctttcaggcactggagccggggttgttttaatctccccgactggagaaaagattgagctacgtattgtggatacatttttccgcgtcccataacgtggcagaatatgagtcgctgcttcacggattaaggatcgcgatctccttgggcattcggcgtctgatagttcgtggagattctcagttggttgttgatcaagtcatgaaagagtggtcctgccttgatgataacatgaccgcttatcggcaggaggtacgtaagttggaagacaaattcgatagacttgaactcactcatgttcttcggcacaataacgaggcagccgacagactggctaattttggttcaaaacgagaagtagctccttccgacgtgttcgttgaacatctttacgaaccaaccgtgccaaggaaagaaacaattgaagccacggatactcaagacgtaagtatgattgaagccgactagagagagcccctcataagatttctgatcaaacaagaactcccccaagataaagatgaagccgagcggatttccaggcgcagcaaactctatgttattcatgagaccgagttgtacaagaaaagtccatcaggaatcctgcaacgctgtgtgtctttggaggagggaaggcaattgctaaaagatatacattcaggcatctgtggtaatcacgctgctgcacgaaccatcgttggcaaggcttatcggcagggttttttctagcccacagctgtgtccgacactgacaaaattgtgtgaacatgtgagggttgtcaatttttcgcccgacaaactcatttaccagctcaggagttgcaaaccatcctgttgtcttggccgtttgcggtttgggggcttgacatggtcggcccattcaaaaaggcagtcggtggttatactcacctctttgtggctgttgacaaattttccaagtggattgaagctaaaccggtcattacaatcatggcagacaaggctagagatttcttcatcaacattgtgcaccggtttggggtacctaatcgtatcatcactgataatggcacttaattcaccggcggagtatttaaagacttttgtgaagacttcggcattaaaatttgttatgcctccgtagcgcaccccatgagcaatggacaggtcgaacgtgccaatggtatggtacttcaaggaataaaagcgcgagttttcgaccgactgcatccttatgccggcaagtgggtagaacagctgtcgtccgtactttggtccctgcgcaccactcccagtcgagctacgggccagtcgccgtttttcctagtctatggagcagaagcaatgtttccgagtgaggtggaatttgaatctctacgatttcgcaacttcagcgaggagcgctacggagaagaccgagtagatgatatcaaccgactggaagaggcccgtgaagcagccttaattcagtcggctcggtacttgcaaggggtgcgtcattatcacaatcgcaatgttcgctcacgagcttttttagtcggcgacctagttctgagaaaaattcaaactacacgggatcggcacaagttatctcccttgtgggaaggaccgttcataatttctgaagtcactcggccaggttcttatcgactcaagcgtgaggacggtactcatatcgacaactcttggaatattgaacatcttcgtcgtttttatgcttaggcattacttttgtatcttcagctttgactgctaacatcaagcttttccttgagttatcagtcgggggctactataataataatggagtgtgacttttatcaattcaatttgcttacttgatttatcattgccttgtttgattttttggcttagtcaatgaggactgaaagttttttaacaacttttgtgggttttaggctcaaaaaggtttgacaaaaacttttaagaaatcgggagctaagtttgaaatatcaagcacaacataaattcatcagtattgtacaaattgtgcctccatcatcatcatcatcatcagaatcactgttacagtataatatcaatcagtatcagttttctcatcatcggaattattagatccagtcggccggaggtcgttgtcctggaatctctcaactacatcaatggctatcttgtcggcggctttctacgcatcgttgatgaggtcaagggcggcttcttcgctcgtcccgtctgcaaatccatcaatggtgtcaacatcaatcttcggttataaagacttggtcattgccaacgccaggcttgctcccatacttccggcctctttgatattcttaaagtatgtatccggagcgattctcagcttgtcgaagatttcggaagcatcaaatgtactcggaccattgttattgaagaacatggcttggacgagtggggtagcagcgttggcgacttcatccctagccccttcaagccttttgattttattgaccaagacatcgaattgagcctgagacttgattttgcgatctgcgtaaatagatttatatcaacgagtaggcataaagataagaggtattagtcaccagtaccttcaacatctttcagagccgaatccctctgtttcgccaatttggccttgtcattctccagagtttggatccgcttttctagttcagatatcttggcggcttgcactgtattgcttcttgattaattgatattacaaggatggcagcataagtaagttagacatagattgtatttaccttttgacgaaccgctcagttcaaagttggattcttgaagctcggcgatccgatccctcagatcatgctcagttttcctggcaagctccttagccttgtgcagctggtttctggtggtctcaagggttccaagatgaggaactaaattctcaagagtcgcggtcttcgcctcgttcctgagatggattctctgcaatgcgaatttatcggcatttgagcaaagtgggaaacaggatagttgaagctatgtataaggagacttatatttacgatgcgagtagcctggctgagtgcctttttcagcaagcatacttcctcatcttccttttgcttgtttatcacgattccctaaggttgcatatcatcgtcccaccatttgactaaaataggtggacgagaatcctcagctgactgtatccggaggacttcttcttcgtcgccgaccattgggccttaggcatttatgaataaaggtgaaacaattgaagaaagtctgtcagatcaaaatgggttcggaggatgtgtttacttgtgattatttccggtcggggacgagtaggcccttgtaatttaacaagagagccggaccctagatcgacgctggcatcctttttaggagggctgtcagcttgagtttctacttcaggaatatctttgtttggttctgtacccgactggtttccagtcgggggctcctgattagcaccaaccccagtttcggccgactggttcccagtcgggggctcgttgctgggttctacattgtcggtcgccggttgattgtcactcgggtgatcttctgcagtcgggtgatcttcttttgaagaacccgtctccatgtcagtcggttcagagtcttttccagaaagatctatgtcagatggcttcctacgagtttgagttatgctatcagtacaaatcggagcgtcgtttcgtcttccccgccgagactctcgccactttccccatttcccgctacagtgcaaaaccacaccggcggaagctagggttaacaaatccactccaatccatcctcctgagctccacaaaaaccctccacgcaaccaccgcaccgaatccccatccatttccagccatatctcggaccaaatcacaccatccagttcgtattcatgacggaagagagagaaagcttcgagagtcagtgggcgccctccgatgtaacagaggagaatttgaaagagatggtggcgcacggcgttcttctggcgaaggagatcattggatggcgtccagcattcggcgaagcattcccgacccccgacacacatgaagtcgtggtattttctcatttcttctatggcggattttctcttccaacctcgagattcttccgggggatttttgatttctatgggattagtttgcatcacttaaacccgaactccatagttcacatcgccaacttcatacacgcctgcgaagcttttttggacgtcaggccacattttgccttattccgtcgcatcttcttcctcaagccccaaccaaacaagagtaaaccatgcgtagttgggggggctggatttcaattgaggggaactctgagccaaaagtatttctccatgcccttcaaaacctcaaacaaaggctggcatgcaaattggttctatgtacaaaaccccgagcctgcactccccgagtactcctgtctccctccagtttatcaggactcttggaactcacttccaatgggagaggaagccgctcaggcgcttgccctgatggaccgtatgctgaagctgaaggagcaaggtctgcaaggagaacagatcacccggcattttatcaagagccggctagctccaattaaagagagatcctgtacagccttcaaatttgatggcaaacatgacaccaaccgtgaagatcctgaatctcttgaattcaaggttatgaaggaaagaatgtataaaatcttctcgaatgcaattgtagttagttattcgcacttgctgccagtggtgccatacaacgccttcaatccttctccaccggtatgtattcaaacatttcagcctttctcaaaagcatgcctttatctgctgttaagctaattgaaaactcgaaatgttatacccaggaattcgctttgatgaagtcggatcctccaattgctcaacgccgatcaccccgctggcgaactggtcaggcgagtggaggaccaaaaattcagtctgacactcaaacaaacacctcgaaatcaaccagtcagtcggactcccgcaagaggaaattggttctgagtgatgatgaaggcgataatgctagaaaatctggcaataaagaggtgaccgggaaacaaccaaggcaaaccaatccgaagaagaaaacatccagtcgtcccatgccgatttggtccgagatatggctggaaatggatggggattcggtgcggtggttgcgtggagggtttttgtggagctcaggaggatggattggagtggatttgttaacccttgcttccgccggtgtgcttgcttctgccggtgtggttttgcactgtagcggaaaatggggaaagtggcgagagtctcggcggggaagacgaaacgacgctccgattttggcgtttatttcgctagggtatcgggagtactaatgggcctaggcctaaacagtacttcagcccagttttgctatcagcgtgattaagttgtgatccatagggacttaggcatttgtttttgtttcgtcaacacttgctcacaacagtatagcccaatgctgttaaaatcctttttgacgcagttagataattctttggaattactacgatgcaaataaaaaggtgcataacataaaagtgttatactaattttgtaggcctttttaggctgcaaagattgtttgggttttcttgagatgactggttttaatacagtcatccactcggcatgttatatgcttattttgattatgtcatgagtcatagcctaggctatttagactcgtcttttatcagattttatgccacatttgataggtcttttgagagtttttactcggacttttatcatctgtgctgatttatgaacctttggagtgcttctcacttgggtttttctttatatttctttggcacattaaagcagtcggcgggaggtttaccagatgctgcatatgcttggccttgagatatttatcctggaatcctttaaagggtgtcgaaggcatattttttggcctaggcctaatatgtctgcagcccatattttcaggtgtggcctatcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttacatagctgccctactgacttttttatatagtcaaggtgctgtttgggtttataaagcagttgattggatataatatcattgctttttgccacgtaagtgtgcatttttattaactaatattatggctttggctgattatatattgtggtcattttccaggcggttggtaaatcgtttacgagtttatttactcggatgttacaccacatatgccatatattttcaggtgtggtgaaatcatgtgtcttttagggacttaagcacatctgttaaagaagtgtgctcatggtgtatgcccaatactttggaaatttctttattcacaacatcaagctcttctttatagctgttttgctatgtgaatttccaaaaatgttgtcaactttaggttgcacgcatcatattctgcaaagcagtcggtatatcacttggatcatattatttgggggattcacactgcatatgctatatattgatatcaagtcacttggttgataacaattatcaaaaaccactcggttggttggattatttattccttgactatatgcttagtttgttcaactaaccatatagtcgagggctacacctaattaggtgcatctagtcgatgcacctgattttttctatttttcagcccttcacagtctttgattatattactcgggagatcaaaacagatgaagctaaagcactcggattgtcttttcggattatgagagaagattattccgtcgactgtaaaggtctcaggggctactgtggagattatggataccccattcctacacggcatgtatatccgactgggtatggggtgtcatgtatagatagaatatctttaaaaggactcgggttaattaccaaacttgtatgtcaaggaaatacccgggatcctagtcggttacgattgtattttatctgtaattacctattccgttagggatatggtttgtactttgtaatacggaccccttcccctatataaggaggggtccgggtgcctctaggggcacgattttctcccagatcatacgatcaataatacactcggcggatcaatccccggacaggagtagggtattacttcttgattaagaaggcctgaacctgtataaaatcccttgtctctgaacccatccacttttctagcttgatagccacccccttttagtattgccaaaatcttgtttcgacaaaaaggtaaagcttgttatagcggcttgcgttctcgggattagtgcttacatcttcatgacactctaatcctgtttatataaatcgtcgagttatcatatatgctatgtaatctaggtcgatcttgctacctaacctcagcggctagcctctatcatcgaaaacagtcgacatggttagatactgacttcgaattagattacatagtgcatctaccatcttcaaaaggttgccatcgacttgtttaaattttatgcttctttctatgtttaatgttgtatcagttaagtttgatccattaaagcattacctggaatcgtaatatctagcttgtttcatgactgctactagagatactattggggtttcagccgatcttgcctgatttagttgtctcgttacttatatgcttactcgacatactgaatctaccctttatattaagatctcttttgaatgaaatatattaaatttgttggtttattctaatgagtaacgagtggtatcggagtattagtcgatacgcattagatttaccctatcagctatgctatgaatatgtataatctttactccaaagcacttttaagcgcaagtaatttatactgtctcggcacactgcccgatctatcccaatcgcttagcttaaatatattcttgaaatatagattatatatcattgatatctacagccgatcgagtggatctaactcttttctcgttacttacttcattgccgatctgacctgcgttacatcggcttggtgctaaatgatatgtcatcggcagtccagccgatcggctatcgtttatggatttaactttggattctttgtttcttgttggttgcaggatcaaactaactagcacgccctgaacctgaaggcaaatctttggacctgcactagagtaaagcaaacctcgccagtgtgtgtttttcacatcaacaccttccaatccttgtacacatgtatgattagcaggaggttcattttatcgcatgtcgggtgcatttttatccgtaaatggcctgcatacgtatatttaccaaaactagtggaaggggcagtgatgtcgacgcataatgggcgtagctgccaacatgaatttgccgcgttgaacgacggacttgacgcatgcattgcgaacggcacgggtgcagccgcaactacaagccatagctcctttcctttcttcttcttcttcttcttcttccttctttcttctttcttccttctttcttttcttctctctccctccatggctgatgccaaaaagtggctcggtcggccaatgacagcgtgacgaccgatggctcgatgcacgaaggtgcactcgaccatgatgggatgagctcgcacgggcttgtgtctcgcgaacgacgaggccacaagacgagcgtggaggccgactgctagtgcgtgatggcttgctcttttgcctgtccctgtctggaacgatacgacacatcttgtgtggagataccccaatcggcttgcgccggcgactccaagtcgacagttgcggtgttcaccaggaacggcaaaaacaaaacgggatggagagagtatttcattttcgtaattagatcagcgaatgcaaaacggatctacgagttgtcatccttctatgtgaattagaaaaatgtgacggtgatgtcatagatctaattttacaaaatttcagtggcacccagccaatatcacgaatagtagtggtatttttctaatatagaaaatttacgatgatatggatccaatctatactttttataaagttaaagttatagtccactaagttcaacatgctaccacgccacatcattacccactaccaaaaattacatattcaacctcatgcaaatatacaacatcatttacaatttatttaattctacaaatcaacatgcaatcatatccagttatcacctctcacaaatctatctatcatttttatagtattaaacatatagttatcaatatgtttcacattaaaacgcaggtatcatctgtttgttttatgataagtactgataaactctgatgttttattattttttttcttttacttttagcttaattgtcgaaaaaaatattgagaaatacttagtaattttcgtggcaaaacgtgagaaatcatacagttaacccatccaaacagtccgtaaagcccgtaagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaagagggcaccagccgcaccggccggcggaatggcggcgccgcccaaggccttgaaggcggagtacgccaagtccgggcggtcctcgtgcaagtcgtgcaggtcccccatcgggaaggaccagctccggctcggcaagatggtccaggccacgcagttcgacggattaatgcccgtccgtatcctctccctccacccgctctcctcgccgacgatctttctccgttcagttgatgaatcttgctttgatctttagggtctgggagggtagggttttggtgtggcaggcatcgtgttcttgagggttttttgtaggttggtttggattctgagaattttctggattgatgggtgatcggttttcatcctgatttgcattgcgggtgtgggttttgtggtcatctgccacaagaatcttctgctttcatgggtggttggttttcatcttgatgtgcattgctaatgtgggttttgcgggcatttgccataagaatcttctgctttggtgggtggttggttttaaatcttgatgcccgaaaaaaatatgtttctgagggtaatttcgcatgattttgtggggtatgatcgaaccaatcttcttcgaatgcggagttcttgatgcatttggtttggtgctctgtcgatttgtcgatgatccgtcaattccagcattgggtttattgctgtttctaatccattatgcaatctatatgtgtaacgcaagaatagatagaggtgcttttgtgggcaccaactttgacatatgcaatttaactggtatttctcctaagttgtttgatatattagttattatgcggacctgccagttggttgtgctgttttaggcttttagcatggcaatggtcctaagttgtttgatatattagttattatgcggacctgccagttggttgtgctgttttaggcttttagcatggcaatggggcataccaatgacaatgttagtaatctagtgtgttcgctaatctgtttttgttcttatctgatgtgtagtttgcaaattataatctaggtattcgtttgcccgctttattttctagtttgcctcttgtaattgttttgtgggtgcatgtgtattataagtgcttacctgtattaggcaagataaaacttggaggggagtccttattctatttttcattttttatattgcacatttggataatgaatctttatttcttttggtcggatcaactcagtactcatgtggttatgtggactagacactcaaattatttcactgggaaatgtaggatcgtttagggcaacttagggggtacttttggatctgcatgccatttttcacctgaccatatctttttattttctgtgatggcccttattttttacctgaccatgttctttaatatggagtgtttataacgttgtaccttttctatgtttatagtaattgttttattcaagaactataactgtttggaacttttttttggtcatggtagattctcgatggtgcagaagagaaaactcgatggttatatgacatatctttccatatcaattttacgaattgaccacttccaattaattttagtgcccttttctctttttcagatgtggaacatgccagttgcatcctcagtaagaaaaaccagataaaatcgtatgcaactttatcttttactgtttgcatgagtttcacgctatagtattatggtttattaatctttattgcatctattggaaatctgacctaactcaaagtgtcgattcttcatttcaaattagtgttgatgatgttgaaggaatagacacactcagatgggatgaccaagagaagataagaaattatgttggaagtgcaccagctactgcaagttctgcagctgctatttcagataaatgcaccattgaggttgctaaatctgcccgtacttcctgtagacggtgtggtgaaaagataaaaaagggaacggtctgtatcttttgatctattaattttttatatgctttctaattcgtcccttgaggataggaagttttatgccatgaaaattttatgtttgtactttgttgcttttcaaattatagtcatgaaaataacctcctcttgatgattaacaccttacagtcttatatgagcattcagctaacaatcatagataatcagaagtttcacattcttgaatgaaccttgatgcagcatgtaagaataattaatcataacatgtttcctattccttatagttactccctgggaaaaatactgtattgtccaaaattctgcatgttactttgttgttctatactttatttatttagaacatgaactttagcgctcactaaggatgaaatggatacccgacttggtcctagcacttgaacacttgtagctggggaggttaaatagcttccctaccactatgccattggcatgttcttttattttctgaacttgcatctgggaaatgtatggttctgatacgcagggacaccataggttcttttctgtaccctattccctgtggcctgcatcatgttgcatataatgcccaagcttttgcactggaattccaagtgaccagaaagcctaaaggccacagtttcccatttattttgtagttactctgctacgtgccactagcaagcattagaactctgaattttgtgttaagtttactttatcaaatgaagtaacctgcaaatgtattaattggaagagtatttattatgttcatatttcttattcatccacactcctagttgagtactcctaatgaattacaataattaccgtggagaattatatacaggaaaatgtttgatgatccagaagtactattagtcatgcacttagctaataatgtatgttttgaaaacatatgaattgtaactgtgatatggcaacttgtaatgtaaaaacatggtctttgtcttcactctaagttgtttctgtaatagtattattatttgtttgtctaggttcgtgtttcatctaagcttgaagggcaaggttggtatcacgccagctgttttctggagatgtccccagctgcaactgttgagaatttctcaggctgggagatcctgtcgcatgaggataaaagagctgttcttgatcttgttaagaaagatgcccccagctcaggtaatgaaacatgggcatcaaattttcttcgcgccacttcgtaatctgacttgatattttgtattgttgtttctcaagggcaaacatcttctaagggttccaagcgcaagaataatcagaatgatatacacgactgcaaagctcccaagataatcaggagtatatcagaaggcacagcagaagataaagggaaagctgttgtatcacatgattccaatgctaattcttctgatcttcaagaaaagcttaaagagcagagtgacacactttggaaattgaaggatgaacttaagaagcatgtgtcaactgctgaactaaggaacatgctcgaagcaaatggcaggatacatctgggccagagcggcatctattagaccgttggtaatattgcatgctatttgtgaaatggtttttaacttcctggcttcctgcactacattatttccatccaatgagtaattgatatttaaacaaactgcactacaaggatcccgcatataaatatatccttggccagttggccgatgctacttgatagaggagggtacgattataactgatgatgaatggtactagtgtacgaaatttgtcaggatagttgttccccaagaccccaattggtcatctatgtaattttttgtcgctagatttattttctgcttgctttctggatcccaaatcccagttgtaacatcctggttatagggtttgtgatactgatcgcttagtggaattcagaattgtcaccgtaacctaatgattgcacactatttgctttggttcttttgtaatctggttcatgtatacaattattatttccttaaaagtggctataccttttctttctaaaaaacacattttaaaaatttgatgtgtgcagagaaatttcaaagtcaggcagcacttaagatatttgttttcaggcaaaaattgttcaatagtatttaggtctgaattttttatgtataattcaaggaagacaaacattattgattgcataataagctttacaatattgttggttgcgtagacctgcttgtggcatttccttgtttcatctcacatagaagtcagtacacttcgtcgctaactttcttcctcgtctggcagtgctgatgggatgctttttggagcattgggtacttgcccagtttgttctagcttcctatactatcatggtggccagtatcattgcagtggctatgtgtcagaatggtccaagtgtacatactctacgacagaacccgtgcgcagtaaaaagaaatggaaaattcctgacgaaatggataatggttatcttacaaaggtatgactatggctccccacccccacccccacccccacccaaacccaaaagaatatcgttcttaatgcttggtttctacagttgaggtaagcaaatatgtatgtatcttgcagtggttcaagtctcaaaaggctaagaaaccagagagagttcttccgccaatgtcacctgagaaatcattgtgccaatcaacccagcaaaaccgatctttccttagtgaaggactggataaattgagagtttctatagtaggacaatctaaagatgtggttgtaagtgatcttttactttttggtacagttatcctcaggttctcttgtgagttgtgttcgttaaagcaagcaccaattatgccatgaccttgctgcatgttgtggcatgcaccagacgccctttattttttccaatcacagttactttgcttacattgttatccagattgattcttaccatattatacagattatatatattatgcatatttgttgtgtggcttgttgacatgaaattggaaagtgctcaactgtacatgcttcatatatttgtttgtttaagtcaattccttgaagatagctagtttagtttgttaatttattccttgagttcctcgattatttctttaatctccaaaaattttaatccatggaatatgcagagtgaccacatttagattgcagagcaaaggttaggagagtgtaggttttttccctatgtacttgattcagttcatgttaaattcatgtcatttgttgaataatagatcaaattttatatgatctagcatgctgcttttgcatcaagtggtaagatagatttgcaattatttgcatgggatactgttttcttttattttttcttctctgctgatcagttattgggctatacatttttctttttcttgttttttggtttgtactttgtacattcctctaaactaatcatgtaatccaactactgtaggatggatggaaacagaagctgaaagatgctggtgccaactttaatgccacagttaccaaaggtttttcctcgtgttatcttttttttttctgaactacacaggatttcctcgtgttatccagaactggaactatcttgttcagacatttgaacctttcatatttggttacgtatgacattggaacctatatcttcacccaagtgggtgagcagtttgacaccaccccatgaccaaaagccaccactcaaattcctaaaattggctggctctcacgtatgtgtaattttagactaatacatgacacttaatctaactgatgttttgaaagtataagtaaaatgcattgtctaactcatgattttttatgggagagatggattatggatcacttatgtgcaggtgataattttatgttatctatctgactgtctctatttctgtaagaacatatgggcattgagccagtatttttgtgcagctgatataatgaactgagtcatgtgacttggtcattgtttcataggttaggtaagctcttagtgtttggtgaaatcttttcgcattattttcacatggaagtcttgcactgcagacagcagctgcttagttttatgtagtgagcttgagagtgagaatgctgaagtcaagaaagcaaggtatcacattttactttgcccttatccttttacacttacagtttgacctattgttttgcgaactactgtgttacctattgttttgcgaactactgtgttaaaataccattatatatgctacttcatttcaggaggttgaagataccaattctgcgagaaggttaccttggagaatgcattagaaaaaacagagtgcttccatttgatttgtataaagtagaagctgcattggaatcttcgaaaggaggcacaatgactgttaaagttaaagggcgaagtgctgttcatgagtcctctggtttgcaagatacaggtcatattcttgaagatggaaaaagcatatacaatacaaccctgaacatgtctgacctgacacgaggtgtgaacaggcaaggattttgctcacagcatttcttgtcaaattcaggatttgcacttttaggagtgattgtcaaggcatatttcatatgagtgatatggataaaccgataaaccctccagcaattttagtcaccaaacaaagaacgtggattgcttctcaaatccaacttcccggtcttcccttgaactaacagaatgatataatgctaaatttcccatggttgttaagttataatgttgagtcaagtgcaaccatataaaatagcatgaacattttggaagtactttggtctggtttggtttggtttggttttcattacatatgcccctgaagtcatagccctcgtctcttgttcaagcccaacttagctttggttgtcaatcattccacgatgtctcgtatacatatatgaatcacccgatctagaatgtcttatttactgccattctgcaataaaaaatgttggagcttgcacaaatttctgtttcctttcctctcaatttatgttcgggagcataacacactgttgaaatgagggggaacttttcttctgtagtattaccagttgctaaatttctgttaggttattgcaaataatggtgaccctgcttgccctacttaatcttttaacagttctctctctctctctttttgtctgtgaagctattatatacttcaggtcattgaagaggataatgggtctgattgttatgtattccgaaagtggggacgagttgggaatgaaaaaattggaggcactaagttggaggagatgtcgaaaattcatgctattcaggaatttagaagattgtttcttgagaagactggaaacccctgggaagcatgggaacaaaaaacaaatttccaaaagcagcctgggaaattttatccacttgacattgtatgttgtgggataatgtttttacctgctggatttttttcccctttttagtggatcatgtggattcaatctgatgtgtttaatatattgcaggactatggtgtaaggcaaggaccaaagcggaaagacattgacaaaatgaaaagttcacttcctccccagttgctggagctcatgaatatgcttttcaatattgaaacatacaggtgcgattttactgttctattttcaggttttgcatgtgcacatgctttgtttttagtattagaaaagaatttcacattattttgtaccagggctgctatgctggaattcaaaattaacatgtctgagatgcccctgggtaaactaagcaaggaaaatatccaaaaaggtgtgatactttgctcattgtggaactcattttgttgatctgtaagtccaaacatatcatgattctcttgcctgcactgcatgcaggttttgaagcattaactgagatacagaatctattgggtaacactaataatcaagaactggcggttagagagagcttgatcgttgccgcgagcaatcgtttcttcacccttattccttctattcatcctcacattatacaagatgaggatgatttgatggtgaaagtatgtgttcattaccttgtgttatattcctgtatattgggaagatattccatgactattcttattttttaaaatcacgacagttttaagtgaaatattttgctataaaaccttccttttgcaaaagaataaaggcgttctatgatcattgctgaaattgaaatgggtccattccacgcacagatcgtacatgacttgtaatgatatcttggcagttaggcatgttccataatgctcaaatggaatcgaaggaacacaaaattgttatttattttgtcatatataaatttggcttccagtaaactatgttattgaagtaaaaaaatgtattttcgcactactttcatttatggttcaagttctcaatgactctcattttgctatctagttggaacattttagaggatgttataataaaaaactaacatacctatggcatttttccttttcttttcctttggttcttcacatgttctccttgccattagatacagtgctgttcttaaatgcaatgatatctcctgcatattcaaggaaaaatgtgttataactgtccaccgtttaaagggctgttttggttcttgtgttattttcattcttattttctttgactgatcagatgtatttcttattgccaattgtaactttattcagagacccaattgactgtaactttggtgcaatggtgcaggtgaaaatgcttgaagctctgcaagatattgaaattgcttctaaacttgttggcttcgatagtgacaatgatgagtctcttgatgacaagtacaagaaacttcgatgtgccattacgccactccctcatgattgtgaagattacaagctagttgagaagtatcttcttaacactcatgctcctacccacaaggcatgtattttcttctgtatacaaaaaccttatagttttttttttctcttttgtagatagtacaatacagacgattgtttctgttttcttctgtataggtattgacatgtcctctttttaaatcttttttgaaggagtggtcactggaattagaggaagtcttttcgcttgatcgagatggagaattcagcaagtactcaagatataagaataatctacataacaagatgttgttatggcatggtaagcaatctatccaagtaatgcaaacacatttggcttacgcaatatttgaaaaggtttttatactctcagtatttagtgccaaaatctaggtttgagatgaaacttattatccatgcgcagtctttgccatggcagtgcgtaggtgaacagagggttcacagtcaatccaacagttgtaaatgtttattttactagttcttcgtgtggtttactcgtgttgtatgttatgttgttatgtcagtatttaaaaggctactttttttgtaattgtactggagatctacttaacgtccctaagtaactctttccttcctaccatttgaatgattccatgattgcaaaacttaatttataggttcaaggttgaccaattatgttggaatacttagtcaaggactaagaatagcacctcctgaggctcccgtgacaggctatatggtttgctctttgttcacttcataaatggttcaactgtagcactggcaaaagattggttgaatttgattaagctattttcctttcaatcaacagtttgggaaaggcctctactttgcagatttagtaagcaagagtgcacaatattgttacgtggataggaagaatccagttggtttgatgcttctttccgaggttgctctaggtgacatgtatgaactgaagaaagccacggtaagatataaagcctctcactaccaaaagagaaattctggttataacattaacttgaacttctatctttgctttgaaatatgatcctgctttaaggaattgaccatggcatttctttcctgatttttttattgtgatctatatttctttgctgattcataattataagaaaaagctcaacgagttactcgagtgcaattacttgttttttttccccatgtttatcttggcttggcaccacactcactggcttactgctggctgctgcagtccatggacaaacctccaagagggaaacactcgaccaagggcttaggcaaaaccgtgccgctcgagtctgagtttgcgaaatggagggatgatgttgtggtgccatgcggaaagccagtgccagcatctatcaagacatctgagcttatgtacaatgagtatattgtctacaatacatcccaggttcagtcaaattgttatccatactcttttgcgcgcttctgttcatcagaagttcagttccttacctttcacgaaaccttatctctggcaggtgaagatgcagtacttgttgaaggttaggttccatcacaagaggtgactagaagacttgaggtaggagtagaaatgtagaattaatcagtggaagtatctccatcgttatcagtagtctgtggtggctacgcttttgatgtgttagaatgatttatccagtagtttcaggttggtaggaggttatgtgctgctcgcgtatgatccgttttggggtatgttgcatgggcatcgcgcgagtggcgcaagtaaatcccctgcgcatgccatgggcatttgatagatgtttgcctaattttctgtggcaatgtgcgcatttggcatctctgtttagcttgctattttatcatcactcgcgttatttgtgcgttgttgcgttttggctatctttctttgtattttgattcgaggtctatgttaggatactgcaatcgaaataaactgaacagcattagtgaatagtgccgtctgtaggatcaaagatagaggcgtgtgactgtctagcggaagtaatattcttctatcctataagtaacggttagtctagcacgacaattcgatgagcatagattgcaatagtttttccccaggtattagtgatttggtaatctccgcttgttttgtgcccttctttcactctggtttgtcgtcgtccttcacccttcgctcggggtgctcccacttcctcttagagagatcacttgacttgatagccacaaagacacgttatgaccagcatttagcctcaaagtaatatttaaccatatgatcaacaatatatagaacttatcattcttgaggtgtggccgtcatgagtttattccaatcatattattagaaaacagtaggcaccgcacgtgaggctcaggcgtccacgggaactgccgacggcgcagcaggggcatgcaggatggccttgggctcgtgctcttccttctcctcgtcctcctccgcctcggcctcatacgcgtcacgttcctggacccagagctccgcgaactcgcagttcttgtactgctcgaaccacggcccgccggaagtgtagtggatggcgcgcggcgccgtcccggccgtgtcggcggggtcgacgcggttgtgccccacgaggaagttccacacgaagggcacctcgccgatgtcggcgtcgtccagccacatgaagcggtgcaggtacgcgccgctctgcgtgctcacggcctcgggcgtcagcgcggcgcggttctttgggtgggcgcagttgaagagcaccatggacgaccagttcttgcgcgggtacaccgtctgcacggcgccgtccatcttggtggcctccttgggcgcgtagtcgtggtgcacgcacagcaccgcgtagcgcgggtcggccatgcgcgccagctccgcgacgtcggcgacgaagaggaagtcgcagtcgacgaagagcgcccagccgcggtagccggccaggtggggcgtcaggaagcgggtgaaggagaactcggtgctctccgtgggcccgcgctcccgccagtacagccccgcagaccggagctcctgctgcacgatcgggatcacggccaccggcacggaggagcgctgcagcagggagcgccggcacacgcggtacgcgatgtcctcgcgcgagtcgtacccgacgaacacgcggaacgtctcagcggcctgcacgtcgccggcgccagctacagggccagtcatcacgacgtcgttggtaggcgtgaccgacatagtatttgttggtgatatataagcagaaggttagtagtactgtttgctagcttccccgcaaaaaaagaaaaaaagagtagtgtttgctagctcctggtgctacgtacgcataggccgtgcgagttatcacaaactcctccgcctttttaataagagcctaagagccctttgtcctttgagtgtggggagcgaattgaaacgaggacatgcgtatatgacgacatgtacgtcaacagcgttacgcttgcattattaggcccagggagatcgatgtccagaattatgcatatgtgtttctcttcttttgttgccaaaatcaacaaaattagataaaggaatcctatagctaaccgattgctgtgtggtccggcgccggcggatgcatggcgacactgcactgtggtgtgggcagcgcgcgggcgggaccgacgacagcgcgcgcgcggttgctaatttgtacgggtaatacgtggtcctgtcgtgtgaactaccacagcagcacggcaggaacacgcgcagctgcatgggcagttgggcactctgcctccctgcgtcgattgctccacagtcgtcgtcatgtcccgatcctaattatcacgtcaaaacagctaggcaagtgttgcttgtttttttttttagataataagtgttgcttgttgctccatcgttttcctttttcaattatatatgttattattcacattttcactcagtattttattactaccttgtagaagtttatcgagaatgcatatagtcaaaaatgtcttattttggatgtccagaaatgtttataatttgagaagatgtagtaaaatttacatccaaaatggacaattataccttcctttcgtggcttcacttccatgtgtataccttatggttgtaaatatttaacatttagaaaaaatattggttaaacctccaattttacaatagcataagtttataaaatatactacatcctattcttttttacttgccgttttagacattgatacggatataatttacatattttatcattactttttctaaacatattttttacaagctataaaaacaataattatatgaaagttttttttacaaatatctactgataccattttcacgtgtcaactcctaatattttagaattaactaattaattaatatttgattttaccattaattttaagacatcatctacttgagaatctacttgagaaacggatagtaataagtttaaagaatggtggtggttttgaaatcgggatcctctggattacagtttgtaatgcatatgaccaagagcagatcatgtcatgcgcttcggtactcaatagtggattacaataaatacagttcgcatgaataatgagcctctgcattactgcagaggatccagatctatggctttgacgcacgtttatgcatgcatactaattttttaaacctaaacatttgataaactattattaatagtgagattacaccagtaccaggcttattttttggtactaacctccgcctcatggaatttttttttcttgtagcacgcatgtaattttttttcttgtcccgagatggctgcgttgcctctcgtacgtttggatggatccgcgagggagaagcgtgaccctcgtggtagcatcccgatgatggaggagcgatgccagttgcttcccttgtcaccatcggaaaacaggtgtgtggtttgagctagggatgacaacgggtcagatcgggcacggcagagtaaaatcatgcctgaacccatgcccatcgtcgcttgtccaaaccttacccactagggttagcgggcaaaactctgtgcccgtacccatgcccgacgggcacgggtatacccggcgggtacttaatggatctcatatgaatagtaactcgaaagatatacagtttaacaaagagaaataaaatcaacaatttaacaatttattagttatcaacaataatttgaattacatcataacttattacagtggcgaatccagaatgaaaatagaggcggtgctctaatgaccagtgtcaacgttgggaactagaatatatcgataagtgaaccatgtatatctcactatgtttgtagaaaaatctcacttttttagctctaagaccgtcaatcaaagatcattcatatttgctaatatgaaattaatggtgaagaaccacgttgtctcgttgatttcacacctctctctagccatcaggtctctgcccccatatataactacagctaaaataatttgaaatgtgccatatcatagcaactgtgactggagcacaaaacatccgagaaaacaaagcatgaaagcagtagtccaagtaccatctagtcattttcttcctccaaacggtagctagtcataactactgcagcattagtgacatagggatacttaggacctagtagatggagctggggcttgcgccccaacaagccccaatactaaattcgcccctgacttattattagttagtatcacaaatgaaccaagagaaaggggcataacaattaagagataagtcgaaattagctaatacatatgtatcgggtcgaacatgggttacccagaggcaaaaaaatgaaacccggttgttacccacgatgtctacgggtttcgggcggacgtgcccacgggtaaaaattcacacccacgcccatgcccattgggtcaggtatccgcggatacccggacccataggcaaaattaccatccctagtgcccacgggtaaaaattcacacccacgctcatacctattgggtcaggtatctgcggatacccggacccatgggcaaaattgtcatccctagtttgagctatactcctagttaacaaacaattataggttagcctggtgatcactcgatcagatatactagtaccgcatatgccacctaccacacacgtacggccgcacccgaccgattgatctttaactgtgttgaggactcggcgacgacatgtcgctgtgggaccacttcgattgatcgatacccggttgttggtcagatcagtttcagcgtcttatcttgatagtcatctttaatttgatagctcgtatgtaggatcaaatcaagtgaactaagctagaggtgaatagtaggaacaccgaaaattagtttttagtgtaactaaaagttacgctcaaaatccgatgacgttaattaactggtatgaccggtctaatcaccctctaaaccactgtcatcgatcgccaccgctggtctagccgctgtgaagccactggtgtgaccaccgtgccctcacaggtgtgatcaccgaaactgagaaaaacacaaatcgaaaaactcttgaaactagatcaactttattgtttctaattgtttttacaaagtgcaacaacagtactactctctcaagtttcgactaaacttgaaatttatactaaactctattttttctctcaactaaactctcaaaattgataccaatagatctcaacccatcttctatttatccccgaaagtagcaacccaaaagccataaatccacattaataagtagtcctaatccactagggaacctacccatatgcacgtacacacactacgccagatcaattcatgtgacggaccaaaatatctcgtcacaaacaatatcacctttgacgggttaaataaatctcgtcatagatgaggctaaaaaaaatgacccgtcacaggtaaatagtatttacctgtgacgggtatatataaggacacgacacatgacgtttgtgacatgtccacgtataaacccatcattgatgagtacttatatgtgacgggttttaagtttgcacccgtcaaaggtgagtaacctcacctcagatattccatcaattttgacttataaataaggaaaccccaacccttccccactgccactgcccatctcttttctctcttctctcttctctcttttctcttcctccaccatcgcctttcccccaattgtgcaccagctgccgcggtctccttcccatagcagcgtcgccgcctcctttgcccgccgtcgtcctctaggagctcagggtcgccgcctccttcgcccgccatcggcctccaggaggtcgggcccggtggccttaacatcgacgccgccgccaccttctgaccgccagtcaccagattcgactgccggtgccttctcccgcctcccggtcgctgacgccgtcgcctcccgaccgccgggcttcaacactgacgccgtcaccgcctcctgaccgccgatcgccagatctggcccccgagaagccggatctggccgccggcgccttccctcgcctcccggccgccgacgccgccaagtctggcctccaggacgcggatccagccgccgacaccttcgccacctccgcaacctcttcctcgactgccggacaccgcctccttcgccgccaaccgctgaccaccagatccgacctccacgaggttgtgggatgcggatccagcatccgcagcctttccttgactgccggacgccgctgcctccgccaccgaccgccggccgccggatttgtttgtgcttgatgtcgtttgtgcttgatttgctaatgtttgttgcttgtgtggatgtgtagtttgttaaaattgatatgggtacttgtgtgatgtatattgttagattgcttcatgtgtagttttttgttgagatgtatttgatttaaaatacaaagttgttgtatcgtgtgcatcttgagatgtatttgatttttcttcatttcgtacatttggggtgaggaacttctttttttctgggtggtttttgacatctgtgacaggtgggaattaaaaccagtcacagctgttttgtcacctttgatgagttggaaagagtcatccgtcacaggtgtgagtcacgtgtgacgggctatatttttctgcccgtcaaaggttttaattaccagtgacgggctttcacccgtcaaagatgaagtgtagtcattagtgaccactaatctctgaccaggactaaatccgtcaaaggtgagggttagaacccatcacagatgaccggatctggcctagtgacaacttatccctttacaattcaaactttaatcttcctacatttggactctttccaaatttgactctgcttttcattcgcacataatctctcttgtatgccgtatggaatcttcacaaccacgcgtattgttattcagtctgagcattccacatgatctcctgatcatccgaacattaacgtctcccaagtcggctttcaatccatcaccgccaatgttctttcgaggcatcaagacacacctgcacatgaatcaaataacaaaccatattcgagcacaagttatttcccaacttgactcaacattaagataaaacagtattacacacgtatagaaatcataaacatgagataatcgcgagtatccaaagaaaacataaaaccgactctaaacaaagtccaaccgatcttaccgtagccacaacaccagtctaaccggcacaccctagtcgatctgatcgcaagagccaaacaaaaatccctgttttcgtactatcactattcaatatattgcataacagaacttcaccaattatccaccaaatttcaaaaccaatataaatcacatatcaattgttcatcacagaatatataaatgaaaaacattgattttacacgcacgtctacgattcatgagctgccagcaacagatgcacatggaaatatagaaggaaaggatccggtcgatcgaagttttcactaaaacttcaaagtcgttcatgtgaatatatacaatcataaatcatgtagcaaagtcccttcataaatttatgtcatgatgatatatagccacgttgccaacgcactgtgcaactactatatatagtgttattacagccatttttatacgttttatttttgctatttatcattaattagttgaccttttttttctcttgtctgttattcaccccgactgtagtttagacatgcaacttaattttgaatacagataaattgccatttttgtttgctttattttttaataccctaaatttatctagatgtatttatagttatatagataatattctaagtgcttttgtatcactttggtgtaattggttaagttcaacaaaatctttcattatttaaaaagagtaaaatgtgcgggtggtctctaaagttatacatgggtgtcatctaggtctctaaactcttctcaatatatatttttggatccacaaacttatcatgtgtgtcatataggtccaaacgggtttcaacccactctctgtgcactgacgtgacatgacatgaagtatatagatgttctgcatagcacatagacaacaataaattgtttcaaatgggactttctttttttccccttaaagggatatcgtcatatctacttttacgagcccacaacaaatcgggacctccacattcatgcatcattagattccccacccacatatgcactttattagcaaattataaactattttttcttacgaattaattatccgatatgtgatctgattgtattattaaatttattgcaattaaattttacagagagatcccacatgaaaatattttggataaaaaatattcgtaacagaaatatttttatatgatatatgaaacattgagttataaccgatgaaacatcacaaaatacttgctgaaacatccaaagaatagcacgtgtaacaatctaaaatgacccattaaagcatcacaaaatacatcccgagacatccccaaaaatagcacgtgcaacattctgaaatgatatagtgaaacatcagctacaattaaacatcgcgaaatacctcctacaacatccaaagaacaccctgtgcaacattcaataatgacatagtgaaacatcctaaaatacttattgtaacattttaaatccattgcaacaaaaaaaaacttctaaaagcaaatcatcaaaatatagtcatgtgagatctaaaaatgtttgtgcggtgcagttgaatggtaccattgcaattgtgaatgatgactccgaccctaggtctttcgagtaggacgggcagtagggagatatcgatgactattcatcactatcttccttagatgatgaaggcccaacttcattttataccgaggaagagttgcagaatcttaagaggacgaaagatgtcttggttgaaattcctattttaggtgattgcttacaatggatttagccatttctgtccttttaaattgcagtgaaaacaaagaacaaggaatcgaatatgcttgaaccattcatatcttcaacagataaatcaagtccatcaaaaccactctaaaatggattcctccaaaccattcattactatggagtttactaatagtaccaattttctaaatacaaacttgttatgttcatcataaaccacaatggtcatgaaattaataaacaaataatcctaacacatgaaattttctaagtgaacaatggaaattatttcttaaaagacacaaaataaatggggctagctgaactgccacggcaacgagctgggcgtggcagttttcagctgccatgtcacggagcctgacgtggcaataggtgctacgtcgaagccggcttgaccttgtcaatgccaatgattgccacggggcaccgttgcccatgccaagaccggtggtgtggcaaggtagtttggccacaccggttacaaatggcatggcaaaaaggttcatttttgaaaataagttcctgggaggccgttaaggttcatttatgttatgttgaaataagtgaaaattatttattaaaatggtctaaaataaaaagattccaccacatgccacctaccacatttttcgtgggatatactagcatccgacgccatttaattaatctaagcatcatgctcacattaataaataatgatactaattaccccgggactccaaccctttagatagactagttagaactagtgcaacatattaaaataattagaccgaagccgtggcatagatcagctagtccaatcaagtgaagcacaaactattcctataacacataactaataaagtagtatatgaactataaacactaataagtgcaaaagataattcctttatgaaactcatagtcttacaaagagagtaaagtactaagaacatacccgaatctccaagaagactatggaaccgaagactattctaagcttatctccactactaaagagaaaacaagtatatgaataagaaaactgctctctaagtgtgtattttgagagtgaaggagtgatttctatttataggctgcttatgacgattgttaagtcggtaatcaagtgcaaccgcctttgagaagaaatcatgagttgccacgtggaggatggagatgagaggtggcgatggtgttggttcgagtgacccatgcatgggccccatctctctctaccacctttctccaaggattgacatgtgggcctctaaggaggtgcacggtggtttggcctcactttaagtcggtttgagctgacttatggggcatcaatccatgtgctcacacatgattcaccggagatgtgtttctttgtatgccggtttatttctccttcactttattgtacaattactgcatccgtagtaattctccgagacaagtgaaactacattatttacaactaatattcatgtaagaaatattagttctccttttattatttgaggaaattgatggttgaaatcggtacttaataaccgtcaatgtaaactattattaacagtaatagtaaaagattacaccatactagacttattttttagccacacgtagcatggtacgtactagattcgttttaaaataaagctatttttaagtatagtactttgtcgtaaaaaagaagaaattttctagcccagtctctcatctaaaccaatgataacattttctatttgatttcttcattcactctcttttcttaatcattcaatcacaatcttactctaaccattaagacctatatttctaatagttatgtttatattaaaatacctatattttagaatattttagaacaaaggtagtagtgagagggattgttgcagcacgcatggaattatttttttctcatcccgacatggctgcgttgcctctcgtttggatggatccgctagggaaagtgtgaccggcgtgtgtggtgcatcccacgatgatggagctagccatgccagttgcttccctaccttgtcaccgtcagaaaaggtgtgtggttcgagctatacgactaattaactgaagtactgtaacaattataggttaccctggtgatcactcgatcagatctactagatcacaccacacgtccgcacccggtcgattctttaactgtgtagaggtctccgacatgtcggtgggaacaactgaccacatcgatcgatccccggccagtcggtcagagatcagtttcagcatcttatcatggtgtgtaatcagtgttatggaaacggaatacggatgtcggatgaagaagatactgacaaacgattaatagaaatacggatgattaatcaaaatttgacgaaaattcaatgtttgtgaatatgtaaatattgttatgcatattatagactcatatattgggaattcactacatataatacgctagaattaattaggaaaaggtgaaaacgatgagagctactatatatatagatatagaaatctgactagtattagtattagtgcattggaaaaatattctataaagattacgaagagaaatttccgctccctgtcgtccacgcgggcgcagggagcgaaccctagtcccaaccgacaccatcctcccttnctctcccctgcctcactgccgctagaaaccgcgcggccgctaggatggcagcgatagggctgaaaccccagcggtggcccattcttcggcgtgaggagacggcacgcgcggcggatccaccgccgcgggatgtagcccccttccccttgccccgcggatggatctggtgcttctaccgccagatctgaccggagtgcactagcgacnacgtggacgattgcggagggacgacgactggaggcgctagcaatgggaggccgcgaggttattggcnttctgtggccggtaggaggcacaggagatgacgggaggagcgggtgacgactccagctgcccaacgggaggcgccgacgacaacagtggtcggctgatgggaggcgtgggcaacagcagcggttcaccggagggaggtgcgactggtgccggcggacgatggcgcgacacaacgaggagcggctgaaggcggtggtggagctcctggtatcagcgcatgcgagcggcagtggtggttgcactctcggtagttgttgggggtggttgcggtcggtgaagcgatggccgatgtaggtcgcaccgggggctatgaggccaacccggcaacgggctaaccgctggtgcgcagcggtggagaggttgccgtgatgggaggacggaggcgacggtgatgcgactaggcagctggttgtgaacacgagcagcctggtcgaggcggcgacaacggtagcgccatgaggggtatgttgaagcctgcaacgagcttcctttccaatcgtttgtccttttgcagcgctggcttgccaccgtaagatggccacgctggacgggctagtgcagggcagaggggatccttctctctcaccattttctatctccaacccaacaacacggatggagttgaagcgcgatgggtgttgagattcttcttagatggctggccaacggcgaggtgtcggcgcagtggctgtgcatcgaaggtggattagcgggtggttttgctgaagctgacatgcactctttggcgcgggagagtataacaatgggtgaaggcctagccttcgggccggcaatggcgatgactgtgggcgcgttttccccttggggtgttgtcgtgttttctgtcctctcccatgggttcttcaggtgaaaactgttaacggtcgttatcgatcagtttcgaccatcaatattaccaaaacaggagagaactagtgatgcttgcaatgcataaatatgttagaataataatattccactagtacaggtctactgaccttttgcaaagaatgatcataaagtggaggagaatcgacatcaacaccaacgataaatcaatcagacgatgtcgaggatcagacttatgtatgaatgggccaagaacacagaattgacacgatgaattgggccaaaattcacaagtctgcggagtggagcaatagaggaggccaccagccgaaattgggctggattgggccagccccgggttcggctgaacctggtggtttggccgaaccaatcctggcgccgttggatccaggttttggcgtggacgtccaggattgcatcccaatgacggttggagggtacttcggacaattccccttccacaaccgccatacctacctctatataaggagctcactctcttcacttcaacacacacctcaagcaagagctctctcattcctcttaagtttagtttagtagtatctagctggtggaatagaattagaataggaatcaggagtccggaagtcttcgaaagagttcaggtatggctctagtagctttcctttcctcttttgtaagctttgtacttttattagaatactcttctaaatacatttctggtattgaaatactttccgagtatatgagtaccaactttacattatgttcttgttatactgaatatacggctagtttatctgggagatgctttggtgcgggtataatgtttctttatgcaattactctttgtcatgacgatggtattagagtagtatctagtagtttaggcgtggtgtctagattacgggatatcattatttggggttatatattgcggatgagaggtgggccgctgatggtgacagcttagtacgggtattcctccgcgcctatatataatcctaagttaatttcctaggggggtattcctctgtatttagccccggttggatggccatgacgggctgtcgtaaggaactcggcagtcaggggtggcttctcgaagtaccaggagagcatcggatatagggtattagctagtatatcaattaactagaatgtatgtatactatgtatattagaagtataggaattgattctctttctcttttctttccacctagcttagattatttattataaggatgagtagaaatgcttgtgtgccactctacccttggattatcttaacccctgcttagaatatgattatcacatgtaatatataaattattagttgagttctctctacatgatcttcccatgggataaaataaatatgatacccttggaatactctcgggtgaaatgctacaatggtatatccgtgcgcttgcggatgaactctgtaaccataatataccagaagtatttctgcgccattgctgggaattatatttctagtaatgtcgttaagaaataccaacaaaaaccacgtcctggatctctaggacaggcggtgacgaagctattggcatcgtttcctccttggaggcgtcgtttagaagacttatttcttaggggtattgtgtgcttgtcctgtatttagcagtaagatcagacatagacgagtggtgtggatgcatattttcttttttcttactatagtcttccaagattatagacttgtgttttattcctactttattaatataaatgtcgcactatcttgtatgggttgttttaaaaaaatatatatggattatcttctgttcttctatttgagtggattgtctatacatttgtcaacaaattttcttctaaaattttgtcagatgtaaatatagtataacaatactataattacattctaactaacttacatgtaataactacagtgtaactgatattataactttcgcgtaattttgaaatcgttagatttgctttaagattggtgcaagctgagaagatatataaaagtcgcaacgcacacaagtgaggggatttggtctcgtgacctccgcttcatgaaaatagcaatgttatcgtaagatttttgaaagttgcatacaaattatactgtgttatatgcaagttacaatgtacgtaattacactaccattacactatatttacatttgtaaaaaaaattggagaatttgttgataaatgtatagcaaaactgctatttgagatatacatgaaacatcaaaatgaattttgagatcaagaaaatatggtagattggatttgaaagaggattagatggaaagaactaaccctaacaggttgcagcgacatcagaggaatttagaagggtaatcaacaacgtactggtacagctagcctttatactagaggacaacaaatatgctgggatagtcgttgtgggttggttcggccttttgatcaggccgattagacggaagcggccggggagattatcggaggtgacgggaattttacgttctggaatgattaacgaaggacgccgttttgcaaaaacgtgaccggcttatcaccatcaacgtttcaatggctgtatcaagcgttttccacaacactgtatgtaatcagtgggagtacgttttagacgtgctggtgctaccgaaattgcgactgctaccatcccggctgtacgtctttgatagtcatctttaattcaatttatagcccgtatgtctacgtcgtaattaattcatgaaaatcgatcggtttttttgaaccatgagctttcgatccaggcacatggaaatataaaaggaaaggatccggtcgatcgaagttttcgatataacttcatgtcgttcatgtgaatatataatcataaatcacgtacagcaaagtcctttcataaatttatgtcatgataactgcacataaggtgtagtttagacatgcaaaactttagtatacaaatagattgccatttttgtttgctttattattttaacaccctgattttatctaaatgtatttatagttacatggatcatatttttgtgtgctcagtgttttttttattactttagtgtaattgattgagttcaataaaagctttctaggtttctgaactgttacaatatatttttctggtctctgaacttatcatgagtgttatataggaccaaacgggctccaagccattctatacgctaacgcacacagacagtaatatctatcaaatgtgaacttctatttttttcccattagagggatgccgtcatatatatttttagctctaaaatacaatacaaatagtattgaaaatctgtaaaaatttatagatagtattaacatctaccactcgaaaaaaataaagtctaagaagggccaatctacaacatcagaacctaaaagataagcgaacttttaccattcttgagaaggtaccaccactccacccggtgctagataccaagaagtaccttttagggcattggcaccgaatgcggtgatgagctggcataaggccagatttgaggcgtctcaattcattcttgatttgcagccgcagcgaggtacacttgaggctgtggtggataaaccgatagaagcaagggtatatgcgaaagttcaattttaccctctcacccacaacacctcctctctcgggagagcagtaccacccggtacaaagcaattctagctcttagattgtacgagatggatggtctagattagtaccatctccactcaaggatgataaaaactctcaaaagataaatacattacatgtacttggtcgtatcattttcatttctcaatgtgcgcattgatttaatttaggcttccatttttagatagtagatacgtactccctccgttttttaatagatgacgccgttgacttttgaacatatatttgaccattcgttttattaaaaaattatatacaaatgtataagatataaattatgcttaaagtactttgagtgataaaacaactcacaacaaaataaattataattatggttttttttaataaaacgaatggtcaaacgtgtgaaaaaaaagtatattgtatcgatgatcaattttgaaaaaaagaagattgtaactatatatttagatctacttttagaaaatgaaagaacgaattaaccacgtagtgtggtccattaatctgcaccatctaggcatctattggtcctctccagtctccaggactcagctaggaaggaaagaacagagccagatacccagcaaacaggaggcaacaaaacaatttgctggagtacgagtcattcggccacaagcccacaacatgacgctagggccactaattcaccccgtgaccgtcctagagcaatgccatgtctcgccatctccggcgccggcggccggccagccacggtcgctgccgctcacgttcttcgacctcgtcttcttggacttcccgcccgtgcagcgcctcttcttctacgacaacgccgacctccgcgacgcccatgacttcctcctccgcgagcttcccctcttcagggagtccctggccgctgccctgcaccatttctaccccttggtcgggaagctgccgtgcgggatacgggagcgcatgtcgccgccggaggtcgcgtactcggatggctactccgtctgcctgaccgtcgccgtcagcagcgacgacttccaggacctcgccggcgaccacccgcgcgacaccgcgaggctacgcccgctgctgcctccgctgcccaagcatggtagctcgcaggacgtgctcgccgtccaggtcaccgtgttccctcgcgccggcatctgcgtcggcacgacgctgcaccacgccgtggccgacggttccagctacgtgcacttcctcaagacgtgggccgccattcaccgcctcggcgacgagcgcaggaaagcggtggtggtggaccacacgccgccgctgttcgaccgtggcgtcgtgcaggacggcgacggactccgggaggcgtttatccgcgaccaccgggatctcgtggagtccggtgacaagcggctcgacgactgggacctcagccggaggccggacaccgtgctcgcgacgttcaggttcacggacgagctgctccgcaagctggggaggcatgtcgaggcggagacctcggcgcggtgctcgccctacgcgctggcgtgcggcgccgcgtgggccggcatcgtgcgcgcgcaaggcgtgggcggcggcgacgtcgcgcggttcgggttcgtgaccgggtgcaagccccgcgtgagcccgccgataccgtcgagctacttcggcaactgcctggggctgtgcttcgtggaggccaagcggagacacctcaccgcggccagcgcatcggcggccatctggcgcgtgatcgcggggctcgccgagcaggggcgggcgctccgtgacgcccacggctgggtgcgcggcgcgcgggagtacgcggcggcgcgcgcggtgacggtggcgggttcaccgaagctgggcgtgtacgcggcggcggatctcggcgcgacgtgggggggtcggccccggaaggtggagatagcgtcggtggagcggacgggcgcgctggcgctggcggagagcggccgccgtggcgaccgggacggcggcggcatcgaggtcggggtggcgctgccgcgcgcggagatggaggcgttccgcgcgttccacgtcgagctggtccggctgctagacgccactacccactagtgctgagtggtgacgcggcctcccccttgccgccagtgtaaaaaaatcgtgccattattccctctgcttcggtgtttctggaactgggaccagtcctttgccttctgctgtttctgtttgccagttgccatgtgtccgtagtagactagtagtacggttcgtctactccctccgttattaaaaaaacaaatcatgagttttcgtatccaacgtttgactgtttatcttatataaatttttttataattagtattttcattattgttagatgataaaacatgattaatactttatacgtgactgtctttttaatttttttcttaattttttacaaataagacggacgatcaaacactggacacggaaacctagggtttgtctttttttttggacggaaggagtattactctactactccattagtcccataatataatgtaggaacttaataccggatgtgatatttcatagtataatgaatctagacaccctcctgtccagatttgttgtactataaaatatcccatccggtattagattgctatattatgagacggaaggagtactagttactcccgttctagaatatattttaaagacctgcttgggagcaatcaaaaaaatattgacttgtaattttatttcgcccgtaattgtcgggcaccaaaaataaagtgaaattaaaacccgtgcattcatggtgtttgggaaggaacatcaagaagttcgaattctgatttgacgaaatagggtatcttacgaattcaatcaatggatcaaatcagcatgaccaatcgaggaatcaaatctgaacaaacaatttagaccaaaacatcaaacagaaatcgattggaaaaaaacaacaaaattgatccgatcctgaataaaaatgagctgttcgtgcattattcatcaaacagttccgagcacaacatgaaagagaaaaacaacagagagattgatgagaaatattgggcaaaattatcaaaacgatatacactgatctcttctcactacccccaacgagaaatttagaagaagcagaagctgtactcagattgaaagctgtacttaacgagaaatcaaatcaagggcctctttgaagagtttctgtcagctgtagctttttccgaaatcagaagctcatcaaaacagtttagcttttcgtttagattctaagaaactgtggttgttgaatccagaaaataaactagagttaggaaactcagttttttcatattctcaaaatctggctatgaacggaggtatttttataagacccaagactacatctagaagtaggtcgtttcaatttggagagagctgatgccaacagcatgcactgaggttgcgatgacgccagaaactgtgaagatgtcggtcgcatgtgagggtgagacggtgccggaaatgcagatcgacagtaggggctgatctacagtagaatggtcggtgtcaggcgacactgacgactttcggcaaaatctatagcaaaactgtttatctatatgttataacaccatgatctaaatataattagcatactgtgacaccgatagatatgttatgataccaattctctgatccgccactgatcggcagtcgagaagatgttgtagatgcagatcgagactgacaccatgacgagaagaggaggccaacgacctggacggattccggccgacccacagggcaaggtcgtagcggcggtgcatggagacggagctaagttcacggtggcggcgcgtggagccggagttgagttcacggggacaacatgtggagctaggtggagcggactgcggagtacggctgaagctgagaacaagcccgactttcgtcgttttctagtgtgattgataggagataatctatttcccggtgtaatgggcctctacgaacgaatttcaatctgacatccggcccatccaagcgcgcaatttcagtccggctcaacaaattttatgggcctgtgaattacacctgttttggaccaaatacaagccttccaaggaggttctaacttcaaccttcaaaatatatttttttctcaatcgatcacaatatttttatcattcaaattccacatttagatttttcttctcaactaatcataacattcttctatttaattccttcaactttcttgatactcatatggaacctaaaactcgtatatgttttggaaggtatttgaaggcggaggaaggtgacgaggagcggatgctacgaggtaggtttgggagaaatcgaaacgcaagtggagattggatagatacttgagctagagagatcagcaaaatggtcgggaagaagaatacagactctagagtaagagcggggatggccatccaaactactcccctccgtttcacaatgtaagtcattctagcatttttcacattcatattaatgttaatgaatctagacatatatatctatctagaatcattaatatcaatacgaatgtgggaaatactagaatgacttacattatgaaatggaggaaggagttgggtttgctcaggtgcacaactaacagcattatcaatatttcgttcaaccaaatatgtttcttaggccttttttagaacgcaagaatttcatagacattttatagtatttttcacgagaacaattcagttccccggaattcacaaacaaaaggctcaccttcggaaggtggccttgaccattaaaaattttaacgttcaaaacagtaagtttacctgcagcaagctttgtagttacagtgtctcaatttcaataagtttaccaggccacgatttctcctctcagggcccacaggaaacaaacggcaagatctaaaaccctacaatctaagttgccttagcattactacatgtactggcggtagttatcatatcaacttaacaactttagggtttttgaaatttgccatgcacccaaacccgttgcatcttcttccccttttttctattcactgatatgacacaacaataccccagttccaactgcacaatgataggcaaatgcaagtcaatggtttcataagttacagacatacaaggaaactggaccaaagcaccaatgacacaaactgaaatttttacatttttggtccttttttaaaacttattttacaaatggccccttgaaaaacttattacaggaatgatcctttctggtgcaccagagtggctggcgccgtactccaacatggcggcgccagccaccctggcgccgtgaccgtgccaccgtggcacaagggcgagcgtggagagggtgacgtggcaaaggggggcgccaaccacactggcgccgaccctcataccacggcgccagcgtgcctggcgcactcctcctaggtaggggccaagccctaaccttctgcctcgggcgggaagctggcaccccaaccac

SEQ ID NO: 12586 - DNA, 2763 bp, Oryza sativa
gcccctccccccttcccaccctcgaggccttctgcctcggcggaattgctggcgcagccccccgaagcacggcgcaagcgtgcttggcgccgtcccccccaacccgtagaccttctgcctcgagcgggtggctggtgccgccccccatagcacggtgccagcaaccctcccacccctgaggctttctgcctcggccgatttgctggtgttgcccccccagcacgacgtcagggtagctggcgccgacctctacctccctgccaacaacaaatttcattggacagtctgcaaaaaatgcaaatatcgacaaaacaggttccacagcaaatattgacaccaaatcacatatcgcatagtccacaagctaactagattgacgaaaaaagtccacaactccatcacacattccacacatcaaacaatactacaagtccatcacatacttcatacaaccaacaaatccaaaagtctgtgaaacaagttaacacatgatacaaagatcaacttcgtagaaatcactttttccgttggcgccgaatagcttgcaagccctgagtatatctacatttgaaaaaccaaagtttagaacatttaaaaaacaaagtgagggaaatcaagtaacacttgagaatggtaagctcattttacctctttttcgctggccgagtggatcgtaagttgtattgggtaggctgtgacgcatgaggcgcatcgggaagttgcgacatgcctatctcctcgacgtctggtgtgatgtagccctcatcctcctcctcatcgtcgccgctaggtggagcctgtgccttcccctttccccttccctgtggaatgcgtgacgatgacaaaccaccaacttgttcacgctcttctatcctgatggagtgtcgagcggtacttggacgcacggattaaggtagtggtagtgatactctccgcagttggtacacgtcgtccaatccaacggacctgcaacctaatcttgcagcaagtttgcggcacctttggctaactttttgaattaaaaaaaaaagaagtttgttatgtataagtcaagtaatgcatagagttaaatcatttttacctctaagacattgcgaagtttgttctccgtatccttaccaccccttggagatcggagggcatgccccatttcattcacactcctaagaagctctctggactaacagcgtgagaagatgtatgttagggtttagggtgcaaataaaaatcactgtgacaaatgcaagaaaacttacgactctgtctctaagtggggcgtgctccatttgatatccaaccctagtccgaacgtcgtagggatgccgcccctcatcagagtcgtggtcttcctctatgtcggcttccgtccaagtagggcgtaggaacagtctatatgtcctatgcagccaacgaaggtactcagtaaaaagatgattttggtgtattgcctcgatgtacctatcattctcccgctgtcctccattcatcaatggatctattatgctctagcacccagtccttcaccttctttgttctcaccctgtcgtaccttcacaagtggaaggtgatgatatgtaaaatagggtcaaatggtgcaaaattgaacattgacaatgaaagcaagcaaagataaaaaatattacttgtgtagatcaactccagttgagatgtcctcaacaagacattcttgtctcttcccgaactatcgcatgacacggtgcggaaggtggtattcaactgccaaaaacaaatcaattggcactagtacatgaagtaatcggagtctcgattgcataacgagttcagtgtaagacttgtagcctcagtggtgtggtatggtaaccactcaatctataaatgttgaatagttgtcgtaggttagtatctcaatcatagaagtaaatgacgaattagaagtgatagtaaagtacttatatgtgcaggcagtccatctcgttgatgtactgcttgtatgcgatatcccggtgagcatgtgcagtggctatactctcaaacaggtaggccactgtcttctctatatatggctcattgtagggccaaggggtaaagatttgcctccacttaggcctgccaaccggtagtcttagccacatccacatctgaatcaccagcacacaaccactaatgttggatgatggtgcctggcaacaacaggcctcgaagagctgtctataagtccatgccaacaccgttggagccccaactaaaacggcccagatcatcaaggttagtgaccaaagaaatccaaattgccgaagcaatgtcacccccagcatctagaaaaagaacccctcccaataagtgcaagatgtatacacgggcatagcactcaacacgccatggctcaacgtcgtcgtccaggtctgaaaagttctggctaagccaagagacgggtattccgttatgcttcttcttgctcccttatccctgctcaatgttgagtgcaatgccaaacaactgctccacttgtgcacgccatccaggattctctgtcttgcccgtcaccccatgtccctgtattgggagggccaagatcatagccacatcttgaagagtgatggtcatctcaccactcaccactggagaggtggaagctaaggtcacgagtgaaagaagttcttcacctaaacaagtctcctcattacattaagaataattttgtgacatattcttctcgtcgttaagggggtgcaagtaagactgagttggtacgagaagacttggatgggcaaggatagaaga

SEQ ID NO: 12587 - DNA, 890 bp, Oryza sativa
atatcaaatggagcacgccccacttagagacagagtcgtaagtttcttgcatttgtcaaaatgatttccatttgcaccctaaaccctaatatacatcttctcatgcttttagtccagagagctccttaggagtatgaattaaatgggacatgccctctgatctccaaggggtggtgaagatacgaagaacacacttcgcaatgtcttagaggtaaaaatgatttaacactttgcattacttgacttatgcctaccaaacttctatttttttaattcaaaaagttcgccaaaggtgccgcaaacttgctgcaagattaggttacaggtcggttggattggacgacgtgtaccaaccgcggagagtaccaccaccactacctcaatccgtgtgtccaagtactgctcgacactccatcaggatagaagagcgtgaacaagttggtggttcgtcgtcgtcacgcattccacagggaaggggaaaggggaaggcacaggctccacctagcggcgacgacgaggaggaggaggaggaggaggatgagggctacatcgcaccagacgccgaggagataggcatgtcgcagtctccgatgcacctcatgcatcacagcccacccaatacaacttgtgatccactcggccagcgaaaaagaggtaaaatgagcttaccattctcaagtgttatttgatttccctcactttgttttttaaatgttttaaacattggtttttcaaatgtagatacactccgggctcacaagctattcggcgccaacggaaaaagtgatttctatgaagttgatctatgtgtcatatgttaacttgtttcacggacttttggacttgttggttgtatgaagtacgtgatggatttgtagtattgtttgatg

SEQ ID NO: 12588 - DNA, 13756 bp, Oryza sativa
  unsure (1)..(13756): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttttttcattaatgaagagccgattagcttcgattgttgcttccagtttagctctctcgcgcatgtctgctattctttgttgtgccctttccagcttgaaacgatgttgctctagatatacagccagggaaatgatgtcggcttcatcttctgggatctggtggtggatctcttcaaacctggccctgattgacccgcagccagtaaccaaggaatccaaggaactccctagccgttgagcaatatccatgagtttggtcttgagatcatcatcaagagggaccaaggctccactggtggtttcctcttcttcttcatctaggaactgtttaacgtcaaaggaaaacatattggccaagacctggagaaaagataaatcgggattattggcaaagaaaatatcgcagccgatatgagaagatttaatagtactaacaggcacaacaagaggtggatgttctggtgttcccaagtgatgactgtccacagccgacggggtgtgctcactagatgctagccgacgaggagatggagatcgaggaggctgaggcaaaaaggggaggagattaagtttttgtggcaactaataggagtaagaacacaagtttaaggttaccaatggaggcggagtggatttcttcttcttagcagcccttggcttcttcgtctgctggaaaaatggcaataaattcatatgatgcacacttaatcggatgataatgtgaagaaagatgcataccaccacttttaggggccggtgttggagcatctggcgtcttgttgggacttggtgtaccagctggaggtgtcccagctcgacccgtagggcttgcggataaggccctggtgtcactcatgccagcagcagcattatcaatggcctcctctatttcttcattctccaggacctcctctacatcacgatccaaaggaggtagatcatcggcagcaaacttttgcttctttgctacctttttcgaggcggcaggaggtttagcagccgatggcttgacatccgattgcttagtgcttttccttttacaagtttcaactggaatcggttcatgagtttgcccatatagtaaattagttgtcttgggggccatatagccgatcactgaaggagctagtccaccaccatttgggataatccctgcagcatagttaatcggcttcccactttggctagtgtaaggcagtgaggaatctgtggtctgcgaacaaggaaaagagatcaagtatcgattaaacatttgctcaaggttagaatttttcaaaaagaaaagtgtacctgaggcatcgagtccgagaagattatcgtgaagaacattgaggctgatagatggaataaatgcttcttccactcagcccaccatcgatcgaagagtgtgctcctgtcacgcccgaaaattcactagtaatttctaaacttatttgtgcataaaatcctcgtataggaatcagctgacgtgcacaaactgataatttaatatacaaatccatcgtaataataacattacatacttacaaaagaaaagaaaacagcagcggattaacggtctagcgatggctttagctccactcccacaggcagctcaactggggtataagccaaacgtcttctccttcgcaacttcctcaattgaggtttgattgattattgcaaggtgagtacatggaatactccgcatgccacacagcaaatatgcaagtgcacaaggataccaaaggatggcataatatagggcttatttgcaaaagcagcatttagcaaatatttgagaatagtaaaacagtagagtaattaatcatcaatattaatcaacactgtacagcacacccatgctgcacaggcccaaccatccttaacaaccatacccggctgtacagatctaactccaaaccaggaatgtaccattccaaaccaggatctaagcaaattattaccagttatagcatcagtgtgagactaatcacgaaaacattgttagacccgcccataactacgggcaaggctattcgaatagttttactctggccagagatgtatcaatgtatcactgtacccacaagacagccccacaacacgttgccaatgtatcactgtacccacaagacagccccacaacacgttgccatgcgcctcaataccaccacgatacctcggaaaggagctgtgacagtacccctcgcataacacaatccaccacaacgcaccgttcctggatcataatcaccccctcaattaccagaggcatggactccccagcgacccccacggacttctcgccacttcacagtctggcgccccataatgaattatactatacaaaaggaaatgccgttacccatgctagcttgtggttggcatggttaatgtttcacaacagtagctcgcgaaccgatccttaattgtcatgagcacgaccatcaaaactatacgctcacaacccaccattatcaagttttaattatcaattgattatcataacacgatttatcatcgtgagctacctttaaatatccagctttaggtaatagtgaagctttaggctgtgttcgcatgttcagcttgggaacatagtgcctccgcacggaaaatggagcgatccattagcgtatgattaattaagtattagctattttttttcaaaaatggattaatttgatttttttaagcaactttcgtatagaaactttttgcaaaaaacacattgtttagtagtttgaaaaacgtgcgctcggaaaacggaaaacgatggagaggggctgggaacatggggttgcaaacacagccacactaatgtttctaagcatatctaagtaactatactaatatatctaattgaaccattatatgaggccaactagtcaaattgtatcccaaggtatcaaggaataaggtaatcaatgcaaattggccgtagcaaaggtataagttcacaccaccggtgacattcgaaaataaatacacagttgaaataaatagagaatttaaatataggatcaacatgctcaaaggagttgtgtttgggatctatgtgacttgccttgcaataatcggtcttcaattaatcttcttgaacacttccgacgcactcacgaatcttcgcaacaacggaaacgatgagctaatacacaaaacgaggaaaaagactaagaaactccaaataaacagtacatataaactaaataaacatgtagatcatgattttagatgaatttagagacttaaacagccttattctgacttcatatgatttagttatgaattttacaagattaatctgattttagccttatatacagaaaaggatttacgatttatcttagaaaaggaaaacgggcgctgacgtcagcgatgatgtcatcacggacaggggcttccaacgatcgccggcgatctagggctcggcggcgcaaatcgaggataccggaagaaagagcacgacgacgggagctcaccgaggggcggcacgacgacgaacgacaacggaagacggccggcggcgaggtagaggcggcgatgagatcgggacggcggcgacggcggctttccgacaacgagcggcggcaacggaggggtggccggggtgcagctcctcctttcgaacccaacggaggtggcgacgaagctgggcgacgacgggaggagcagcggggcttcgccgaagatcaaaacgcgacggcgaactcggccttaacggcgacgaagggcttcccggggtcttcggcttcgggcagatggtggccggtcttccactcttcgctttggtcccattggaggcgacggcgctgaccggagatgtcggagtcgacggctacgaccgactggagcggcggccggcggcggagcgaggagacgagcgcgggcaggcggctaaggttagggaaaagctctggaaaaagatagaaacggaagaggaggtattgatactgctatttataggcaaaggtggaggaaataggctcggacccgtgaggatttggcggcggattggttaaggttcgccgggaaaataggagatgaactccgcttcgaatccaagcgatatacgatgggatttgctccgattcttgaggggaaagaaagaggaggataagggaagaaatcccttcaaccaatttgggaaacgagtcacgggatgcaacggattctacagaggaagcgggggcgtcgagttgcatgggcagtgggcacaggagctcgggttctgtccagagatagaaggagtactgtagcgataggaaggtgaaacagacttttgtctgggctaaaagaaaagaggcgagggacaagaaatagacttcttcgggaaagaaggagacagtaagcaggcaaagaggaagaatgggctgaagactggcccgaaaaggaaaagggaattttatttacttttccatttaaattaatcatggaaatgatctttgaattgttaaaaataattacaatgctcaaataatttcaagaaaaatcctgaaaataatttgtcgtgacacaaggtcacggacaagattggggatagacaggaaaacacccttttcctgcctatcctgagaaatgagcccgaataccaaatgatcacaccctgagtgacaagatttttagtattccaagatgtcctgtctgctacaggctttttgtctgctctatatagtacacagctttacatgtgagattacaattgtgctctttgttgggcccacatgaaattacaatcgtgcccctgcatatcaacagaccctaagggcattttggtacattatgggggtcattatagtcttttggtgccagctagatggagtggttgagtggtccctgggaatattctcttggcatctttattgtccaagtcgccttcttcatggccaagagtcttttccaccaacatggatcttctcctcgactaagggtcttttccaccactacgggtcttttccatggcaaatagtcttttccatctcgaccaccatttccgacttatccggtagctgatgtcacagcctgatttccgtttcaggatttataaattatttaataaattattattagaatttatattaaatgttcattaatttacaagtgaagttaaatgtgggaaataaaatttcctaaatataaagcatggctggatttaatttttattaaattctccatgattaattataccctctgaaattttctcggatttttcagagctcaattcctaaatgatacaaagaacagttcagtaattagttaatcaattaatgatctaattataattatgttaagtgcttttcttgtttaaaaatccttaaattataaattgttgtttaaaaggaattattagaaatgatcttaaaagcctaaaagagaagatctaattttaatttgttaaatctcaatataaaagtgggctagataaaattttgttaaatacttctcttgcttctatagttcctagatttttctggaatttatttgagccaaggaagtatttttaatcaatggaatatcatttcatgaataatttaaatagaaaaaggttttaaaatctcccttttggctttgggccgaaagtcggcccaagtctctctctcccttcccccggcctgcgcgtgctcggcccgttcggcccagtccgccgcgccctccctcctctctctcagccgctgacaggtgggacccacctgtcaggtcgtcttcctcctccagccaccaaccgccgactgtagccgcaagccgccgccgatctccttccaaatccggccgcctccttccttctccggccaaatcaattgaggggaaataatctcctcgatctcctcttccttttctctttaggaaaccgagctaattcgtttggaaatcgtcggattcaatgccgatttggttagcatctctttccaaaccctaaaaccttccatctcgctgccggtcgccgtgggcctccgtcgccgcctcctagcccctataaaaggatccctgagacctcctcaatccaccgtcaccttcgccttagcccgccaacgcttgtagcgccgcctccgcgttagctcgtgtgtcgccgtcgtcgccgtgagtccggccgtgccgcgccgctgctctagtcgccgccgtcactcgggaaggccgtcgccaggttcgcaaggtcgccgccgtccttgtcccgtcctccgtttccgccgcagatcatcggagcgccgccgactccgtcgccccgaagctctccaccgctgccgttggtccagccacgccgcgccgttggtccagccaccaccttcggtcgtcgtcgccaccgtcgggatcgcgaggaggagcagcacctcgtccacccctccgtttccgccgaagatcgctggaacaccaccgtcgtcgttgacccaatcatcgccgccgcttcgacctcgccgccgtcgtcatccgtcgtcgtttgccgtcatccaagagctcggtgagttcgccgcgtcgccctctacccgttggtgccctccgtttgcgtcgccgcgccatcgattgccggcgagcacgaggtgccgagccgccaccggcgatgacgtcatcgtcgacgtcagccgtagacccgtggtggattagatcgatcttggccgtccattttgtttagattagatctcggccgttggtttcgtagaccgcctctatgcacccggtctaccgtggaccatctttgatgacgcaataaatcccttttgcttttcaaaaataattcattattgcgtcataattcaattaaaatctatataaatgctttaatccggtttaatctttaaaaattcataactaattcattgtaactcagtttaatgtggttcaagttgcaaaagttgtataaaataaagatctacatattaaaattatccataaattgaattaaatttatttaatttttttaaatgggctttaattagattaaatcttgtaaaattcataattaattcatatgaagtcagagtgaggccgttcaagtctcctaattcatctaaaattattatctacatgtttgtttacttcttatgtattgtttatttggtttttattagtctttttcctcgttttgcgtgttagcttgtcgtttccgtcgtttcgaaggttctcgagtgcgccggaagtgttcaagaagactaattgaagacccgttattgcaaggcaagtcacacagatcccaaacacaattcctttgaccatgttgatcgtatatttaaattctttatttatttcaactgtgcatttattttcgaatgtcaccgggtggtgtgaacttattcctttgtatggccaatttgcattgattacactgttccttgatacattgggttattataatttgactagttgagctttatatattggttcagctagatgttagatataattgcttagccatgcttagaaacattagcacataattgggataactaatgtttcactattacttaatggtagagatttaatgatagctcacgatggttaatcgtgattggtgaattaattaatgtgccaactaaaacttgataatggtgggttgtgagcacatggttttgatggtagtgctcatgacaattaaggaccggttcacgagtttcggttgtgaaacattaaccgtgtcaaccacaagccagaatgggcaacggctggacactttgcatagcaaggctcatcgtggagtgccagactgagaagtggcagagataagcccacgggggtcgctggggagtccatgcctctggtttttgagggggtgactacgatctaggaacggtgcactgctttgagttgacatatgcgaggggtcttgtcacaactacacaaatggtgacatgtttagcatgggcacatgatgatatggtgacatattgtggagttgtgtcttgtgggtacagtggtacacctctggccagagtaaaactattcgaatagccgtgcccgcggttatgggcgggtcgaacaatgtctttcgtgattagtcctacactactcattaataataatgtggtaattgatggtaattaatttagctcctggtttggaatggtacattcctggtttggagatagatctgtgcagccgggtatggttgttcaggatggttgggcctgtgcagcatgggtgtgctgttcagtgttgattaatattgatgattaattactctactgttttacaattcttaaatattttctaaatgctgcttttgcaaatgaaccctatattatgccatcctttggtattcttgtgcacttgcatatttgctgtgtggcttgctgagtatgtcatatgctcaccttgcaataatcaatcaaacctcagttgaagacaagttgcgaaggagaagacgtttggcttatacctcagttgagctgcctgtgggagtggagccggagcttcgctagactgtaattccgctgctatttttcttttcttttgtaagtatttacgttattattatgatgaatctgtatattaattgtcagtttgtgtacctcggctgattcctggacgaggatttaatgcacaaataagttcggaaattgctagttaatttctgggcgtgacagctgacctgttattaactcaggaaatacgcaaaacggataatgagacttagtgacaaggactcactcgaacggtattttccgactcgaatagtgttttccaactcgaacaacattttaccatttccttgttcgaatgaccatttgccactcggatacttagaataaaaactcaatcttacccaatctcttcctctacagtgttttgggccgaatagagaggaacggtggtgacccctagctacaacaagccccctcacgggtaagggcgaagtgtgttttcggccgaaaccgtgttcgaatcaaaagctaggggagaaccgccgtcctcctattcagtcgaaaaacactaggatagaaaattttgaagttcgaaagcggttattcttgtcagtcattatgcatttatttgtttattatatatatatatatatatatatatatatatatatatatatatatatatatattgttatatgtatacatattctttatgtattgaatatgcacatttatgtcaaagtttgctcaacaccatgcggcagtttgatctgtagtcaaagcttttcaagtttggtactggaaaaagaaaggctatgaagatacccttgcttctctctaagcatcgttggcttcgagctcacacaccgcacaatcctcttcgagtcaaccagacaacggtggtgacgctcacaaatctgattcacaggtgtgaagttattttagggaaaactaacttggaaaactttttggatatggtcgaaaacgcttgttcttttgctccgtcgaacctattgtggttgggaacttaattatgtatattttctgtggttgggtaccatttgctattttctctgtatgcctgtgcttcatcatcatttcgtttttgtcggggaagcaggtttatttgaaccgaaaagttgtggttcgacgcaacaagtatcattcaactcgaaacatgaagctcgttgcatttcgaacacacgagaagttgctcttttctaaagcaactaaatgtgatgatgaagagaaggaaatacattacgatgacacttgtattttttctttaaaatttttccaatggcaaagagaacatcgagatggtagtttgcgtgacttcgttgtcgagtttagaaaacggcgttcgaataatgcttcgagcagcattaacttttggcaaacttttagaccatctgagcgtcaacttagaatatggaaaaggcgctactcaattgtcccttacacgggaatgccttctcctctcaatgtcatttttcctttttcttttccttttattccgcaaagactcgaatcagaaaagaattcgagcgtttagctttggtttttgaaaaccgccgtccccctttcctttcgaaggagtgacgaggtcaaaatcgcactttatcttgtcgcatggaatttccactttctgctcgaatcggttatgagtgtttgagtgtttcatcgtttttttggtttttggacgatggtaaaacttgttcgaaaaccgccgtcctccttacctttcgaaggagtgacgaggtcgaaatcgcactttacctcgtcgcatggaattttccactttccactcgaatcggatatgagtgttcgggcgctttatcattaggtttttggacgaaggtaaaacttgttcgaaaaccgccgtcctccttacctttcgaaggagcgacgaggtcgaaatcacgttttacctcgttgcgtggaattttccactttccgctcgaatcggatatgagtgtttaagcacttcatcgttaggtttttggacgatggtaaaacttgttcgaaaaccgccgtcctccttacctttcgaaggagtgacgaggtcgaaatcgcactttacctcgtcgcgtggaattttccactttccgctcgaatcggatatgagtgttcgagcgctttatcgttaggtttttggacgaaggtaaaacttgttcgaaaaccgccgtcctccttacctttcgaaggagcgacgaggtcgaaatcacgctttacctcatcgcgtggaattttccactttttgctcgaatcggataagggtgttcgagcgttttatcgttaggtttttgggcgaaggtaaaacttgtcgaactgcgtggagtgctttttaacctgttgtcaagttggcttttcttctccgaagcgtgcggaggattttctcgatttgttatcgtgttggattttcctctccgaagcgtgcggaggattttctcgatttgttatctagttggattttcctctccaaagcgtgcggaggattttctcgatttgttatcgagttggcttttcttctccgaagcgtgcggatgattttctcgatttgttatcaagttggattttcctctccgtagcgtgcggagtattttctcgatttgttatcgagttggcttttcttctccgaagcgtgcggaggattttcttgattcgcaaacacatatacaatccattattgataacaccctacgtcctgtttatatgtattaacaccgagaagaaaagagaatcttacaaggtggtcggtattgtacacttcgagcaacatgtttcccccttttttttttctcttttttttcttcttccttttcttttttttacacatagaacttcttcaaggaaacagcattccaagtatgctttaattcttctccatcgaggtgtgccagcttgtatgctcctgttttaactttctttttactatgaatggtccttccaacagccacttcatttagtgttttcttgagggccaaatcaccttcttctatttgcctgattttcacttttttgttgtaatagcttttggtttcttctgtgttttttgccattttgtctaatgcttccactcttatctcgtgcaacatttccaaggtgatttcccttccttcttcgtctttttgatcaaacacaattcgaggtgaattcgctcccacctcgcttggtgtcattgcctcatctccatatattagcctgaatggagtcatgccagttgatcgaacaactgttgttcttaaagcccaaaggattgacaacagatcttctggccattttcctttggcagaaccttccagccttttctttatggcttctactattttctcatttgctctttcaacggcaccatttgttcgaggatgacccacagaagcaaagttgatttgcaggttaagacatttacacatatctttgaactttcctgactcggatcgttttccattatccttgggtattccaaatcggcatatgatattcttccaaacgaatctttgtaccgaagcagatgtgattcgtgctactgcctctgcttcaatccaccttgtgaaatactcaattgccacaatgacaaaacgtaaatctccttttgctcttggtggaattggccaaactggtggaattggttgcaactctcttggtggtgcttttgacgttgcaccaaatttttggcatgccttacatgtcttaatgtacttctctatgtctttgatgatagtaggccaatatactcattgtcttatcaccttcgatgcaactgatcttggtgcttgatgggctccgcacagcccttcatgtatttctaccaccattttcattccttcttctcttgttacacattttagcaaaggggtagtgactccactcttgtacaactgcccttctatcactttgtattttcttgacattaactgtattcttcttgcttcttcttctttttctggaagttgttcactaaccaaatacttcagaattgactctctccaatctatctcgccatgtatgtttgccacttctcttttctcataacttggttgaattaacacatcgaagaatgaattctccaatggttggcctgtggcagctgcttttgcaagctcatcagcttccccattttcttctcttgttatagtttttactgttatcccaaggaagtgtttttcattcagccttgcttcttccaagtactttgccattgtctcttcttttgctttaaatgttttggaaaggtgacctgccaccagctttgaatcagttttgattatcaatcgacgagcccctagtgctcttgcctttctcatggctaataaaaccccttcatattctgccgtgttgtttgttgatgggaaaactagctttgcaaaatattttagtgtttgcttcatcggcgtttttacaaccactgctgcccctacgccagtggcattgcatgctccatcagagtatattatccatagtttttcatcttcttccttttcctccacctcattgggagtccattctgccaaaaaaatctgccagaacttgagactttatagctgttctcgaggtatacttcaaatcaaatggtagaagttccattgcccattttgtaatccttcttgctacctccttatttgtcaatacctctcctatcgggtatgctgacagtatcgttatgtcatctgatattaaataatgtctcaactttcttgaggccatcacaattgcataaatcaacatttccacttctgtgtaccttgtctttggcccttgtaaagcttctaatacgaagtaaactagcatttgcttgttttctttctcttgcactaatgctgcacttactgtccctggtgtcgctgctacatacgttagtaaaggttgacctttctgtggacttgctaaagttggcatattctgtaactacatcttcaaatcatcaaaagccttctggtactcggccgtccactcaaatgtgtttgctccctcttagggttttgaaaaatggcaaaccctgctcttcagatttagaaaggaatctgctcaaagaagccattcttcctgtcagcctttgcatttcccttgtgttttttggtggctccatttggtgaatcgctgcgatcttgtcaggatttgcttctatgcctctcttagatactaagaaaccaagcaactttcctgctcttaccccgaaaacacactttttcgggttaagcttgactgaatattttcttaaattctcaaatgtttcctgcaaatccttgccatgagtgaacggcctgtt

SEQ ID NO: 12589 - DNA, 1694 bp, Oryza sativa
  unsure (1)..(1694): unsure at all n locations
ttttcaccaagactggattagccaaccatccaggatgcatcacctctcttataacttttgctttgagcaacttctcgagctccacttttgctgcttgctgcctgtctgttgacattcttcttaacttttgcttttttggcttgtagccttgcttgattgccaagttatgttcgatcaggcttctatctacccccttccagttcttctggtgaccaagcaaagacatccatattgcttttcactactttcaagatttcctcctcaacatgcttttccagattctctcctagcaaaatgtattttctaggatcatcatcatctaactatactttcctagttttcccttcaggaactggttcctgcaacttagagtattctccatgtttttgatcaacggcatggactcctttgacatttggcgttccctgaagctcaaactttctcgccgccaactggccacctcggacagatatcactcctcgtggtccaggaagtttcatacatatataattgtgatgtattattgcctcgaagatattaattgctgatctccgagtattgcattatattgacacggggtacctaccacatcaaaccctattttctcttttcttgcattgtggcatattccaaaaaccacttgcaaaggtattttcccaattgcatgtacttgtgtccgcaaaaccttgtagaggcactcatgcatttgtcaatctgtcttcgggtatntgcatctttttgaaagcatcgtagaatagcacatccgntgagcttcntccatcaccnaagactctttgactttcgcattgtactatttccactgagatcaccaaagggtcctggtgggggaaaagtattccttccgcatcttcaggcccaaaggaaattactgtcttcgaatgaactggtggatttgactgatagcttgtccatacatgatttacttgtctcacatatgcttttctttgtctttttgactcaattcccaaagaagagcctcctgttatggcatttatcactctttttggagcttcttcaattgcttctattttcatgacttgtggtgcttctatggcatttttccctcgctgatctcaagccccctaatgcttgttctcatatcgaccgacatgcttttccactaagtaagccatgtgcttacattcttcagtggaatggcctcatagaccatggatttggcaaaacttgctatagcattcttccgtagaatgaccacctagaccatgtgcttgacaaaacttgctatgattaggctgatactcttttcctccgcttctatcattattcaaccatcatcctctacctctgccagaattccaccattgtcctcggcctcttccagattgcccccagttatttcttcctccacgagtgttttctcattgtcttttcccttttccttctccattatttgagccatctccaatgaagttcacttgttttttctgatcttacttataatcgaatttttccatggttttgcagtgttttctgctttttgttcttctcctaaagaaacttgcttgttcttcgtctgctactttcccaacaatgcagcttcttctgcttgcaccctcaactcatcttcttctcctcttacaaaactttcctattccttgcaggtccttcactgtctttggcctattccttgcaagatcgaaacagagagggcc

SEQ ID NO: 12590 - DNA, 619 bp, Oryza sativa
gttttggtttaacaaattgtttagtgtgccccaatatcaatacgatctaaaattacacaattatcgaacttcaatacaaagagaagtggcatacaattaacaaaacaatatgcagatttacactagcactaatacttttcacacgcaaaaccggttgaaggtgaagccacaatttttacctgaacttcacggaatcggcgacagcgcaataagacatcatcgaatcagggttcagcaacggcggggatgaccctggtgggggcaagatggggcaggcatgacgaggacaaacagcgcgggacactgtgccgacaaagcctccggatacgattttgctaaacgttagatggccataaggctcaaggctcggcacggccatctggcccgacccaaacatggcatggcatgactggtgacgggttcgtgccggcccagcccgacagttgagccatgcctgtgcagatgacttggcacggtggcgggccggcccagcatggcacacggtccaatgagtagcaagaaaaatagtagagggacccaaaataaacttagttgccatataaacttatcgcctaaagagaagagggatgcaaaataaacttataccaaccatataaga

SEQ ID NO: 12591 - DNA, 3519 bp, Oryza sativa
  unsure (1)..(3519): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaggtcacaatatatttatctcaaaatggacttggtttcaccaatatacgcctacaaatgtggaaatttttagcacgaacgataaacagcagtaatatttcctagttcttacaagcatggttgacttataaatagtactacagcatacttaaagtagacaaacagtgcataaaaaaaacatattgctcccttaaacaacattgtcatgttctggcctcctgatgatcccagcatgagtgagaagtgcccagaggattgttatcagctcgcctcccctggcaatggcctttgcatgtgcctttgtattgtcggaaggagcaacatatagcatcatctctgaccaaaactcagcaagcatattccaccccttgttttcattctgaattccatcaaccagctgcttgccgagttgtacacctttgcacaccacctcattgctctttgatttttcactcagtaattgcatcatgcggtcaaattcgaaacacctcatatcagtgctgcccaaaacagagtcggtgatcttcttggcagatttatacaattcttttgaccatggagtgtcatctggcagtagctctgggcacgatgctagcaaatatgcacagtactttgacaagtgaatggcagtgatcatatcatcattctcatcaggagagctatgacgttctgaaggatcatgcatgtgcctgatctcaaagatgcaagttgcaatgtgccaaacaagaataatgtcagatgtcccttcaccattgcaagcccaacgaatatcgtcacgcagatggcacttctgcaaagatgctatgccattgctcagctgcccattgctacctttaagtgagttgatgagagcagccttcaccggctttggtatcttggtaggcttcattgctttagacagcctgaataggtgcctaatatgacctttcctcttgcaaggatctaatagagaggtcatgcccattttgtcaccccagtaattcatgagcttgcatctgcaccacagaaaacaagcaatcaatcgtctcatgattcgagacttttgccatgatggctttgctgtgtaggcgcaaaccagggtaactttggtccagttagagcaaacgtaagatatgatctcccatacctcaccaagcaaaactaccagaagaagggagatcgttggcaccaacacgaacaagatgcttccaatatcatgaaatctatcattatcttgttcaccgcatgttaattcgcaggacattaccctgtagtccttatactctggaagaattttccaagccagtgtaatcacgatgaagatgcaaaatgccatggtaaagagtgaggtcatgatgctcataatgggcaaccacttacccaaatgggagatcgggtgggacgagtaatagaaatcccaagcaaatgatagctcatctgtgataaccctgaacacagcttcaggatctgcgtctgccccatccgtgagcaatataccacgaacaaagtgaaaggccttctcagaacctgcctcaaccagtgggtacctagcaaatcgccttcgcagaagcttaaacaatgagaatgacatgcagagatgtttcagtgctggccttggccccaaaagagcatcattcatttctgccaaatgccaaactttgtcaatggttaccaagttaccattgcttgtcatcgcacttgtcccgttctggctaaaagtgctacgtttgaagtgataaccatgaggtcctttctcaatctgttgtttgtcttctcccattaccacgagtgctaaaagcctttgtattgtcacctctgcaacttctgatacctgtagtctgtacaattcttccatatatccagcaataagactaggattttgtcccatagcgaaggagcgccgtgccctcccgtatgcaacaaattttagaataatcttgatgaaaccaaggcccagtaatgttgatatgatgatatctggcaattcttcggtttttttttgtgtagtagtacaacacaaggaagaaggtccaaatctgtcgagcaagcatcgctattgattcaaaattcccaccttcatttccattatgaacggcagtcaatattgaacttgtattcatcccaaccattggcagcagcgctgcccatagtagcagacagaatgcgcggttgtcaacgcattccaaaccgtgaaacaagttgtagtacttgtctctgccgacgtaggagacaacataggagaggattggtaggactagagtggatgctcccagaaaaagatagcggttcaaagcaatatgccggtaacgacggccataagagccagctcccacaaggatcaccaccaagaatgcattggcgacgaagagcgcattcgtcgtcagtacatctttgtttatgcgctctatcaagtcgtttgagcggaagccacatgtggtagacgacattatagcttttatagatcttgcaaccttgttgtgacaatctggtttacatatattgcacattcattagggttagactggaaaaagagttagcttataattaagaaattaaccacaaagttatattttttgtgtccctatttattctcacatgtttgaagctcttacctgacctatatggaacaaatcactaaaataaacaaaaaagaaaaggaaaaaagaagaatgtcccaaaaataccaccttgaatttcaatgttagaaatattccactctaaaacatgttctccttgatttatgccatcatagacttgacattaggtcaaaaatattttttgtagctctcccaacgttaaatttaactggacagtgtaattaaatgaaagaaatcaggtttggggtggcatatatatttttagctatgatattctgggtgacatatatcaaatctatgtattatataccaaaagtccactaaacttcctataaacgctccaaagttgtcacgtagcgcttcaacaagcattcctaggcccgccatgtggcattctacaatcccaccatcgattttatgtcgcgtcccaaatcgaccctaaaatagatcctctaaattatgcctagaataattaaaatacttatgaaatccttcaaaaattaaaatgtgcaaagttaaaagtcaaataaggcttggaggatttttgtatatttcctaaaagcctaaaatgtgtaaataaattttagtggaattttcagagcacaaataataattattaagaaataaacaaagttaaaatgattttataaaagaaaaaccttaaaatcccccccctccccc

SEQ ID NO: 12592 - DNA, 16474 bp, Oryza sativa
cccctccgtttcgctcgccgaccaccggagcaccaccgaccccgtggacccgagccgcgccaccgcctccctccgctccggccgcctcatccgccgccgacgtcgccccggggtgagccgtggaccgtcgcctcctttcccccttccctcccctatctcggacgccgctccgccgcgccagtggtcgccggcggcgaccatcggggcgcgggcgccgcctcccgccggccgcgtcgacgtggccaccttcgggcgcgccgcgcggttgccgcgtggggcccagccgtcagccgcccgcgccctcggctgcggctgacgcgtggggcccacggcgccggccggagtgagcccgggtgcacccggtccaccgtggaccgtgaggctgccgcgtggttcccacccccgtggacatggtccgcgcgcccctctctcccggctgacacaataaatcccttttaaattaaaatttaaatgaagaaattcgtaaatattcatttaaagagcatataaacttcaaatggccataacttggctatttgaactcggaattggaccgttcaagtctctaatttttccttaagaagtcaagaacccatttttgtgctttgttcctgcttgttatatggagtttattagagtaaaagcccttttcttttccgttgctcgtgtagacgctgcagcttcggaagatccgctcttcgtggaggttgaagccgacgtttgggaaagcgagcaaggcaagtcacatcatctttgaacatattggatcccagtttgtgaaattattttgatttaaattaatgcattatcgctttatttaaattcccgcgttatcactgttttatttagccatgcctgtttacctttgttatgaccttattattattgctattgttattattaccttgttcaccctagaataaacaaaaccccaactagtgggtactctattcatggtgccactagtatgaatttaggtagatgcttcgctgattaattaggcaacattaggtggttttataactctagactttgggaatattcatatcacttgaacattatggaatggttggattattgcgaaattggatgcacacctccccctctattcaaaaccctcaaaatggttttaggctgggctcggggtgcatggttttgatagtagcacctcggccacgtaaggaccggtcttcgggcctctgttgcaaagcactcccgtacttccacatgtctagtgggtaaggcttagtttgtggctcagtatggttataaacaaaagtacacggatggagagggacgaagtcgggggtcgatggacatctctaggacaaatgaatgctacacgagctgcggcccggtagtcaagaagtcatggcacaggcctggtgtcctgctgctaggggctcagtcctgcctacctgtcccggaggttccggccgtaggtggggttgggtcggtactcttgtctatggctaggatgggttggaaactatgtcatgtcttccgtccatatgccatggtggtatgtggcacgtggttgcacgtgaggaagacgtgtcttgtgggtaaagatgtacacctctgatcaaagtaaaacctattcgaatagccgcgccctcggttatgggcaagcctagcaatgtacccaagttagtgttttcaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacagccttgtttaataatattaaatagttctaggatcgtgttttaaatttagcttcgagcaactaagtgtcttttaaatgctgtttactgcaaaacctaacccctatactataactccattgtactccctcgcatttatgttgcacttgtgggtgtgtcttgttgagtacggtggttgtactcagtcttgcttaatttttcccaaacccagaagaggagcccctggatgatgaaggctttggtgtttagctcgtgcttgccgtcaaacgcctgtggtcgtcgccctagtcttccgctgtttcccgtttgtctttgtgtgagctgggccttcgccgcccatgtaataattaactatttacgcttccgcttgttaaactctgaattgtatcaacttttggtgtaccttgcctcctgggacaaggaataatacacgcacgtaaggaacgcccgttgggttatttccggtcgtgacattttagaaggactggatctatgtcaaaatcgcgtgcacaagggcgtctcgggaccaatcagacatgcgaaaaattgtgcgcaaggacgttgtgggcccaatcgtggaagcgcgcaaaggcgcgtatgaaaaatgggcttaatcgctggcctgatcgctgcatgtggcaaggggcacatggaaacgtgcaagcccaaataattcacgcacgtctcagataagagggacactttggcgtaagaaaaaagaaaaaggttttgacagaaacataaaattaaaaacaaaacataaaaattaaaacgattcaaacacgatgacgtgccgaaattccggtgaaaacatcttcaatttttataatagtagattgaagttttaaaatttttataaaatatctataagatggtaatatgaaaccattgtaaaaaaagagaataaaatattttctctcactattaccaatccttgaactcaggatctcttggacaaatcatttttgtcttcaataaactaaccaacttaacccgtgtcattaattgtatatttgtgccttgagtattgtttaacaaacttaccaaattattttgcaaaaaatgtattatttaacagtttgaaaagcgtgctaatgaaaaacaaggaagttgatgtttggtgttgaagaaaagaacagagcctcagaaatatctctacagagttttaaatatttgattaaaatgcctttacatattgttgacggtcgttatcgatcagtttcgatcgtcaatattaccaaaatagaagagaactagtgatgcttgcaatgcataaatatgttagaataataatattccactagtattaggtatactaaccttttgcagagaatgacactaaagtggaggagaatcgacatcaacatggaagataaatcagtctgacgatgtcgagaatcagacttatgcatgaatgggccaagaactcagaattaacacgtcaaactgggccaaaattcataagtctacaaaaaggagcaacagaggtggccgccagccgaaaggtgggctggttgggccggcccctagttcgaccgaacctccctcgcctccgttggatccaggttttggctggacggttgagatgaagccccaatgacggttggagggtattaccgaccattccaaccgtcacaaccgtcatagttcagctataaaaggagctccccttctcacttcactcacacaccttaagcaatagctctctcatttctctcaagtttagtatagtagtatctagctggtaaatagaattagaataggaatcaggagtccggaagtcttcggaagagtttgggtatggctctagtagcttttctcttctcttttgtaagctttgtacttttattagaatactcttctaaatacatttatggtattgaaatactttccgagtatatgagtacctactttacattatgttcatgttatgctgaatatacggctagcttatctgggagatgctttggtgcgggtacaatgtttgcttatgcaattactctatgttatgatgatgatattagagtagtatctggtagtttagacgtggtgtctagattacgggatatcattatttagggttatatattgcggatgagaggtgggccgctgatggtgacagttcagtacgggtattcctctgcgctggtatataatcctaagttaattccctggggagggtatttctccgtatttagctccggttgtatggtcatgacaggctgtcgtaaggaactcggcagtcaggggtggcttctcgaagtaccaggagggcattggatcgaaagtattagctagtatatcagttaactagaatgtatgtatactatgtatattagaagtataggaatagattatctttctcttttctaaccacttagcttagataatatattatgagaatgagtagttaatgcttgtgtgtcactctacctttaaattatcttaacccttgcttagaatatgattataacaagtaatatataaattgttagtcaagttctctctacatgattttcccacgtgataaaataaatacgatacccttggaatattctcgggtgaaatgctacaatggtatatctgtgcgcttgcggatgaactctgtaaccatactataccaggagtatttctgcgccattgttgggaattatatttctagtaatgtcgttaagaaataccaacacttattaggcgcattttaaagtgtaaaaaaaatgcctctataaaatgtgttgaaaatatctctacaatgtctctagagtacacattttctaggcaatttttaatgtgtctataaaatgtttggggtaattgtgttcttgcccttgctttccgattcaattgtacttttacctttttagggattgtgtttttacctttttttcaaaatgaagtagctgtttgaccttgatcatgacgaaaaatttgataatttaacactttttttatttcccaattgttttagttagcacttgtgaggataacatgtggtaccatttgaacgattaaaagtaggccaggatgtcaaataatcgaaaccaattttaaaaactgttaaattatcaaatctctagagtgtggccagaattttcgagtaaaacaaatgggggagaaaataaaaaatgattttgtaatttgtgaatgactgttatacctctcgtgagtaaataaatcactcaagtagctgtgtgaatcaggctccgcatcccaaaaccctagaggatttggcggcggcggcggcacgaacaaagcggcggtgacacgaacaggtgacggggaggcacggcgacgacgcgacgtagggatgaagtatcaggcggcggcgaccgtggggcggcacgaaggggaggcgcgtgcgccgcggaccgtcgccaggactacgggcggacacaaaggggaggcgcgacggggacaacgggacgcaggggaggcgcacgcgcggccgaccatcgtcgggactgcgccgcggaacagcgctgctggaggcaagtaggcgcagaggtggcgggcgggtacggtatcgacacttcgacagcgaccaagtcggccacaacattttgccgctgggtgcatcggcggaagaggaaggtgtcgaccgcatcgtctcatgcgaatcctggacctcctccttgttggatcccagctttgctcaaagctagctaccgctgccaccgaggaactgggagggtttaatcagtggcagatgtaggaggggataataggggtctgaataaactatataaagctacaaccacccttcctatttacatatagcaaaaaaaaaaaaattagcggggctgaggagactgaaatttactccatatttctatatttttcatggattatttgaggagactgagaagagtgggttttgggggcagacctataacattttatacttgttgggtatttgaaatttgttctttggaaaaaagctttgagaattagttgaaaggtctgcgtatatttgaatgtatgatttaatttcaattaagacacttgagtggagtatattgttgtagcaatattaaaatattaatatcatgtactaaatacctcgaaggacacgtgcagatagtggtaatcaaaatttggtcgattaatgggaagtggaaattatattctgaatattgtacaggcaattgcacttgttttcataaagtaaaaagctagagtgaatcatcgttagcataattaggagtttagtgtgtcaacagatttataattcttacgtgtgttaaatgggcacattagttgatgcatacgtacgtcggtacgtgttatgtgtgtaaggtggtgcgtgtgcgtcttccacatagtactagcattttattaagtcgtatatttgtgcaactctaaccttctctccattagatgtgtctacatgttaattataataataagcttaaatttgtactaccatcatacaatgcaagcgtaacatacttgacagaaagtacgtgttgcttgaaaattaacatttttttatcatgatttgcaattaataacatcaaatagcttccatacaataattaccacaacaattgtctctctgtattgaatattgtaaatagacttgtaatctgaaatgcccaattcatgatttgttgaacaaaatggtgagtgcagtgcttagggttaggatttctattcatcttctgtattaccatttcccctttccatgtgttccgttccgccttattcgttgttgcttgagttgccgtcttcttgtcatctccgctggtgcacgagtcttgtactcctctcatattttgcttattctctacttcgtacatatatgtattatgtaatagaataggtgttcatagatgaaatctagttccaacgcaaatattttttttgagaagggtatttttttacccggcctctatatccaaccggatatatacggccattgaaatatgaaacttagacccaaacaacccaatctgaaattcgctccataggagatttgaactcaggaccttgggtactacttcggtcactgtaaccactaggctagatgccctttcgttaataactaagtattatcattaacaactaaatattatcataacaataaataattggttatcattatgataaatttctgaaatttagcgtaaaacccaaagttatagaatttagctgtgcgtaaaaatatattccttcacaatatatttttcaaatacaattggttggcattttgtggtttataaacctccaaaatgtatcagcttataagaaacaaaacatccacgccactccactctgtttgtgtgatctctctgagaaattttccactgtgacaaagagaggttaggtgtgtcagggtagaataaattgttgttatgagaatgcgtgaacagtgtgataatgtgattgaatatttgaatgggcacatgaattactacttttaactctatcagtatacacgtcaccttctcttgctaatgacacctcatcattcttttccacactttatttcctttctcattcgtgcatcccctgcttgaagggtctagaaccctctgctttttacctctagtatttaagttcgatcgaaccgttaaaattgatttcacgttttttccttagctaatccaacggctatatttctaagatgatgtggcacattcttgtctcatttcactagtgaagattcgaaaagaaagagtacaactagagaggatcatctttcgaatcctcggtcctgactactacttctgacacaaaccatcttaaaaagatgattagcgtggtggataacgagtcagccctgatcgttaaggttcgacttaattaggcttggttcgatcggattgttttaacaagccaaaggtaattaactcggttcatctcgtgagctagctcgtgaaggttgttagattcattaacacatttatatcatctttataatctgaaattgaccactttatcatatattaacacaataataaacactagctaatataaagaaatcacaaaatagatagtttggaaataactagctaaatgactaaattaacaatagctaaaaagcactaaatatgcatataaagatacgaaacgatctaatcaagcagcttaagagcttaaagtctcatcatgactataagtttgagctgataggagacacgagattcgaactttctttttaccacttaagtttgtgggagatgtagctgtatatttttcttcactccatttattttttttatatataatgtcattgacttttgatatgatgggcttatttggtttggagccaatttttgccctaccaaaatctaggtagtaccaaaacattggtaaattttggcactaccaaattgggtagtattcaatttgatctatggtgggtaaaatttggtagtaaaacaaacatctacttgctactattgaagttgccaaaattttagtagggtagtaaattggtatcaaaacaaataagcccgatatttgatgattcgtcctatttaaaaattatataagtattatttcttttgtcgtgacctttttcattaaagaccccttaagtatggcatgtactttatcatatttgcactaactttttaataacataaatgctcaaatattgttataaaagccatagatagcaactattgagaaattaaggaggtagtatttaattaattaatttttatgagcctacagttttggtagctgagaagcattttaaggcattcctaaggatataatgggggtgcaaaccagaataaatgacagtgggtgtatgagacccactactacacaaataattttcctgtacaaacacttcaatagattgtagatagatcataagtgttcgcgtctgtaaaattttattttcgtatatggccctcttaaggtgtcgttgcaaaattaggatgattttccagacgagccacttaagaggtcacacggaaaaaaatattttcgtagacgagcttcttaaggatctgtccataagtctgatttacctcctcttccttctcagcacttcattttttttttaaatcatccttatctcctctcctgtctcctcatactcctcgctctatctcaaactcctctctcccggacagaactctctactctctctctcccggaccagacggcggcagcggggggccctccatggcctagatccgcgcggatctggctgcggccgtcccctgccctgaccagtagcaggagagcccgaccagctagcattttgcgattttcttttcagattttttatttttgcgtgtggacgacagaagcacctgtacggaaaaaatgggattttcgtggcgtgtgggtcacccgtatggaaaaatagcgattttcgtagacccggcacgtgaaaatcacttttgactcgtatggaaaaattactttttactagtgacggatgaattgtaccaaggattgagcctgcttaccgtgtcaaaatcgcgatgatcaatgtaacactaacgcagtatcatgaagccaacatatgttttccatcaaagaaataactcatatttaacttggagaaatccctacaaaagattggattacattgtcaactctcaaggcaagtctgcctgaaggaaaaacactctcaagactagtgtgaaattgatcatctcaacaaaaacgcatacattaattagaaaacagaaatgggcaaaaagaaaagaacaggagaacaaagatagagattaattacacttcatcagtgttttgaaagaatctgctttccgatcgaggaacttcaagggcagtagtttcagcacgtacgggtaacatatttatactgaatgatcaagcaagaaggagagcaaacaacgcccacagcgaagtcgaaacgacattggatttgatgaagtgaagtcaacgttagccacagttgcaaaaataatagatcgagaccggtattctagaacaaagtggcttggctgtaagtctccagatcttttacggtgtagtatccatcattaacttctaaacagttaattaggaatagaaactaatattagcacgtgtagtttagtaattcctcaatcaccatccctcggctggcccaacatgtctgtctaactctagtgaaagaatgaacgcagcgagtttgcgggcgaggagcagcggggaggcaccctcaaggcctcaactccctcacgcaggcacgggtcatgggtgttgtgaatagaattgattgagcgagagagattgagtgagagagaattgcacataagaatatagagaatgaatgagcgatcatttattgataacaatggttacaatatataggggggagagaggcggcaacagaagacgcgataatttgggaaccatcgcgtccgttgttagaatcgccgtgaggcgagaagaggtgtggggcacgaccaaccatcgtgtcccagaatttattgctgctctatctatatagatggatgagatcacccaaatatttcagaacactctcccttgatcgaatccagctttgatcattactcatttagtgttccagatatctgtaaagataatcttagaaataattatagttaaatacatcacgtaaaactactcgaaaacccagtgggaaaaataaggagagaaccgtgatatatattatggactattttagatctatgagtaaagctcatagtttgatccaaaatagtataatgtctatagttatcatttagtaaaaacccagtggggaaaagccaaatgataagacatataagcttatattgatattacctcgttaaaaactttggatgagaaaacctaaagggtaaaactcatacaaaggaaaaagagtataatatgacgaaaataggttattttccagaggaagatactccccctgaatcctgcaaatttttaagtcgtctcataccaattccttcgacacatttaaagaatgtggagtatggtagagattttgtgaataaatcagcaagattatcacatgacttagtttgcaagatgtttatctctccatgttgctgaagctcatgaggataaaataatttatgagcaatatgcttagtgatgttgctcttaatataaccagtttccatctgaacaacacaagcggtattatcttcatagataatggtaggtgattccaatgaaccaataccacaagatgttaatacgtggttaaccattctgcgaagccatacacattcacgtgacgcctcatataatgcaattatttcagaataatttgtggaagtggctaccagagtctgtttagaagacttccatgaaatagcagttccaccctgtaaaaatacgaatcctgtttgtgatctggcgttgtggggatcagatagatagccagcatcagtatacccaattaaagtcgaatcctggttctttttaaagaaaagtccaagatctcttgtgccattaagatatcgaatgacattcttaactccagtccaatggcgtttggtaggagcagcgctgtatcttgctaatagatttaccgagaaagcaatatctggcctcgtactatttgcaaggtacataagtgcgccaatagcactaagatatggaaaatcaggaccaagtacatcctctccatcttcctttggtctaaatggatctttctccacgtctagagatcgaaccaccataggggttttggaaggatatgacttgtccatattaaatttctccaaaattttctgggtatatgcactttggtgcacaaggattccaaaaggtaaatgctcaagttgtagacctaagcaaaatttggtttgactcaaatccttcatttcaaattccgtctttaaatgatgatgtgcttcattaatatcttgtgtattgccaataatgttgagatcatcgacatataccgagataatacaaaatcctgtgggggactttttgataaagacgcacgggcaatcatcatttttagtatatccctttagtgaaaggaattcacttaatcggttgtaccacatcctgctcgattgttttaagccataaagtgacttctgcaacttaacacaatacatgttacaatttaccttctgattcgggatgtcgattccgccaggaaccttcatgtaaatatcagaatcaagtgacccataaagatatgctgtcactacgtccatcaactgcataaatagacgattttgtactgccaatgatattaaatatcagaaagttataccactcataactggagagtaagtttcgttgaaatcaacgccaggtttttgcgtaaaaccttgtgctacaggccttgctttatatctcaccacctcgttgttttcgttccgtttccggacgaaaacccatttgtatcccacaggaaagataccacgaggagtaggcattacagccgagaatacatctcttttgtaaagcgaggctaattctgcgtcaattgcgtccttccatttgttccagtcagagcgcttttggcactcttttatatacctaggttctggatcaacttggaggcactcagcaatttgttcagaaaaattagtgtcgacaattatagctcttctatcaaaagattctccagtttcagagtaattgatggcaatttcatcaacccttatagactcattgtgatctcccgaaacaatgtgtctatggtcttccgaattcctagtctcagcattgtgcaccaccgagctaggttgtagactatcacgatctgcttgacatatagtatcaatttggtgtgtaccaactaaaggttggtttgcatttaccgtctttctttgcttattagcaattgtttctcgctgagtggccatacttcttcctctctttttagtgagtggaagttgagtgcttttatttggtacctccactctttctggcgcattctgagcgggaatgaaagatttagtcacacctttataattggtaaatgcatctagcatgttatttgcaagtctttgcaaatgtataattttctgaacttgaagttcagtttcagtagtacgtgggtctgaggctggaataccctgggcatcccaatcaatttcctggcattctttttggtacttgaattctccccctaatgccgggaaatgttcctcatcaaagatagagtcagcgaaccgggcggtaaatagatcacctgttaagggttctaaatactttatgatcgacggagatttgaatcccacatagatccccactttcctgtgtgggcccatagcggtacgctgtggtggtgagatcggtatgtatacaacacattcgaacttacgcaaatgggaaatacttggaggatttccacgtactagctgcattggggaagtttcatgatatgcagttggtcgtagttggacaaggtcagcagcgtgcagaactgcatgaccctagcacaacgaaggtaatttgcaattcattaataatggtcgagcaataagcttaattcttttgatcaatgattcagccaaaccattttgtgtgtggacatatggaacagagtgctgaacctgaattcccaatgccatacaataatcatcgaaagcatgagatgtaaattcggcagctttgtccatacggattgattgaatcctatgttcagggtaatttgccttcagccttataatttgtgacatcaatttggaaaaggcatggtttcgtgtcgatagaagacacacatgagaccatctagtagatgcgtcaatcaaaaccataaagtacctgaacggtccatatcttggcacaatagggccacagatatctccttgaatgcgttcaaggaatttaagtggttcggctctgattttgagataagatggtcacaaaatcagtttcccagtagcacatgcagtgcatacgaaatcagaggatttgagaaatttgtcagtgatcaaatgatgaccaatagagttgccaataatttttctcatcatcccgataccggggtgcccaagtcgatcatgccaagtgtggaatgcatcaacattttgaaaaattactttgtacgcaacatgtgcaatgggcttaatgtatgtatagtacaacccgatgtgagagatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattaggagtgtaataattgctctttctgagccaactatcacagtatcgcgcccagcgatagtcaaactttgccttctctctttttgagagtttgaaagtatttgatctccctaagtatagagtttatggtaccactgtccacaagacataattcctctccaatcggagcgatatccttagacatctataatgaaagaagaattgcatgattaagaattctttatccaatatatatacatagatacaataattaaaacatcaaatacatagtatgacgtttacatatgttaatagtacatactctaatgactaacaagccatacaaccttacaatacaagggagttcgtacttatttacttattacaaccaatattatttggcaaacttataggatatcaatatactgtttcaagcacactgagataagggcagcttcatctccaagtgggacgcatcgagatcattgcaaatctccaagtgggtccgttgagcagtattcgatgaacatatcatccatcgtagagagtggagcgacatcttctgggagaacattgaggttgctctctggttcagcaggagcctggtgagaacttgcaacctcagggtgctcttcatgtgtaatattgaagtgtgcttcaaatcttgggttctcagaagattttttgtccttgagggatttttggtacaagaggataagatgtttcgggatgcggcagtctttagcgacatgagtgtcagatccacacctgttgcaatgcttgttgccattgctacgaggttgtggtgccttacccttcccttttcctttctttcgacccttgaatttgcgcctgttgttgttgcgtttgcgctttccagtcagattcttatgattattcgaagaatttcccttgaatcctttcttattctcagcattattctgtacattgaagtgcacctcaggtagtggagcagagcccggtgggcgctgttgggcattctttaaagaaagctcatggtgtctttctgcctgagtcaatgtatgtataagcagagaatgtttccagaaattgttagcgcgatactgttgagtcagtatcctgtcctccggaagcatagttggatagagttttttctatcttttctgcctccgttggctcttgttcgcaaaacttcaacctggaacaaatgttatgaacagcatggttgtattctgccacagttttaaagtcatgtaggcgtaaatgaacccactcataattagcctcaggccaaatgagttccttttgcttatcataacgctcttttagagctttccaaatgttgagagggctcgtctctaacatgtattcatgtttgagatccttgtgaatgtagagtctcaaaagaaaaagggctgtattgagcttcctgggctcaattgccggatccccatcattgggttcctcaattgtctttagaatcccccgagaggcaaaattgattttgatatcagaaacccatatgggatagttagtcccatcgagggcgagttcgtcgaactcttttgtttccatgtccctacaatcatggttaacattatcaatttacagaggtaaattaataaaaacatgatattaaggttgtaatctcaatgcgaaatgtaaaacttcatattctgtaatgtttcgaaagatgtaggttatggacctgacaatttttagttagaattcgaaattaggtggcacaatgtggataatcttcaagtaattaaacagtggagtagatctcttaatagtgggcaaggtatacttgctgcctaaaatacggtctccaggcaaatatattatggtgaatataccgtagccaatgtttagaactccactaccttgtgttcaaccaaatttcaaataatctcatttctcaaaacatattcttggaaaagaacacatgtgggtaatcatcgtgagatgtagacctctgtgagatgggcgaggtgctcgctgcctaagttatgaccagtgcggccaatttctagggctccatcgggtaatcatctcaaaatatagaccactttatgatgggcgagatactcgctgcctaagttatggtcgatatgaccaaagtataggactccatcgacatgtgattaatttccaagttaaagtgtgaagtggaacatgcattaaatcctccattaattatgttggacataattaagagaatttgctaaatcaaaatacaaaatttatagagaaagtagagcgtgtcttgaaataatatgcaaaaggcatgttattaagacaacaaataaatttagtgaaacaaggtatttaaataaacacctatgttaataaacacataacatcagtggtctataggaccattacataattgtttgtacaactgatgaactgtttcgactaaattacataaaatatagggactaaagtgaaattgctgctgaaaataaaaaataaaaactaaatttaaggggtaaatgggtggtgggcc

SEQ ID NO: 12593 - DNA, 17182 bp, Oryza sativa
  unsure (1)..(17182): unsure at all n locations
ccgccatctcccatccaccaccacctccaccgctgccatccaccatccgccaccgccgcgtccccctcattggccggcggcatgccgacgatcccgactccttatcggagtcggagaccggccggatccgaataccgttcccccccacgccgtttggtatcgtgcggctccgggagccgtggggaacagcgatgaacgtatgacggaggccgggacggcgtgcaacggcggctccagcgtggcgatgtgttggagacggtgtaaagagaggcggctcccacgtgcgcaccgccatggttccggtgcggccgaatcctggtgccgcgggagtgggggagcgtcgaaagctaggcgtcggttgcgatgttgatggaggtggggaaggagcggttggtggtgatggagtggcgacgaacggggccaacagcgactccatctccagtgggagttcacacggctcgccgggcattgtcatcaccgccgtccatccatggtaggcacaatactgtaccccttgcacaaggatccagcgaggtgcttcggcaaccggaggcggaggaggtgcgacagggatggggggggggccacaaccggagttgcaggcacacgacgagggtagtggcggcggccaccaaccctagccctgcctccgcgggatccccggcgcgtcctcctcatcgatcgacgaagaagaaggtgaagccggcgtgcgcgctgatggcgagggaggccgaaaacggcatccatgatccaatgaaaggtaggcatcgtaccttctttgttgattcttctgttcgcttttctattagatcaaaagcgatgtttcttcctttcacttcgcgatctccttcgcgagagcgaaagtgatgataacgtgttgtgaatagaattgattgagcgagagagattgagtgagagagagaattgcacacaagaatgtagagaatgaatgagcgatcctttattgataacaatggttacaatatatattcgggagagaggcggcaacagaagacgcgatggtttggaaccagcgcgtccgttgttagaatcgccgtgaggcgagaagaggtgtggggcacgaccaaccgtcgtgtcccagaatttatcgatgctctatccatatagattgatgagatcacccaaatatttcataacaatgggggctcgttggttcaaaaaaagatcagatccggtgttacggagcaaaggtgaagtgggctgccatttcccatgatttctggccagtgaagaataatttttctcttctcttatatttctgagagaaaagatgaacagtgtattttcaaaaaaaaaattctgctgcaacaccaatatcaaaaattcatattgatagtacaaacttgttgcaattttactgttgttttttatgtgcttttatctctcttttttctagagaagcccggcttctatatccaactggatatatgcaatattttttaaattgggaacttcgctcctatgaagatttgaacttaggatcctgggatgctactcaggtcactgcaaccactaggctgctcaggtcactgtaactcaggactttaggatgttactcaggtcactacaaccacttgagaaattgatgcgcttagtttgaggaatccgtagttaatcgctaagcatttaattaaccaccgtatgaacatagaaatgcctccaacacactctatcgggacttcgcattgcaggctggatgggatcataggaggaagatacgcttttgtcttccgcaaaattaaccacggtatctaattaccattttaaccaaccacttttcgtacctggcccaattttttcatacctttttataggtataccttttatttttgtgcgttagagattaagcgtgatcatgagctcaaaccaccgaagaaagtttcgtaagtcgaacaatgaaaacaagaagtttcgtaagtcgaacaatgaaaacaagactgatgagcagttggctcaacttgcatagcgcagatacatatataattacttaacttatgcttcactgctataatgaccgtcacagatataaccttaaaggtttctaataaatcatttgagtttttataatgtgtaacggttcgaagtccatcggattgtgattgtgttgggaactatatagtatgaaccattagtgaatagtcatcattttgaaaagaggttagagatcattagttctcagttcgtagttacgaatgtttgctgcttttatgtaattatatgcacacaatatgaatccttgcaaattaaacaaaatttgcaacaatatcaatccttggaaattaaataaaatttgctactgcctccgttccaaaatattgcaatataggatagaatttaatttatcataaaataatgtaactaaactgaaccgatttaacacattctgtaaccataaatctcgacataggttctatccagattcagtggcggatattgagcctaggcaaacctaataatagagaagaactacaattaaatccatacaaccacgtgcccgatttagcatagatcgagttctaatttatgaagaagacaaccaatgcacgaaattatattgatgaaatgaaactcgttaatggttaatgttgaatacttgacattatatgtatatatagctagtcattttgctagtttatgtgctgatccactgatctgacaaccattattggaactagttaattaaacatgtaatttgctattttactcaaatgtacgtggctgaacgcctgaacttgtatctaagtaattaacgtaaactgataactactgcatagtacggccacatccggcagagcccgggcacctgccgaggctagccgggtcctagctccaccactgtctaaattcgttattttaaaatgggtcaaatcttatcctgaatagcaatattttagaatgatagagtaggtgacactctaaaatatattatttggcgaaggacgatctaaaacgtaaatttgctcatggattaaaaaaaaatatgattctttgctacataacaccaccagcaatattttatcatttttggctacttgtgaaaaaaaaaaagagtaatgaacagaatgcccgggaaaaaaaaaggcttatcttatgtatccagttcgcccaatatgtcaattgtcacctctcttgaatctcttagaactgtaatcataagaaagtagctgtgctaatggctatcacaacgctcgctactacagcttcagtttttccacgtggccaaaatcaatattttcatgcggacgggcggaccgcctacgcccaaaagtctgcaaaattcgtatttttgcatgtggccagcgcaaccgcatgcgggcgcttaagccaacggccggcatgcgaataggaaaaatcgtgaaaggaatagaaattatgaaaaacaaaaactactcagaaactctaaccctagaatcctatcgttgttgctgccaccgtcgtatttgtccttccgtcgtcgccgaaattgtcgtcctcctcccatagccaccgctgacaaatccgcgcgggaataggaggggacgcgtgatccgggctggggagggccgctgccaccatatccaggttggagagagcggctgccgccagatcggcgcggggagggtcaccgccgccggattcaaagggggggggggggggtgtccnncnaccntnnccacncccccgtgtaactgtcacnttgtcccatcgccgttgncttttggggagcgggacccgcccgaagtgggtcgaaccgcccgcacacggccacctctttgtctgttggggaaccgctcgagatctctgagccggccgctgcccgccaccggcccctagaaggagaggagagaaagagagaagagaggaggaggtgaaaataatattaggaggagaggaggtgaaaaaatattaaagttgctgagaggcaaaagagagaggaggggagaaaaatttgtggagagggggtattttcgcacgtggaccatttaagaagcccgcatgtgaaacgtcttaggaggcccgcatgcgaaaataggctcatttttttatgctgccattaaaaggctcatcagagaaaatatgtttttgcatattgtcctcttaatgaagccatatgcgaaaatggaggttgattttttttttgttcagatgagaccaattacgagcccgcacaacttataagggttattggatgatcaatcttctccctaggggcattctggtcattttaaaattttgctctctccaaattaactagccagaaatgataaaatattttatgcggtatatatcttgcagagaaaaccatttcgatcagaatagggagcagccatgtttcttgctgatcaagctcgacagagggtgatttgttgctattttatttaaaattttgggtacttgacgctttccccggctctaaattgtcttcgaaggctagtaacatactccctcctgtttcatcaggttacagcacgttttgactttggtcaaagtcaaattattttacgtttaattaagtttatagataaatatagtaatatttataatattaaattagtttcattaaatcataataaatttgtcttgggtttaaagtgttactacttttttctacaaacttagtcaaacttaaaatagtttgactttgactaaagtcaaaatgtcttatagcctaaaacagagggagtagtagatatcctttactctattgttgtgttaaataatatttcaactatatagaataatcatttttaatcgatatttattttctagatcgaccgtttcacaatataagactttctggtattacccacatttatatagatgttaatgaatctagacatatatatatatatatatatatatatatatatatatatatatatatatatgtctagatgaatataggcaatgctagaaagtcttacaatatgaaacggagggagtaatacgtatttgtctagatatattaatagaattcactttatgtatgcaaattatcgacgggggataccagtagaccggatatagagggtattgaggtacgctggtacaaggatctacgtaatatgacatcaagaaaatagaagacaaggattatactggttcaggctcctcggaaggtagtagccctaatccagttggtatgggattatacagtgaaagccacgaattacaaagggaatagcagaactcgatgataccgacgagatcgtagtcgagttgatccgactagatcacccggtgacttggctcctgtaggttccgacttcatgggttgtggtcgttgtgttaactctgagattccatgccttaggtcatcccggggggtcccttttatatcgcaggttagtggtctccaagtaggactcggagacatcggaccctgcacgatacagtgacgacccagtcctatacgggtaggaatctttccatcagttaacttcgtgaagaatttgcttagcgtatacagagaacgtccgtacacgtgcaggtataccatattgccgcatagcgtatatccaagggtagagggtataccttatccgtaaccctgacacaaataatatattagattttatgcatcaacctaagtaattaaaacatcaatcatggtggatataacttattagtatatgcattaattaagcttctcgtctttcttttttcttttggaatatagatggatcgacgatgtacaattcaaaacgtggtaatgtagagtacattaaaggactcgtaaaatctataacgagaggcctttgatctggtcttacgcagcgacgcctagcacggccatccgatttagtcgagaaacattagagtttagaatttgagagaagcatcagagtgttagacatccatgtctttttcccttctcataaaattgtctctcaaattacttatccgatctacaatccggttacaccattatgttcgttgcaatgtaatctttacaacaagatatcacatgatcatattacgatgaaaaattgcaaattacttttataatatatctaaattacttttagatttcactaaattacttcttagacatattaaaagtaaattcaataaagtctaaaagtaacttacatatatttataagtaacttaagaaaaaaagaaagtaactttgtcatgtcattagaagtaaatatgttgtaggtataaaaacataactctatctagaaactaaattaatcagcagaaattatggaattgactaaaaacaataataaaagtaatcaccacgtaacattatgaatcaaatctaaaagtaatttatatatatgataaaagtaacttagtatataataaaagtaatttacaaacataaatacttttttcttcataatataatcattaagatctcgttgtacagatttaattgtaacgaacacaacggtgtaatcggatcgtagataagataagtaatttaagagaaacttgttttttgaaatttagatgggttacgaggatgcaagtggcaggtgctactgcttttagtaagaagggtaacaagtggatacacactgtactacttttggtaactccctgtagccgtgtcctaaaggactagatgcatttctcatcgcctttgaggaattcaggttgcaagtaaatgcaggcactactagaaaacgcattatcgccggcagtggaaatcggttttcgcaggcagggccgacctctgcttgtaagcaaacgacggtgaagatcatcgatcttcgcaggcggggcgtccgtccgcctgcgaagattattttcacaggtggacgttagctagattgatccgcctgcgaaaatatgtagaagccgactgcaaaaaaaaaacatccgcctatgaagataggtagaaaattttgaaatttgatacaataataatttgcccataaattacttttttattatttaatagaaattcttgcaggaagattattatatacatatattggaaagattatcaagtatttggtactgagaaatctagatatattgcataactgaaaagtgttgccaaaattatatatattacaatatttttttacattgtcacttcaaatacaccatctagttacattatggcatagtagtgctccactctcgaaatttcttgaattcgtcacttgtagatagggcaccctctgggtcgaaaaactctcctttcacatgacaacactcatggtggatgaattggcacagatcgcgctggacattcgtgatgcttgtattgtcaaagctcgttcgacgttctattcttagcaactgcatgcattgaagataaacaatatattagtatcataaatatgtgaagctgtctaatgcatagtatagagacttacatcctccgcgttaaccttgtacctcccattaaccctgaggaattcgtacgcgtaatacccgcaaaagacagttcctataggttgcttgtgacacttcaggacatatcataggaaaaagagttaaattttgcaattagtgaaacaattggaatacattaagtgagtgaagtattaccggccaatatgtatgtactagcagcttctcccttgttcgggtctgttcttcacccttgaacttgtagtagttgtacacactgtatggatgtcgtaccgtttcgcattaaggaggatatttaattataaaacattcatataaaaatgtaagagtcaatcacttactactgtaagattgttagaaattctttgtatgactggtgtatgtaatcgagagggtccaagactaccacggttccatccttctggtggatgattaaatagatataatgatcgctacatattaaaaaacaacttagttagttagtaccggctaaaataagacacatgtgtagaagttaaatgtaccggacttacttaaaattataagcggccatgacgactctcttattttgaaagtgcaagaaggctcgtccaatatactatgcgacaataatcactttctccttgtgcaagcccttcttgtattcagttatctcttgtggagtcttgcccttcagctgatctgaccctggtgctagcctcacggtatgttgtgtttgacagatccgagttggatccaagaagctgataggtttatttttcttcttagcatccatgtattgcatcctacagaagaagtttgttagagtaagttcaatagtatagccaactactagcttcaattcatctatagccaatctaatagctcattcatacaatagttacatactacactattaatacctggtcccacctgtcattcacacactgtgtcttggagtccgtgttacagctggctacaaatctgtagcccgctgcccttctctctcctcgtttatcttcttaaaatttgtttacagctggcttatagcctgctattgtacctactcttagtaataattacatggatttgtattgtacatatttttcatgtaattaattaaaattcatactcacatgcacctaacagcaacatagttgacgttcatcttgtcccgatgatatatggcatggagatcttcgaaatctagccatacgtaacattcgccgccgaaacaatctgccggtgatcgagctgttatattgcccaagcctttcttgctggcatccatgtagaaggtatgtaaccttctcatctcctatggtccttcgtaaagtgcccaatccggcaagagtgctttcccattttcgtatttttccgagcaatcatcagttggcaagtatggcctggctagtgcagcagccttctgggggtcatcatctctgagtttggcacgttccttaccccctctgaagatggttaccatgaacttctcattgttctcatctttagacttggagtcgtggctcataagcactttaggcaccttagaattgtcagtggccttctcagggaccggggtttcttgcacctcggggtctttcgcaggagaagggtcttcaaatatttctggctctgtaccgtcccattccaatcgtactacttcttctatatatgtcccgactgatgccacaatttgcacctctggttctgccactgtaatctccattgggacaacggcactacaatctccatgggcacctccggcactgcaatctccggtggcacttccggcactggattttccttatgcatctcgggttcctccgccttacctgtcacctgcctcttcggaggaggtctcggaggtttttccacccctagttttggcaccatgggttttcgcgtggcattggtgcacaatccaaaggatatgtcattctagtgctagagaattacaagttctgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaatcttctcttactgaagggggaaaagattgagcaagaatgagtacaaccacagtactcagcaagccacaccggcagatgcatgattaatgcaagggggtacaaggggtaataatataggggttaagctttgcagtaaacagcatttaaaagttacttagttgcccaaagccattttataaagacgatcctagagttacacagtattattaatcaaggccgtgaaccctcacgaacctgccttaacctaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtagccacgtgccacataccaccacggtatacagacggaagacgtgacatagtttccaacccatcctagccatagacaagagtaccgacccaatccccctacggccggaacctccgggacaggcaggcgggactgagccccctagcagcagggcaccaaccctgtgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcctgagcttaatccttatagtggccggggtgctacttcccacaactggcatgcacccaaaccccaccgaaaacaggttttaggggttttgaaagaggaagagaggtgtatgtccaattccaccatcatccaacaattccatagtgtccaggtgatatgaaaattcccaaagtctaaagttataaaaccacctaatgttgcctagttaatcagcgaagcatctacctaaattcatacccagcgggcgcgggcggctgacagccgggccccacctggcagccgcggggcgcgcccgaaggcggcctcgccggtacggccgacgggaggcggctcgctcgcgcccctatggtcgccggcggcgaccaccggcacgacggagcagcggccgagagaggggagggaagggggaaaggaggcggcggtcctcggctcaccccgggtcgacggcgacgacggaaacggcggccgaagcgggagaaggcggcggcgcggttcgggtggacggagacggcggcgctccggcggtcggcgggcgaaacggaggagcggacgaggtcgacgaggacgcggcgaagccgatggaggcgatgccgaagcgggagaaggcggcggcgcggttcgggtggacggagacggcggcgctccggcggtcggcgggcgaaacggaggagcggacgaggtcgacgaggacgcggcgaagccgatggaggcgatgccgaagcgggagaggtccggggcgacgacggcggcgaaccggaactcggcggcaacggcggagagagaggacgacggcgcgggcacgattccgacggggagagagggcggcgagcggcggaaacggaggaggggggcgcggggaacgattaaatagagcggggaggggaaagaggcggcccgaaggggaagaaaaccggcgcggcgatctcggctccatcaatggcgccggcgaggattgcgggagtaaatccgaacgaatccgagggagagagagcgggaaaagtggggggaaatggcgagggaatcacggggagtaattccccccacttcaatgcgcgcggggacggcgggatgcggcggattcgtcggcggcggcggcactagggcacgggcgaggcggcgggagcggccggaggacagggatgacaggtgggccccacccgtcagcgagggtggcgggcgggcccgcctgtcagcggcgcgcgcgcgggggaaggccggatgggccgcgggggagaggagagagagggagggagctgggccgagccggcccaagaggggaaggggggaaaacagactttttagggtttttctttttataaaacctttttaactttgtttatttcttaataattattatttgtgctctgaaaattccactaaaatttgagggctgcttttagaccaaggagaatttaacaaaaattctccgggccacatttgaatttttcttgtacgtattttaatgtttgccaatttcttttcgaattttaattaattctagtattccttttagaaaatgatttttaattcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttctccactctggactgcttggctcgatctcctgttgcaggtggaatcttcttttcacctgactcgaaccagggtgcacctttcagctgacgcagactaggttgcggtagtttaatgatgcttccgttccagaacttctcacgattcatattttcggcgtcaacctcacacaagttatcaacttcatgtcatgtgtcgtaacctgcttgtcattactaggataccatgcttgtcatcatgagaataccatgcttgccgtttccttccagcttaccaccatatgctttagactatgatatcccgcttactaaggataccatgattgacaacttgccattaactatctcatattagctttcctggtctccggtgctaggtacttctgcgattcgatgcaagggtcaaccactctaactataagttctgcttcccaagagaaccaatttatcccacttgacatgctttgccgtcttcccgaatgactttgctgctggacttgttattgtctgatcgtgatcctgccagatctgaagcttcgttgttaggggtgattttaatctgacctctgtagactatcttcgaacatatcacttggttcataactgggaatagctcccacgaacaagcagctcggattcactttctttacattcagtttacttcccattattatcttcaggttgtcctcagttagcattcaacgtattcctttacacctttaaccttgatgtgttctttcccattggatcatctcccaagacatggcattacctggtaaccggtgcttgcacttttcaccccgtgtagcatctgataccgagttgaagatttcactccttgccttcatagaaacactcttacctaggtcatcttgcttacttaatgacaaggtgactgttgcggggcaattactatcaggggtcttccttgagcgatgcagagcatgtttttgtttatcaatcacctttcagcctacttctttcatgctagagaacatcgttgccaatctcttttatcaatcctctttcggcttatctctaacaggtggtattctttaatggggattgcggacgcttctggggacgatgaggtcctttggcttgctgcctttcagtgaaaccttgatgcggttcgtcaaaaagctgtactgactaccttcagggaaatacattgcttgctatctgtatccatgccactagggtttaattgccgatgatcatctttagtgcttcctcgggatggggagcatccaaattgttcttctgccatatcacctttgacccttttctgatacctgatagactaattaccatccatcgactactatgttctcaaatattgatgtctcctggatcttcttaaccgtttgcaggtatatccgaacttatcaatgtagaggcatggctggtacccttatgggtttcatccaacaatccttatattgatctgtaaaggcgtatccaaactcttatccccaactactgtctcattggctttttaacccaacacagtttaattggttttcttttccatcaacaggttggttattaactcgaggttagaatatagttcctctgacacgagaccctaggtctcctttgtcaataaacaattatacacatgatcacatatccgcatcttccaaaagaatcctcttagaacttgtctgtattacacattcctcccttattacacgaatacaaggcactgccttaaacaaaaagggaagatgcttatcatcggtacattgtatcctcaacatgaatcatccataaacatagcaagctcactgtttacagacatgaatatatttatttattacatgattgctgcaaactttcgattacgcaatgataagtagcgaactgaaaaccacaaacatggctgctcattttgactctggagagatatagctggcattgttctagtgactgcatccttgattggttctgtgatgatgtgataggactgcataatgctatcattcacaggagaagcttccgtctgattgctgtttgaagcggaggacggtcttctgcttggtatcgccctccggaggttgattgccctttgctcggcctggagtaggtcggggagagaaacaacttcttccatcgacgacaattctctgctgaggctgtcggcgcagagaatggttggtgctgaaggtattattgctatgattgattgcagagtcaggtgcagcaggaggagcattggtgctatggatgatatcgtcgatgttgctgttggagctcactagctgatgagacaatcgtagggtggttcgttggatttctgcggtcttggtcaacaacacactaagttggcaatccttgggcacatggtttgtaccttcgcacagaaaacatgtgatcttgcgggtgggacactcccctggtgggtggtcttcttcacaatgagagcagagtgtgagacacatgctagcaacgtgtccaatttctccacaacgggtgcatgcctttgatccgaagaagtcacatctgaaactcttaatccaaacaaatgtctctttggttgaccacttgattttcttcgccctcaatcactaggttattcgattcataacagattatgggtttacggaaatgagaccctaggtctccctaatcagcaacaaaatgtacacaactcacagcacttgcaatcttaacatggatccttcataaacttatcaaactccttcataatctcatgtttctctgttataacatgattgacgggaacaacaataaaacaaaagtatttgaacactgatataagagtattatgtttgcttctgactagcactaggcttagcaggtactgcatttgctccagtgaccacttggcgattggcatgtctgcttccttaacaggtgctaccgtttgtaacagacaataactttcttacgctcgggttcttcatcttgtacttgattttttttttggctgctgtgctggaacatccaaaggtacaatgccgctgtcttgtcaactggtggctggggctgaaattgagcattgacaccttgtggtaatgtactcgctggagttggagctgttgcaacgggggctataggactgcttcgggatgcatggatgacaattcgctgaggagcaagcttctgattgcagggagttgcgtggactgacgtgccggcagctatgtttctcggttttggccacttgtcggcgaaatgacccattccttgacaattgaagcaacagatatcttctcggactcggcattttctttcctcattttgattcctctgtcctggcactgaagttaggctgaaactgtaatcttggcgaggatttgtgttgccttgatgctgctctccgttggaactggcgggttggctggccatcctcttcgtcagcagaaaactgaattgacaatcttttggtacatgatcagttccttgacaaaagaaacaagtgatcctgctcattggacacctgtcgggtggatggtcttcctcacaatgaacgcatgtagtggcacacgagctggcaacatgaccgatttctccacaacgagagcatgccttacgttccattttgttctggttgaaaccttggggagacttctgatcttcatcatctgatgagacttgatctgaatcttcactatcagacactctacctccattagctaaaagatgctctgtcaactgtggtgcaccccggaaggtatttcttctctgacgttttgtcattcctggtggaggccattctgtgctggtaatggtcatcttacgtacttcttcttcagttcgcatcggtgcttttctcctctgattcttactcttcttgcctttggcttgcttagtacgtgaccccacgtggtacgaagggctaggaggaaagcaattcccgggattcaatggattctcttcattgggctctctgctttgcacactaggctgcaagcttgacttggtgcgaagaggctggtttagcgatgtctgcactgttaaaccaagggaaggagcttctttggcatatacccatggacaattcagggcatagtgtccttgctctctacaatcgtgacaaaaggggacatcctcttctggtattggaagctcatcgacctgggtggcaaatgctcgatcaaacacatactgattttggtcttgacttccaaccaatggtagctgtggactaagcagcatgcttggaatggaccaagggtgtgcccttgttaactctcttgaggctagtggtggattgagttgaaaacttgagttactggaggcatacccgctgacattctttcctttttctctgttaaacatctgttacagggattgaggtgagagaggaaacaagccaggaaagaatagaccagaactagggacaggaccttaaaggaactaactcttcttgatgatgtgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagattttcactgcttctacacagctggcttcactgcttcctccacttcgctagcggaccctgcggtcttccggagcttcggcagacaattgacgacatcttcttcttcgcaaagctgaccatctagtactagttgaaatccgaagaaggaagaagggagtaaaccttttgcaaatagcattagggggaggagaaaaaggaactttcgcaaatagttttatttataaaatatgtccttaggttttatcctcttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggcttcatcttcacaggcgctcaactggggtataagccaagactccacctaagacttcttctccaaatcttttcttactgaagggg

SEQ ID NO: 12594 - DNA, 13270 bp, Oryza sativa
ctttttagggtttttgtttttataaaccctttttaactttgtttatttcttaataattattatttgtgctctgaaaattccactaaaatttgagggctccttttagaccaaggagaatttaacaaaaattctccgggccacatttgaatttttcttgtacgtattttaatgtttgccaatttcttttcgaattttaattaattctagtattccttttagaaaatgatttttaattcgggatgaatttatcaggacgtgacaagttcgaccatatccccaagtacggatacaccatctggagtagggaagtctatgtcgtaggactcaaacccttcgtggaccaattgcggctgcactttggcatatgcatcgggtatgaactctttattatatgttctcccagggatagcaatggttgtagcggcctcaagagttttcccagagcgtcaaatgagaacgtgcaatctgcagggtgtattctccttgaggtcatcgaaggggtaatctggctcaggttgtttggttgcgggggcaggcaaaagcatgtgcttgacgcagaaattcatcatttgcctttcaaaatctgcagccccttcgtctcttagtttatccttgtacgcatcacgcttcttgtggggggtcatgtttgaacccttccttccaactaagcttggacgatgttggtatttcttaacgacattactagaaatataatctccagcaatggtgcagaaatacttctggtatactatggttatagacttcattcgcaagcgcacggatataccattgtagcatttcacccgagagtattccaagggtatcgtatttattttatcccgtgggaagatcatgtagagtgaacttaactaataatttatatattacttgtgacaatcatattctaagcaggggttaagataatccaagggtagagtgacacacaagcattactactaatcctcataataaataatctaagctaggtggaaagaaaagagaaagagaatctattcctatacttctaatatacataacatacatacattctagttaactgatatactagctaataccctctatccgatgccctcctggaacttcgagaagccacccctgactgccgagttccttacgacccccgtcatgaccatccaaccggggctaaatacggaggagtaccctccccaggaaattaacttaggattatatataggcgcggacgaatacccgtactgagctatcaccatcagcggcccacctctcatccgcaatatataaccccaaataaagatatcccgtaatctagacaacacgtctaaactaccagatactactataatatcatcgtcttgacatagagcaattgcataagcaaacactatacccgcaccaaagcatctcccagataagctagcagtatattcagtataacatgaacataatataaagtagatactaatgtactcggaaagtatttcaataccataaatgtatatagaagagtattctaataaaagtgcaaagcttacaaaagaggaaaggaaagctactagagccatacccgaactcttccgaaggcttccggactcctgattacttttctaattatattccaccagctagatactacaaaactaaacttgagaggaatgagagagctcttgcttgaggtgtgtgttgaagtgaagagagtgagctccttatatagaggtaggtatgacggttgtggaaggggaattgtccgaaataccctccaaccgtcattggggtgcaatcttgtacgtccatgccaaaccctagcctcaacggtggagatgggggttcggccgaaccatgggctggcccaaaccagcccatcttcggctggcgacttcctctattgctccactccacagacttgtgaattttggcccaatccatcgtgtcaattctgagttcttggcccattcatgcataagtctggttctcgacatcgtcgattgatttatcgtttgtgttgatgttgattctccaccactttattgtcattctctgcaaaaggttagtaaacctaatactagtggaatattattattctaacaaacatatgcattgcaagcatcactatttctcctctattttggtaatattgatggtcgaaactgatcgataacgaccgtcaacagacgacacacctcgaaccctaccctctatgctcaggagtacctagtgccgtacttagcacatctttctccctcttaggcttgaaagatcctttcttctgtgcactggataaattctctcttttatcggcaacgccctgcagcttcggatcttcaaacgatactttgcctttatccgtgatcttaggagttccagctcttacccagttcctagatctctatgaccattcctccattggtaccggaaggcccgccttccttatttcgtcctcctcttttgtccactgtgtcagggttatggatatcacatacctaatagtagttgactaaatctcggcaggacttaccacataccatgtcttatacggaaactaacctcggatatggatggagttccagataaggaaagacaaccagagttccacatggaaatgacaaggactacttggattgtatccatattagtttccctagttctacttagaaaaggggacacctatgggtataaatacaaggcccctaggaggagaggagagacaatcaacatacacggacatacacggaataatagatcaagatacgagatcaacatacaaggtaacatatgccaagacaagccgccggatatcgacttcagagataggtatggctagtcccctacggtgtctccggatactgtcaggagagacatagcgctgtctctgatctcgctgggcacggattcgaggaggaagactaccctgttgtcaactatgagtcagatcttcagaccgccatgtcgacaacagttagataggctaccccaaatattgtactggtgtgattatggcgaataagagcaacaaccggcttcggccaacaggatgtagggctattacctgacaatccaggggcccgaacctgtataaaaatccttgtctccatctcttttacctcagtctcgcttatatcctagtaccaacgatcctcatactatgtaaataccggaatcgcgacatcaaacgtcgacagtggcgcgccaggtaggggatcttttggtgcttcaaggtttcgacgagatgggtttaagagatggattctccgacaacatactactcgataacttcggctatggaggatctaacctgaccggagtccgtgccccgacatgatcgggaccatcatcgtcaacaacttggtctatcgagatcattcaagcctcaagctccgcggcgtaccaaaagatgtcagatcacatgatatcgaacgagtacgcagcaaggtaattaggagattgattttttaaattaatctactaattttgtacatattctctgctatatgtcttgccttatagaaaatatttttaggaacaattgagcactcgagtaggttgtggtcgagtacaccccattatcgagaacgatctcgacaaatgcagagtcgtcgcgcccaacctgccaacgaagaccgacgacctatctcatagcaccggccatggttggactactcgagaaaaggttgttaacggataattcctcgcgaacgtcgttggcttgatcacccgacatgattgcaaacggacatccggatatgctataagttgggtatgtgagtcatgctggccacatgagatgcacatgtaataaaccaactctagcacctccattggtgttcgagagataattctactcgctggttcttgaaccagtaaaccgtagcaatctctcgcaccgcaacttccattggtgttcgagagataattctactcgctggttctcgaaccagtaaaccgtagcaatctcacgcaccgcaacctccattggtgttcgagagataattctactcgctcgctggttctcgaaccagtaaaccgtagcaatctctcgcaccgcaacttccattggtgttcgagagataatcctacgagctggttctcgaaccagtaaatcatagcaatctctcgcaccacaacatccattagtattcgagagattattctacccgctggttctcgaactagtaaatcgtagcaatctctcgcaccgcaatttccattggcgttcgagagacaattctactcgctggttcttgaaccagtaaatcgtagcgatctctcgcgccttaacttctgatggtcaaggtaccactacggcaatagcgtagcggtcctcgcaccacgacttcagacgacttcagatggtggaggaacagctatgattggtcttcgaccggcagcgtagcggtcctcgtaccacgactccaaatggtcgagagacacctactcactggttctcaaccagtcaatcgtagcgatctctcgtacatttacttcaagtggtcgagttacgactactacctggtcttcgaccagagatgtagcgattctcccactatttccactttaagtgatcgagttacgactactacctggtcctcgaccagcggtgtagcgattctcccactacttccactttaggtggtcgagttaaggctacacttggttctccaccagcggtgtagcgattctcccactagttccacttcaagtggtcgagttatgactaccatccggtcctcaaccagtggtgtagctattctcccactacctttactttaagtggtcgagttggggctacaactggttttcgaccagcggtgtagcgatcctcccattatgtctactccaaaaaagttgatatcaggtacacaatatcgccaagtgttttacccagagatcccttaccacggcgacacctagagttgaaaccaatcctactgtccctttacgccgttctgacaaggcctctaaggaacctaagggaacttcgactggggacgcccagagtggataaggccttgtcggatcatgtagagacaaacgaccatgtaagacctggtcatgtaagagttctcgccgtgcgtattaaccaagccatgtaatccgaaattgagttttccaactagacggctgggggctagggtcagtgcctttttgaaccaaggcaggtcaagggtccaagagccttatcctccgagaacaattctccgacgacaaggctgggagctaggaagagtgtatgactcaacaaactgactgatcaaagtcggtaaaagagaaaacgctcgtacacaaaacattggtctgtaaatttaattcatttttagttttccaaacatattataacatgtcaccctttgagcattcgctcgggggctatttctatttaatattcttttctaagtattgatttccggaaaattctattcgacattgttgaagactcgatgtctctatggttctacaccacaatcgactaaggcgagtacgaaaaatgttgacaagcctccgtcgcagattctgcgccttctccatcactcgagaacggttagtggatatcgacaaggaatacggaatgaagaaatggtgtactcgccgagacaaagtttcttggtttcaatccaaattctctattacagtaagacgggagacttagtcgtatgctctgtgctttcttggttaacgtcggagattgactcagacaaaccctataggtgcccgcacgaggctgataagggaagtctaatgttatctctgaactcaccgagaacggtcacgtgagctcgataacagttactccatggtctgtagttgagaatatgaatttgttcatttgcattgaagtcgggggctactgtcagggttatggataccacatacctaatagtagttgactaaatctcagcaggacccaccacataccatgtcttatacagaaactgacttcggatatggatggagttccggataaggaaagacaaccagagttctacatgtaaacgacaaggactactcagattgtatccatattggtttccctagttctacttagacaaagggacaactatgggtataaatacaatgtcccctaggaggagagggaagacaatcaacatacacggacatacacggaacaatagatcaagacacgagatcaacatacaagccaacatacgccaagacaagccgccggatatcgacttcagagataggcatggctagtcccctacggtgtctccggatactgtcaggagagacatagcgctatctctgatctcgctaggcacggattcgaggagaaagagtaccctgttgtcgactacaagtcggaccttctgaccgccatgtcgacaacagttagataggctaccccaaatattgtactggtgtgattatggtgaataagagcaacaaccggcttcagccaacaggatatagggctattacctgacaattcaggggcctgaacctgtatgaaaatccctgtatccatctcttttacctcagtctcgcatatatcctagtatcaacgaacccatactatacaaataccggaatcgcgacatcaaacgtcgacacactgctcgaccattggtgcgtatcccgcgcagcctaagcagtgaggaaatctgttcttcttagccaactctgaaaactttttgctcctttcaattccttccggggagttcttcagcgtcacagagtcgacccactactttggggttatgttggcatacgtcgaaaactgtgtatggcccgtcttcacgaatttcttgttcaaggtatttttccaaccacgccaggagttgtccattgtttgcagtgcacaattcctcactgctgcctctgatccatccgggaactggaagattttcttcaactctttctataggacttccttatccccatccgatatatgaccccagtccttgaccgtgatgggatcttttcccttactattatgccacaccgtgaactaaatttcgcacgtgcattcttaggggcgagcggctctccttttggcccaacattggtaacaacatgaaacccttcgtcctttctatccacgcttatcttgccctttttttcttcgcctttgctgccggttcgcttttctttgagcaggtggtcttagctgggacctcgtcgtctttcgacttatcttttttctttggctgccgttttgatcgccgtggcgccctttcctacgagaaggtatatatcaaagtttcgaattagctcgggctaatagttatcagtcgaacagtttacatattaagtgtacttaccccttctttagggggaatgtagtccttgtcgcctttttcaccctcgccctttttccttctcttcgggcttggacaaggatcacttggcgacgagtactcatcatcctcgtcagctatgtcgctgtcggaactatctgtcggctggaccgttggttccggagcaaccacaataggaagggacggctcttcctcccctaaacccttctcttcagtccctttagtaccattggccatcgtttcgtacttctaacataaaaaacaaactgtatattaacaatatgtcatatgaacaaatttaaattctctgagattgccatatattaacactctacggaaatagtttaaaaaattgataagtagtgtactatgacataacttatcatatgttatattaaaaacttgtgtacatagttgcaaaatgtaataataaaaacttgtgtacataattgcaaaatgttataaattagtacaaactaatttgctaaattagtacaaacaaatttgttcaaaatttgatatgttattattaagtagtgcactaattcacaattacatttcatcgacatgttgtttaaaaagaaattaaaaaggcgaccatatcctccacatgttataaaaaaaaaattgaacatatcctcccacatgttattaaaaaaaattgacaaattcacatatcctgcaaaattgaacataccctcccaatttcattcacatatcacccacattcccaaattcacattgacaatcaacatataacccctcattcacatatcacccacccctcgttcccattcacacccacatgcacacacacatatatagcccctcacagccacatgcacacacatataaaaagaaacacccacatgcacacacgtccgtggacaatgaacggccgacgacgaggttcggtcgtggacgacgacggaagggccgacgacgaggttcggccgtggacgccgactggccgaagacgtcgttcggctgaggatgacttcgctcgtggacgacgaccggccgaagaagccgttcggccgagatcgcgactgcgagagagagagagagagagaggtggcgccggcagtggtggagcggctggcggcgaagtgcgggcggcggtggagccggcccccgcgggggtggatctcgcgcgtggtgagcggccggcggtggagcggtggcgcggagctcgacagccgacggggtggagctcgacagccggcggtggagctcggcggccggcgcggagctcgactgtcagcggcaaggacctccacggttggcggcggcggacgacgacggtctgcggcggcggaggatggcggtcgccggcagtggatgacgacggtctgagggcgatggttgcaggcaggcggcggagaaaaaatttggcaccctgatggcgccaaaatttctagggttcccgcctggacatagaaattttggcgccgcgggcttgcccttatatagggaaacgatcttcgcgggcggacggtccgcctgcgatgatgtaaaccctactcggcacaataatctttgcaggcgcaccgcccgcctgcgaagattgttacagagctgactatatttatttgaaaatgttttctaatttatttttgtaatttgaaaatgtctacaatagttgtaataaaaatggtaattgtacatacaagtatacaaaccttaatattagtactattcaaatgtaaatcttacttaaatgtttgaaacattaatattactacttttaattttttaaatagttttcaaacaatggtaagtgcacataaaaaattgctacaaaattttgaaacctcttttaaataaacttttaaaatataaaaaaactgtaaattttaccctacaaatggtaattgtacataaaaattagtacaaactaatatgcaaaatgttaagtacaattgttcgtcaatttgcaatatgagcacacatatccccttacataccatcattacataactaagaacatcttagatgcttacgtgccactcaacaatcattaccctttaacatttttgcccacaccgtccgtgcgcatgtaaggtttcatggtcttctgagtacatacctcaacatgcttgatcttttgtacaaactgattacaaagtggcatactatcgtattaattgtaattttcgatatcttcgaccccatccactcccaatatcttttgttttcctggtagcactatcgttttcttcaaatttgaagggtctttctcataaaacacttgtgccatgcgattggtgagtacccaagggtcatccttgtgacccacactcgtaaggtcaacaacagtaagaccaaacatatcaacattgaccccgttcggttattttacccactggcacttaaatatggggaattgcattgtgtgtccatagtcgatttcctatatttcttcagcaaacccgaagtatgattgtttttcccccgcttcatcaattgcctccacacggatactgctattttgcgtacaggtcttactatctcgggctcttgtactaaacgagtatccattaatgccatatccctcccaagaatttactgtagttgatggaccacaagccaaccgcttcatagttatttcatcggtagtttgtccctcaggtaagtctaggtctcgcaaccaatctatgaagagacgcttgtgttctttcattatccactcggttgtgcgacccttattgttagctcatagtagttcgatatgttgatcaatgtaaggctcaacgatagcaaactgatgaagcacgctgaagtgagcttcttgaaatgatttgtgatcatgggtgacgaatatcttctttcctatggttcccctgccactcaatctgccctcgtgtcggggcacaggtactccaattttatttccatctttgaggtaatcgatacagcactcgacaacctcttcagtactataaccctcaaccattgatccctctggatgtgcacgatttcgggcgtaacccttcaaaaccgccatgtaacactcgtatgaccacatttgatggaggtacaatgggccaagcgcaaccatctgcgacactatgtgaataatgaggtgctccatcgtatcaaaaaatgatggagggaaacacatctcaagttggcactgtgtctcatgtgcgaatgtacagagatttgctaactcttcatgactaatgaccttctgtgacactgcgttgaaaaagtagcaaaaccttgtgatagcaacatttaaaagttccggttttatggcccttattgtaattgcaagaaacacggtgagcaagacatgacagtcgtgtgaattataaccagataccgacaaatcttttatggaaactagtcgactgatgttcgatgagaaacctatgggcactctgacatcacggagtgatttgcaaaatgacttcttctcctcaggtgtcattgtgaaacaggctggtggaagatatactttgccattgttctctccttcttgagggtgtaactcttccctgattcccatctcgactaggtcaattcgtgactgaagaccatctttagtcttcttcggcatgtccaacaatgttccaactatgttgtcaaacacattcttctctagatgcatgatgtctatggcatgccgaacctccagatctttccagtacgggaggtacttaaagaatatggaatgcttcttgaatgggagagggagtttatcatctagcttcatactatcatctagcttctttctatcctctggtttcttagtcttctcgggtttcttgcgctttgtcccctttgatggtttcttactaacttttccaaattcacaaatcattttctctgtcattgcaaccactttttcccctgatgtaggttttttgtgtaggatcactctcttcggtgccatcgaactccgccttcatcttgcggtacttgtgatttgtgcgtaggaaccgccggtgccacatgtacaaaagcttgttggaacccgggagatacttatagtacgttccattcaagcagatcacacatcctgtttttacctttaatttgacctgaaactgaaaacattgctggataatcgttaatggtcacgaagatgatggccttcactgtgaagtattctcttaagtactcgtcccacattttcaatccctctttccataaatcagccatatcttccaacaatggttcaagaaatacgtcaatatcaataccaggctgacggggtccctgtatgaggatacagagtaatacgtattttcgcttttgacaaagccacgtaggaagattatacatggtgagaagcactggccatgtactatgtgagctgctcatttctccaaaaggactaactccatcagcactcagggcaaacctaatattccgtcggtctttagcaaactctctatactgagcatcaaagtttatccactgacaagcatctgccaggtctcgaatcatcccatccttcttgcgcccttcttgatgccaacgcattagttccacatctcgcggatttgagtatatccatttaattcgttctttgacaggaaggtaccacatcacaagctgcgggatttttctctgagttccctcagttgtatcagacggttctaggccagtattgctattcgatttgtaatggctagcaccgcatgttggacattcatctaaagaagcgtattctttcctgtacagtatgtagtgattaacgcacgcatgaatcttttccacaccaagtgaaaggggacatctgagtttcttcgcttggtatatgctagatggtagtgagttaggcctcaggagcattttctgcagaagttctagaagattgtcgaaactactatcagttcaagaactgaccgtaatgttgtgaactcactgtcatagccctttgattcatcgtacaaaacttccttagctgccttctgtaaagcttcaaagttatttaaacctataaccgaacccattagcacctcgggttctggatgacataacatttcatctagatcgattttgtcctcacctgaaccatcgtcatgcaccatgtcttcaacttgtgtcggaactacattttcaggcccgtccacttgttctttgccatggtgtgtccatatttcgtacttttccataaatccacgagttactaactgctccatcactttagaagcatcttcccaggctatttcattcttacagtcagcacaaggacaaattatcttcctcatattgttcttttcagcgtgtgccttcgcaataccagtaaatttagacacttcatccctatatggagacaaaaacctcggccaatgatacatctattgccgcctttccctatctctaaaaaaattaacataaaagatttgcactattagtaccaaatttgtagggtttactaaaaaaacatatcgctattcaaaactaactgaaggtgaattataaattcgtaaaaaacacaaagtttatttcaattttttttacacagacatgccaaattagtatattaggaaaatctaacaaaaccataccatcggcatattacaaataatacaattatttttttgattaaaccaaataaatagacattaaaaattttgttctctctcatatatatatgtctacatctagatctagatctaggaggtggatgtgatagcaaaataaaaaaaaaagagaatttatgttactacattaaaccactacaacaaaaggcatcaagtattacacatacatctaacatcaacatatcaaaagaaagtaaataaaaaaatggagcttttccttcactattttgcatgcatagatccatcacaaattgaggtctaaaagcttaaaaaattgcatacctagtgtggaaaagagtagatctaagcaccgaagaaaaatcccctgaagatttgaagttcaaaagctccccctatatttaagtcactttaggagagagaaacttcgggagaatgaacagggctcagaaaggaagaagactatataggggcattatt

SEQ ID NO: 12595 - DNA, 21696 bp, Oryza sativa
accgtcccctcctccccgggtatcgtctttgccggcggggttttgcctccgaaggccatgcccgtctgcgaaagtggaacccctacgtcgtagataatgtgttttctagtagtgagggttcatagggtgcacatgccttgattacaagaacgggagatacgttcctttagaagaaatccaactacggtcatatggtttggcttattcagggaatatgtcaaatggtgtttttgcaaatgaaaaataattttttgaagaaaacttttatatacgtgtccttaacgacctaaaagtaaaggttgaaaaataaatttcgatcaaaataccccaaaatcaatataaagttaaaaattgaaatttttgttgctaaccataagcataagcgaaaagatgagacttcaagcataaaaataaaataaaatttaatgttaggtttaatgtaactaatctggtgttataagaattgctacatctccctataattttgatcaaatatataagagtttaactcagagaaaaaactcaaaacatattataagacataaaatgaatcggtattgtaatcatcaaaaggaaaaagtaaggtgatatgattttataagagaagaaaaggagggagataattttgaccgtagatctattatctatgggttaaaaacaattaaggcgatgtagcttaacgagagaagagagaaaaatcgtttaactacttagtgcggataaactttatggatatacagaataggatttgctatgttttgctatgtgatagtcaaacatggtgtttggtgaaggacgaggagagctacaaattggacgtccgatgttgtaaaaacatcggatggtcaaatgtttcagttgaccattggtgcaacattaagttatacatgatgaaaacaaaaaaaactctgaaacatacataaattttgtgaaatacaatgagaacacattgtgaaacgtatcgttatcacgtatgaaacattaagtttttattgtttgaaacatatatttttctttcatcataatataatcattgatatcttgttgcaaagattcaataataacgaaatcaaccgcggggcggggaggggggggtgagcgtcccatactttttcggttatacgtggtgaaatagaaaaatatgttattgaaacatttaatttttttatgaaacataaagaaaacccatgttgaaaatattgctaccgcatctgaaacatttaattttaacagattgaaacatatgtttttctttcatcggaatgtaatgatgtgatatcttgttgtaaatatttaattataacaaatataatggtgtgatcatatcatagattggataagtagttcaaaagaaaaattattttgaagatcattatagcatttatggatgtgtatagtggatagggaggaagtaatttgcctgtccgattttttctgcgtcatacgtatgataccaagcatttccggtgaaggacacacgaaaaatgtaattacgcccatggattcccaaaaaatgtcattctttgccacagaactccacctataatactttgtcatatgagttttatttttactcctcatccctttttttatagtagaaatgaaaattatggggagttcatgtggaattaaattttagggttgatttgatccatgccattgcaaaagtgagtcattgtatttcgtctatttgtaatcgtgccactcaaattttacaaaattcgaaccatgcaatcgtcgtcatgttttccatcttcttccccatctgcacgtggggcacacccatcatattcatcttcttcctccatcctcccctcttctctttgtttctctctccaccacttcttagtctccacccgaccaatccatcccgacaccctctgcaccgcggagtacgcctgcgccctcaccaccacgggagtccacgcctaagccctcaccgccgcaggagaccacgcctcacacctccgacccccgttgcctactcaatcgttctaagaactactcgatgcttgctgcatggcggtggcggcgagttcgacctgcgcggctgggagaagcaccagtgattgcgcagcgacgacacactcgcctacttaaccgacaacgtgttgcagcgaggtacactaagcttgctctgccgttggcggtctgttgctgcgggcggcagggagggagttgggatggatgtacgtgtaacgtgcagatggggaaggaaatgaaaaacatgatgcgatggcatagtcccaattttataaaatttgagtgacatggttaggaatagacgaattgtaatgacatttacctaaatatgcacatttgcaatggcacagatcaaattaaccctaaaatttaagtgatgatgtacgactgaatttatctcatcgtacttaaaatgggaattccctcccaatacctacccttacacatgtattgaaaaaggtgggagctgctcttaaactctcaatcccaatccctcataaaactcccacatccatcaaccaaaacaatagactaaacaacctccacccttcaaactcccatcccctcttaacaattccaaatgcactgatcttgtaaaatactcaaacgagtcacttatctttttttaatcacataaaacatgtgtcatgtgaggagttctctattaaggttgatgccatgttgatttatttggtaaacatggccacacacaatcctggattgtcaatccacaaataagccaactgcaatatgattatagtaaaatccaattttaagatgaattatattattgcttgctaagtttctcgaaagcacccaaatagcagctagcattgatgaaaatatggtggtaatttgtaattcttttacttccctaaaaacatataagcttatcctgcccatatggctcacaatgcattatatttggctggtatggctgtcaattcgaaacaaaacaatagatgtgatatgtattttataagatttgcaccggcgaaatgagatgagtgacttaactgagcaatttgtaaaataagtaactaaattgcacccgcctcgcaatgagtaatgacaagtttatcttatgtatcgttctgcctaaacaatgtcgtgtcacctgtctcataaatcattttgggttattcagattgatgtcattttcaaaccatactattttttttaagttgctaaatatatacatccatttagttattaccaaactctaataaatacataacaaatcttgccaaaatttgacaatattactaattgccaaatttttggtattaccaaaattataaggtttatttttgctacaacctaaacaaactcttttaactgtaaccatgaaaaagtggcggtgctaatggctaccacaacggtactgaatggatgaggggggggccttaatgggcgattgatcgccaggcgatcgcccaggcgatcggatccggcccccctcctcctatactcctccctcctctcccctattcctcctccccttctcctctttctactacagtagactacacaaatttttttgaaaaataaaagttagaaaaatttatgtatagaaatactatatataaaaaatttgaattcaaattcaaatttgaatcgggtatgtaaacttttgacttataaactttgggtctataaactttaggtgtataaagtttagatgtatagaaatactatatatagaaaatatttgaattcaaattcaaatttgaatcaaatattattcaaattcaaatttgaatcgggtatataaactttaggtctataaactttaggtgtataaactttagatgtatagaaatactatatatgaaaaatatttgaattcaaattcaaatttgaatcgggtatataaacttttgacttataaactttaggtctataaactttaggtctataaactttaggggtataaactttagatgtatagaaatactatatatataaaaatatttgaattcaaattcaaatttgaatcggatatataaacttttgacttataaatttttggtctctaaactttagatgtgtaaactttaggtgtataaattgactaaaatagaaaagtaacgcggtgccaaaaaaggaaacaaggtggaaaggtggagggagggaagggggggtgccagggcgatcgctcgtcaagtagcattcccgatggatgagcacgctgcgtcctaggggcaatctggttattttgtattttttttctccctcttgaattacctagctagaaatgataaaatatttttggtggtgtctatagaaaaaccacatcgtttaggtgtgtatgtgtgtatggacgaagccatatttttaaggggtgtttaaatctaggggtgtaaaattttagcgtgtcacataagatataatatagggtgttcctaatttaaaaaggctgcatatatctggtttgatgtagaggccggataaaaatatctttctcaaagaaaaaaaaccaacgaccttatgttacgatccatcttccttacaaagttgtcccaatgggggctttttgcaacatgtgtttcctacgaaattatacttgtttgtcaaattagggtctgtttagttcgcgaaaagaaaatttttaagagtcacatcggatatttgaacggatgttgaaaggggttttggacacgaatgaaaaaactaatttcataactcgtctggaaaccgcgagacgaatcttttgagtctaattaatccgtcattagcacatatgggttactgtagcacttatgactaatcatggactaattagactcaaaagattcgtcttgcgattatctcttaactgtgcaattagtttttttatactatatttaatgctctatacatgtgtccaaagatttgatgtgatgtttttgggaaaaaaattttgagaactaaccaggccttaatccatagaagaatctatggattaatagcaccgggcatgaaaacggtgcatttacgcactcatgtgactgctgcaacggacaataatcaaaatgaatgaaaaaaaaatgaacgataaggagtttactaacaggactataattcgacaagctggtgtgcttattcttgtccgtattgtcattgacttgtcaacaactagttattgtacatgcatcctatgaccacttagattattgcaacaagtacttgtcaggcccagcttgcgcctgtaatgtccggaatctcgataaatttatcccgtatatagcgcccctacgtcggccggcccgacgactgtaatatacagtcagtcaatggtttcaccaataacaatgtatggtatactgacgtttcccgggaaaaataaggctgatgcaacggagggtaaaagggtcccaagcgtgcccacagccacaggaaactaagagcatcccaacagcattccaaaatttcatccccaaaattttgttttccaaaatcctaaaagaaatttaaggtgtgaaaataatcatctctccaagagatgacctataactaattctctataactgaaaagtggaccctataaaagctaccaacaaaaatctgtttcctccctcctcccgcaagtgatcatgcagcctcgacgcttactgtcaccacgatcgcattcacctcccatcccacaatgttgctctccccccgccacgatgtacttctgcatattttggcctgcagtgtttgtaaactaccatctaaatttgtacttgtaagaaaatttctcagtacaaaatcaacaatcagattagtacaacatccgcatttcaacgcgatcaacccaacaacatttcagtagaaaattatctcagtccaatatagcagcaagcaaaccaacgtaaccagtaagcagcagcagccagccattacgagcaatggctgcttctaggatcagcatcagttcaacagcggcagaagcagcaagcagcagctgtagaccacacgggtggagaaagcgtttgtagtcccggttcgtaacccctttagtcccggtttccaaaccggcagtaccaatccgggactaaagatcgctatctttagtcccgggtgcaataaccgggattaaagatcgagctgacctttttttttttttcatggccctgttgctgcatggttatatatatatatatatatatatatatatatatatatatgaccaaaatatatatttacattaaagaaaatgtgtacacatgcatatagaaaaatagacatgtattaattacaatccattatgtcctagctagctacgatttcgacgtagtagtagtcgctatttcagaagctaaggacctatgaattgtatttctgtcgtagtagaattcacccttgggatcaaggatttgttcgttgatgaatcccatgagttattcttgaatcgccgcgataaattccttgtgtgtgatcaggttatccctcatgcgaataaactatatgaatgtatgaaattaattagtaattaaacaacaagtcgatatgtaatgaaattttgaatttatttgtacgtacatcgagctctcttgtggtgatgatttggtctgcaaggcagtggcaatactcgcacacgtagtagccgcacaagttagttccctgcttttgctttgcgcactataaataaatgacaaacggcgagagatgtaattaatatacaattgtatgtatttgaatcggagattcaatataaatgtagagcatgtgtactcacaggaaaattgaacttcggcctaagtctttctctccatttgccgcggaccaaatgacagaaccgataccaagccctacatggagtttaaagctatgattcgtagtagcaattaattataacaagattcttaattaacataggaacttatgacagtacctatctataagttcgaaaacattgtcaaacgtagactcttttttatccattgagtcatatacgttgacggtgcaggcctccaggttgaagagtaaaagcacccagtggaatttgcaatgtgcgtgggatgcattacatatgaaacacttagcatgttcgtacgggaataaaatttggtataggaagacagtaaaattaaactaactctgagttgtacggcaatagtatgaacgtccctccgttcatactcagaagaatctccctccgttcacggaatatggacatatatcgcagcctgactgggatacgtttgttgcagatcatacaacagctgaagcattggctttgaggaaaaaaatgtccgagctcgcgaagaaaaatagatatccccatagattggggtcaagtggatacgctgggcacgtcgatcaatggcgggagaccgagcaaagatttgcagcggccggcaaaccactactggtagaccccatggtggaacgtagtaagaactgggtttgggcgcgcagcacaggtcaagtctcggatgagggagacatactattcgagactccggacatagaacaagtgactactaatttgcagcagatcgtcgagaaagaaagagcaggacagtttgtcccacggagggagcgagaccagcttactgtggcgttggggaccgccgaacactctggacgtgtaaggggtttgtcctcaaagccaagttggaagataggctttccacatgacgcaccaagttataagaagagagacaaatacaaagaacaactatcatacaaaatctatgcgcaagtgaaggaacacttctactcgttggtagctaaaaacccgacagcctttccaaggttattccctgatggccagcaacccacacaatccacacagcaaacaactaatgcacccagtagtgtaggatcagtggagacaactcccttccctatggatggtataactggaccaactccgtgcagtctcgtcgtacctatcggccgcgctagaaagactaaggaggttgcaactggtttagcgatacccggatgtcaattacacaacacggtaatccctgaggattacgcaagggtacaggtcgccaaggtccatagagaccacatttccttggaactagacatacctgcacctgagaggattgaacttctcggtgatgcagtgaatcagtttatgttgtggcaccgcagagacataatcctgaccgcggccgttccagcagcaggatcttcaactccatcctcatcacaagcaaggacagttgccgcttctgcttcaccgtcgcctcctggaccaccatcacctccaaatctggcatcaccactaccgtttaggtcaccggcttgccaacctacaccaccaccgcttaggtcatcggcttaccaacctacaccaccaccctcccattctcaacagcctgctctcccggctccacaaccagttcaagcctctcccacctccccagctcaacagcatgctcccccgactccgcccttagttcaagcatctccacctacaccccaatctgctctggtagaacaagtgcacataccggaaggtactacatccgaaccgaagtctaatcctttggaacctcgtcgtataattccaaagttgatatcgacatatgacccaaaggagattgacaaggataaggagaagttcatgtttcagctttcaggaattctgagaagagaaaagaacttgctcacgtcatgtcagactcccagaagtcagtactagcagcccaagatgaattgcaatcatggttatctgccgatgtgcctgaaacttatgagtatggcaagccattcttgccaacatatcttatgaacaatctaccctgggaaatgagggcaatgcacgaatggtatatcaaggcatataggaagggtctcggtttcataagcatcgccgtcccggaaggtgctttcatgagttgagtggtcctaatgggatattttttttatctctttccgagacctttacgccctctacaagctagataaaatggacgttaatctcgttgcggcattctgtctgtaagtctgaactctttattacatgttacacgtatcattccaaacaaagaaaccaaatctcattacttctttgttcattatacagtatgcaattcatgaagctgatagaactggatcaccggttggatacatcgatccaacaagaatatgcaaaagacaacacaccgtagagctgagagaggactacgagcaaattggttggcaagacccctcaagaaaaggaagaatatgtgaagcaattgcacaacaggaagaagctagaagtagcaacatacttagcaatagcaatgttggcgcacgccgacaaagatgtcttaatggtcccctacgcgttgacgtaagctttatcttctttttgtttaattaatttatcttcttcggaattttctgtctccaataagcctatcttatatgcagagaccactacatattattccttgtatatccaaaaaaccaattgatcatatcgttggaccccacacaatatgaaaaggagacctttatggaattcctcactattttgaatttgtaagtgataaacatttcattaatataaattgtttaggtcgatccctagtcttcttgctactgataaaataattgttttcttcaaatagagcacacaagtactaccgcaaaagaggcggacccagtacatattccatcccagaagcagttacccatcatgactggctggccggtactatcaaatctataccaatagaactaattatcgaacaatacatactaatttatatctactgagatcagtccctcataattatatcgcagcgttacaaacaaccaccaggaaccaacttgtgcggttattacgtgtgcgcgatgctcagagtaaacgggaggtacaaaacaaccagtaaccaagtaagttagcgaactcttctctacaaagaaacccatctagcacacgcttctcactgagtaccattctattttcctttctgtgcgcagatccccgaaatcccatatattgcacaacaaatcaacaacggtactacctggaacgtgggcgctgacctctgccgattcctccgtcgtgatgtctgcaacgcaagaggtctcttctacgacaacaagaatgaactcgcaatgaacgacaaatttaaacctctcagagagtgggagaaagaacatatgcaatgacatgtacactacttatacatatgatgaaaaaactgtgacacttgtattatatatttcgtatgtaaattacgattgaatttatggttatgtatcataaactgtaataacaacaacccgactatctcgtatgcttactattccgaaatacgataataaatcctcaataatttaatattaattaccagacacatctcaccaaaaggctagaataaatattattttagctattcggaaattgaacttcgcatgcggtctacttaagacggccgcatgcgaaaatagatctttgcatgcggtcttgttaagtcgatcgcatgggaaaatagatcttcgcatgtggctgcttaaatgggccgcttcgcatgcggccgtcttaggtgaccgcatgcgaagatcgatcttcgcatgcggctggacgcaaatgatgatctttgcagaccatttcgcgcatgcgggccggccgaccacatacgaagatcatgttcttctgtatgcaaaaacccattctgtagtagatgataggtgatgtcgcaaaagtgatggactgatggcgtccccaactacgcatgatggacgcgattgtggggccggagcctgatgaatcgccctcgacgggatgaattggcagaatcacataagtgagagcgtcctcgtctatgcgtgatgcacaagattgtggcgccatgcatcaacatgaggatgtttggccggacggggtttgggttgttcacgacacgtcctgatgcctgaaggcacggtgcggttccgcagcttcccatcttgctccttcacagcgaacggttagatttatttcgataccgtctggtaccagtaccacgaggagaaacgctagggtcttctagctaactccactagatggtgggttagcctgcctagctagttcgaagcggcactccttttaattatttgatattagatcattttttaatatttgtgtttttacaagtaccgcgaggtacaacctcatggacaggaacaacgcttttttgcaacatatattttatacgaaatctatgctttctgtaaagttaaagcacactaaatctaaagcttaatatacaaccatgccacatcatcacccactagcaataattatatatttaatctcatacaagcatacaaatgatctacaatttatttaattatacaaatcaaaatacaagcatccaaccatcatccgtctccgtcatacatttgcacaatatttcaacaaatctatctattacttttacaatatttaacatatacttatcaatatgtttcacactaaagcacgagtattatttgactgataaaccctaatgttttgttttttttcttcgtaatcctagtttgattgtaaaaaaaacatattgagaatttcttagtaaattttacaacaaagcacgggaaagcgtgaggaatcacctagttatactatagttatactagtttcattgtttgtcgaaccacagtgaagaagaatctattgattaatagcaccgggcttgaaatcggtgcatttatacgcactcatgtgactgctgcaagcctgcaacggacaataattaaaatgaatgaaaaaaacgaacggtacggagtttacttactgttactggattataacaagctggtctgacattgcgcttattcttctccgtatcgtcattgactttgtctacaactagttattgtacttgcatcctataaccacttactccggagcaagattattgcaacaagtacttgtcaggcccaacttgcctttgtaatgtccagaatcttgataaatttattccgtatatatagcgcccctacgccggccggcccggcgactgtatattaatatacagtcagtcaatggtttcaccaatacatactgacgtttcccaaggaaaagaaggctgacgaaacggagggtaaaagggtcccaagcgtgcccacagcgacaggaaactaaagcgaaacggaaagtaaaagggtccgagacggccaaaacgacatatttacaaacggaaaataatttgtgaataaaacttttatatacatgttcttagcgatgtaaaagcaaatgttaaaaataaactttgataaaagaaccccaaaatcaactttaaatttaaaattaaaaatttaaattttagctaataagtataagcgaaaagatgagaccatataccgtagcgcatctattcatctaagccgtttggggcaaccggactcactatttggtttttattcgtgtagctgatccttccgtcccaaaatacaagaaatttttagtactccctccgtcctaaaatataagagattttggaaagacgtgacagattttggagagacgtgacactttctagaaccatgaatctaaaatatgtcacaaatcttcaaaatccttatattataggatggatggagtatattccatcagcagtacatacacataccgcacatgattcgaacgaattataactcctacggtgcaataatatattgtaatggttgtatatagtgttagtatatagtagggtgtgaaaaaccgccggtaaccgcgcggttaccgcggttaccgcccgtaccgcgggggtacggttacccgtaccgcacggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttaaaaattggaaaaagaaaaaaaaataggccggcccgttactgtgcaacccattacacatcgcgcggtaaccgcgccaaaccgcgtggttaccgcgtcaaaccgcgcggtaaccgcgccaaaccgcgcggtttgcccgaatttttgaattcaaatttcgatttgaaaatttgtcgcggttttgcgcggttaccgcggttaccgccggtaaccgccgtaccgccgggtggcggtaaccgggcccccagcggtttttgaaaccctggtatatagaaggacgcgcggcgccacgccgcgcacagctgaacccacaagcatggcttaatcaaagcaactattaaaaacacattagctattattgaccaaatattaatttatagttccatttagcttaaaaactactccctccatatatattgacgtcgttgacttttcaaccaacgtttgaccattcattttattcaaattttttgtgcaaatatgaaaatatttatgtcatgcataaagaacatttgatgacaaatcaagtcacaataaaataaatgatcgttatataaattttttgaataagatgaatggtcaaacgttagacaaaaagtcaacggcgtcatacattaaaatatggaggtagtatatcatagtacaagcggcttatacactcaaaatatccgtagtttgttgtttgttaacaaagcggctttataattaaacagtgggtgatcgaacaacatgagcctaagaaaaacaagatcgatagagtaacatttttggtgtgaccaatgtttcggatacatacaggaatagaaccactctgtctcttttacatttatcatagcatgattgctcatggaacaacaaattactgattctaaaatctgaaagtagcagaaaaaagctacaaaactacagtcagtacatagacatgaaccagcacaaaataacttagttcgagaattagtacgaaatccaaagaacacaatagctcacacctgtgcaagcacaaatcctttcaaatctctaaaccgaatgccatcagagcaccccccaaagtcccttacatggagcaccttttttgctgcaagtaaaaaggcacaacattaattaacttatgtatgcaaccaatcatgaaaagcatactttaatgttgacctggctatgtacatgtgcacatagtaatctaattttaattagttccatgaggataaccatatcattacaatatcccatgaacaaacttagaagtttctgatgtaggagctagaaagaatgataaaacactggagtttggacgatatgggcatctagggaccagttctctgtaaaccagatatgcatacaatgggctacatggcacataaacaatttgacattagtctagcaaatccaagagcatactcacttctgtgtatatccaagggtaccgatttactgaatatgcaaacacaaaaattgtagaggtcaaatgtgtacgctaaattgagttccagaaaattgaaaattttaactgtacaggaagaaattaatcgacaacccaaaaaaaaaaaccttggttacaatatatttcgctattaagctgcataagaaaagctacagagcactgataataatgcatctggacatttatcaaccatatgttatagagatttaaccaataaatcaagaacacgcatggtgctttcagatcaaacaaacagaatcacaagcaaacatagccaaatagatgccgtctgatttgcctgtgcaatttgtgttaagcagacatttgaccactccatgaacagtttgtgtagttagtcacctgaaatgcaaaacatgcaaacaaaacacatctccatccattttgaactgttccttccaagttgcagaagtgaaagaaaaagggtatcaaattggggaagcgattgtttgcatagagtaccaatcaggagcaagaaaccggttctgttttttacagagtaccatcaaaatgtacaaaaacaaaattgaaggagcatagtctaaatcacctgttccactaagtgctcgtcctactgaaaacatgtaaatacaacatgtcagatagttttaataacaggtagcagtactaagtacgtagattttaaaaaaagtattataagtacttgtgcttccctctcatggaagcattttatgtttacgatctttcatcttctggaaatgaacaatataaaataatattgtttggggttgtatctagatagggtgactcaacaaaacaaatgacaatcattcatgaacttgttactaatacggttacgtagtaccttcttcacaattttcattgctaaagaacccctctcgcctgacacggtggcagcagttagtttcatactacctctccaattggtgaaattaaattacaaatttactaaactaaagcaataggtacaaatatgtgcaaagtaaataatcaacactatttttttaagcagaaccaacattactggttccccctgaacttgacatacctgaagattgtaagatcaacaatcctaggcggcagcgggctagtacccagcgcccaacagcaaggttctgggattcggtccgaaagatccgaatttcggtgaatttcacccatttcaatgaggtccgagacaaagattcactcctatttcgcctaaatatggttcagttttaccaaaatttctcaaatttggtttaaatttgaccaaatttcatccgaattttccgaaattcgtccatttcggtggacgtactccgaattttttctgcaatcgaatcccaaaaccctgcccaacaggcacggcacaccaatgagcagaacaaccctcagcctcaaagactcgttgtatcaaaatctctacaaatcagaagcaccaaacctcagtaatcatgggagattgaaagagaactacttactggacatcttgataggaacgtaagaattttgtgtgcaaatcggatgagaaattgggaatttagttgtatagggcaaaagaaaactcacctgattgcttatctttcctcaacaaaacacccattgctgtgctgctgctgctgctgcctgatgtggggaaaacgcctagtgttcctcatggagacacctgtcggccgttctgcctcgcttatgtgctgctgctgttgctgcatcatgatatgaggaaggcaaagaagatagcatttgttttgttgggcttggtctgctatagttgcatgtctatgggcaagcgttagctcacgcctctgcccactgcacccaactgaatcgcaacctcttggttgctcctgtcctgcacagctgcatgtcgtcgctgagccgccagccacagtactggagagggagcttccacagccgttgcgcatctgatgacggtatgtagcggtgccggtggtgaaggaggaggtgggaggacgcgatgccgatggtgaaagcggaggtgggacccaacgcagtacgaggcgacgacgatatagtgcaacttttgcagcttgaagcgacaggggagactggactgggactctggggagttacctcatcgaagggctccgcctccatggttgcgccaccactgcctagggttctcccctccaaatcgacggcaggagtgaacgaaacagacgatttgagggcgataggggatatatgccatctaattcgtagacctttcagggcaagccactcaatacgcacttctttcagattttgcactgagatagcgaattcctttattccgtgccactccgtcgccgatccgtccgtccgtccccaacgccagcttttccgtcgtcttccccacctcgtcacgctcgtcaccggcgcccgcgtgggccaaactcttggagagttggagggactcgagctcggactccggcacggatgggaggaaccagttgtcttctaatcttgcgaagcagcagccgattaaatggcgaggaggggccagctgcagcagcccggcgggtacggaggagaatgcggcgacggcgacccggcggtcggcaccggtgacactcatactttcttcaggtaatcactaatcaggttcatagctgactcctccgagtgaaatagcaagcctacagagtttgtatgtgtcaagtctgcaggctggaacgtacgtaattgctccgtgcatgaatttatcataaaaatactactgattgtgcatagatctagcttgtgtgttaattgcagctcgctaatttcttccctagtttcttcgttctctctcatcgatcaattagttgcggaatgtgatttctttctacttcgttctgccttctgaggagcacgcttggtagtttatcaatgaaaacagtagattcctctatcagttttctcaatgcatttgtttgggaagattaacaattttttgctgattatggcatggaagagattagctctgcagttctgcctggtgctgaggtcgcacgtccgcggaatagatatggccttcgttcccgatgtggcccaggttcgcgaaggtggccgctcgccggctacgtcgaggtggaagacgctggaaatttcttcgccgagttgcccaactattctgcggtgtggagggcggccttggcgcctgcggctagccccgcctcgtgcgtctcggctcgcccgtttcgatcggctgctgctttgccagattacaagacgaatctgagcttgaggccctttagagcgtggctataggtgtccaaacgggcggcacggcccggcccggcatgggcacgggtccggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcatggcggcccgtgaaggcaggccggcagttgagctgcactggccgccaggccgccaggccgccagtgcacagtgttttttttaaaaaaaaagcaaaggaaatgtataaggaaaaaaaattaaaaatggaaataaaatgtttaaaaaaataatgatttactaatgttaaaaaatgaaaaaatggtatttaaaaaatggaaataaaagtttttaaaaaaagtaatgatttgctaatgttaaaaaaaagaaaaaatggtattttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcaaaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctgacgaactttctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaatttgtgaaatttttggacaattgcccaaacatgctcgttcagtactgaagacctgtcactgtttcttgggccaccacgtgactgaacaaaatcaaaaagtaaactactataaggtaaaacaacttttaacattaaatacgttgcattccaccgatgctctgcatcggtggcaaacttacgagctttcacaccggccgcattgcaaaacctcttccatgcagcaatccgtgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcgatctcttcgagccggtgtgtgtcaaaacacttccgctcgcggttccggaaaatccttccgaagctgtcccgcctgaaccggtacctcctcaacgacagccgtatgaaccggtacctcctccacagatggtggagttggagccgatccggaggtatcgtcaaaccccgacatgtagttggggtcgaaatcacccaaggtgaatgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgtgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccctgctttcggcctggcgcgtgcgccgctggcccgctttcagcctgacgggccgccggcgaaacgggccgtgccgtgccgcgggccgtgccgtgccgtgccgctacagtagccgtgccgtgccgtgccggcccgcgggctcggccagcggcccaagcacggcacggctactcgtcccgtgccggcacggcccgttactgtagcaggccgtgccgggccgtgcctgctacaggttcggccgtgccccgggccgcccgtttggcccggcccgtttggccacctctaagcgtggcccacgccggcgccggtgacgagcatgacgaggtggggaagacgacagaaaagctggcgttggggacggacggacggatcggcgacggagtggcacggaataaaggaattcgctatcttagtgacaaaatatgaaagaagtacatattgagtggcttgccctgaaaggcctacgaattggatggcaaataatgaaatggaaggagacgtcagcggtcagcccgaagcggcggcatcggcttcgtcgcggccacaggggctcggggacagaaaagaccatgtgtcaaaaaaatttacaataaagtttgacaattagtttttctcaagcgcatccatcacaactatggtcactctatatcattccacaaccctgatgatcccgatgcccgcaaaaaaaaagagaaagaatcaagtaaaacctaaacgaacccaattacacagtatctttttaagaccacaatagtcctccgctctagagaacggatccatagaaccactgaagaaacatcgcaagtctgatccatggtccgatcctaaaccaaatatgctcttaga

SEQ ID NO: 12596 - DNA, 17898 bp, Oryza sativa
ggcaaatgcaagtacgtacgtctgttggcaatgtcattagatatttatatttaaaaactcatatccaatttagttcaacttaaagagaaatatgtcatattaatcggggccacattttctaacttttgtgtcatttaagcaattataaaactataaaaaaataattatatatattttatcatcgtatataacttgataataattaaattagatctaataaaattaaaatgaacatatctttgagtaatattaaaaaaaattagaccccccattataacacaataaaaagtacacatcttataaacactcctaagatattatgttgttctcttaaatcggagaaaatacactcttaagatattacgtcgttctcttaaataagagaaaatcctaaaaattctgacatgacaacaaaacattcgaccatcagcttcgacttaaacatctgacacattattttagtttattagattaatcatttagaaaaaaaaacatcccaaacctcccttcctcccagcccgtgtatagcctgcgccattcttttctctctattttttatctccttatcaactgaatttaaaattttctatatggaaaaaaacacaaatgggcctccatctattacttatatcccattaggcgtttcacgactttctacccactaattaatttctcttaacatgcatatgagggctatgtatctatacaaattgaccttgatacttttaaaatgatctttttaggagataaataaatattcataagaaagattatcataacatcccaattacacatatgatatatgaagttactaatcataacaggtatttatctagcaatatagacaatagattgaaaataaatgtgtggccggttgaatatcataccagtaagcatatgggttgcacctaggaatcttaacaaccttgaggtggcctttacaataaatcaagtcaattctatataggaattaaagaccatgtcattttttttaatttctggtaaattttgctacaatatattataaaatcttgacatagaacaatctagaaatgtgtatttgttataagatactccactttagtgatgattcgctaaacacactatgaccattacttcaatatttcttgacagaaaaatttggaatgcatgcctttaccccatgccatgttatatgcaattatattttcgtctcaaattgcaaatatcaaatcatttcaaggatgattcatataatgaaaatatccaaaaataaacaaaaataaaaatggacatgaaataaattgaaaattgagcaaatgttgctagatttaaaacccactctaaatagttagaatgataaaatatataaaaaactaaagtacaatcaatcaaacaattgatattgttggatttttttgagtagtaagatatcctgctggggagttaagatatcctaaattttcttataggaagcaactcctttgtttcgacacaatattttctcatcaattcaaaaccgtatcttctcaaataatttatttttgaatttatatgttgtaagggtaattataagaaaataaccagcgttcaaagcacacaaaataaatttaattttagtttagaatataataaaaaaatatttaataaaaagccacccacacataaatattcataataaaatttcacttacattatacaagaagatgtccacacgtatgcacgggctacctttctagtttttataacaggtaaagttaaaaatatagatagtcttaatgtattcaaatcatattttgtttttgtttccgaaatatcgaaccagcatcattgatcaatttctaaaaaatcgtctgcctagggaaactagactaaccgatttcatccctcgtgaatactagctgaagtggccatttccacttataggctataagccaactataagcttatgtagaggaaagagaatttaaaaaatggagagggttggctctcatgcaagagctagctattcacatacttcaagataaatacattaaatacataggtgagagatagagagaggaggagaaaaaaaaaagataacattatagctcatttactatacatgttaactctaatattagctataagctcatagttggctctattattaaacttgctcttagaaaagcgggtgaaaaattgaagtcgcctccccaacaagcctgaagccctatacttcattaattaattatactatacagcgattactagaagctaattgtattatcctacatatgcccaaataaaatattggtgtacaaggaaattgactaacaaacaaatgccctagcaccgaaattcttctcaaggagagtatgggtctgtttggtttatagggtttggtttgggaaaatgatcctatccgggcgaccgatgcacgaactaaatatcgagcagttactcccctcacccacttcttctccattccctcatcctcttttctctctctttcttcttctctatccacacaaattctctttatataggagaagctcagcggcgcggctgccacaaggacgcaaccgacctttgcgtggcatcgacaacggtagacacgctgacgggtcgagctctgtgtggcgtcggcaacggtggtcacacggatgcggtggagcttggcgcggtgtcaacgacagcgaccatgcggttgtgtctgacacggacaaactcaacgtgacataaacaataacagccacgcagttgcactgcatagacgacaacattgcaaattggacactagagaatgtggtaccaattcgggggcatgccggtgccacctcctcacccacggcaccatcccagtcgatgtggtggctaaccaccggaatggaggaagagatagatctagatttttcttttgaattttttaatgtttcagtatatgtaccataatgtttcatcggttagatttaaatgttgcagtggggttttcgatggtgtttcattctttttctcaatgtacttggatttttttcatgtttcactacattcgaaactgttgttttatacgctgtagtaaaatgttttattgtgtgatttgattatgttttactatcttcagtactgaaacatttttacgtaaagactgaaacaacgtgctcgatttgtagtcgtttcgatctgttttgtttacagcccaaacaaacgacacaaaaatattggcaaggacaagggcatagcctgggtacgcattggtttgtttccagaaaaattggtgttgctaacattttggcaagggcaaacaaaacatcacaagttacattcccacaattttgggcattgccaaaattgtggcttgccaattttttttaggcaacaatccattatatacttcaatataggatttttgggatctaattttgtacatctatcgactcttacggccattaccttttcgattgacctggccgagttcctgaagatatcgtgattattactcaccacacgttgtacacaatgatttgaaaagcgtatttcccttttttctttttcctatcccaattgggcatttggtaaacggagttcgcttccctccaaaatgtcatccacttccatgtcagtccgttctccggcgtccttccccttccccacggcagccggagcccgcggccgcgtcggctcggcgcagccggtgggccccaagctcctctcctcgccacttccgccggcggccacgcccgcggtgcctcgccggctcctcttcccggtggctgccggcatttgggacttcctttccggtggcggagcaggcggcgcggctgccgcgtcgctcgccgtccggggaggcatgcagctcttcaggcaggtgcgacgataagggatttttctttcacattcttttcccacttattttctgtaattacagataaacccctcgtctcagccaatatctgcttccgtaatgctgcgcggcgaagctgtttttgttattagcttcgataaattgcgtgagggttcttgaatttttttttctgttcgtcctatctttgcattacagggagatgtagctggctcagtagcagagttcgatcgggcaattgagctcgatcagcggcagaagaaatgtatgtatttgtaacacttcaaagttcagatttcagagtgtgagtcagcaatgtacaactggctgcaattgtgctttgtttcagatctctggcaaagggggctttcactctactacctggacaggtgcattatcatgatagtaactaggttcatagattctggaaactgaaccaaataatttcaagccatggactgaaattaaaccatgtgtaaccatctcttttatccttggtttaattgatcgaaattctgggataggttcgaagaaggtgcagaacagttcaggctggatgttgctgccaacccgaatgacactgaggagtcgatatggtgctttctctgtgaagctcagctgtatggggtagacgaagcaaggaagcgcttcctggaggtaagttttccagctaaagatatgttttctgaatgctagatttcttgatgtgttctacttcttactaatgaggtatggtgcgtgacgtgaagaagtacgtaattaatgtcctcaagtaagatgcaaaatctttgccacttctgtagactttcatggtcttatcaatttagtttgttggcatgaactaacttcctaaatggtgtttttactgtccattatacactatctttacattgcgtacttcattctagcaatcaaaactgaagctttcaaatctaatgaatcgttcataatatatgctgtggaaacatctatgcctccatggtgactgcagtacataacaaattcaaattatcaattgactaaaagtgtcttaagctgagatcagctggcagagtactaaacgaatacagtgctattgggcgtccgtactcacttgatgatgaccacatttataaatttcttaaaattttctatgcatacgacataacgcgtcctacatgtacaaatttctaatattcttcttgacaaatctctcccaaatataaatggcctgcagcactatgtgtaaacagcccacactaattgctggtaaatgtaaactttattgcgcttcactttcaggttggtttagactcaaggtctgtaatgcgagaagcttatgcactgttcaaagatggtggggaccctgaaaaggttgtttgatttgatgataaatgaacatatctcacctgttcttacaaatttctgataaacatttacgctagttttctttttcatcttcagttggcttcaaatttctctagtggttctgaaggtgaaattttctattcatcattatacactggactttactatgaatctcaggtacaattaaaatcacaaaccttcttgtgaacatttgcattcttattaggttatttacatattttctcatagtttttttactgaacttcccccagtacaacatttaacaggttttcgtcaacgctatattttctttttgctttgtgggatgttttctattttataaatatatccattgtagtccttggatcactcacacatatagattataattgatgcatagccagttgaatgaaatatatataccggaaacacgagcagactgagtagttctaaacatgagcagttgacacatcctgcaagtaggtactaggtagtgtcctgttcttctcttatccatggcaatcgcaattaaaatttaaaaagtctctttactttgtgaacattcagaacattgaactactactactttgattctgtactgaacagaaggatgcagagttggcaaagtcccacattgttgctgcatgcaggtcaccatatggatcaaggtcttccatccccacctgttccaaagtacagatatatttcactaactgtgcagtcttcagccatactgaattaacaggataattcttggtttaggtccggtgattacatggcttcacttgcactagttcattgtcaatgccgcaactggactctggagtgacagaagtattatacaaacaagtggacctaaacattcttgttgaagccaacagataggaagcatcttgggtatgttcttcccatggctcactgtatttaactggacttcttggtctcaaatttttgtagatttggtaaatagcacattgccactcacagtcaatgacgtaacggctcttatgtgtctatgacatgtagatccagtaacaaatcctaaattgtcatttgtaagagtggcaattagttaaatatctcgcgtgatctggactcttcctcttctttttttcccttttaacgagactgaaatggctgatcaaacacggtggaagcattttaaagattcaacctctgagaaagatgagaaatgaaaccaaatcaagcgttgagatgctcattgaatgaatctttattttcataacatttcccatgcttgttgagtaattcttccacaaagtaagcaacttataatcagttgatcggtggttcttcgtccagaagaacagagtgagtgaatcaccaagtatagttaaatgattctgaaagtctgaaccattatttttttaattaatacatgtactgattcggaagcctaaaaacagtatatattttcttgacatttaaacctcactactacgattcatttgtttggcacatcagacatagcacccagaaattttcagtgcagaaatcgcgcttgttcatgcagaagccggactgcagccagggatgttggtaccagcagcgcagccgctactagcagtagagcatccgcccaaaacttgagtagctggcctggacggcctcctccaaacaagagacggtggccttggccactgacgcagcatgaacacagcgtagtacaccagaagccctgaaactacgcacgacaccgaagtcatcgcgcacctggagactccatgctcatccatggaggccgccaggtagccgaacccggccaccgccccggcgccgaggaagacaactagcccgtttctgttcgatttgatcgtgtccacggtgataaccgtgctgctccggtcgatcgaggtgaaggctggaccagagaagcgccgggacaagctccggcacgcagagcagcagcacaacgttctcgccgagcagcttggcggccatggcgtgcacggtcaccggccagcagcaccacgagcgaggccttgcggagcagctagctctcacgcgacgccggcgcgacgcccggagccacgccggcgtcgtacagccagctgagcctcgtcagcatcaggaccagcgcgcccagtgtggcgctgaggaagaggagaaactgggtgacggcgaggtccgtggcgcggtccgtgccccgtcacacatagcgcccagtagggcacaaccgacatcgccgtcagctgctcggcttcctcggccgccgtcgtcgtcgtattcttgttgccttcgcgatcagttgcagcagccgaactggcactgctgctgcttgcgccaggctcgccgccattgtcagcttcagctcggatcagtgcgacgcacagcgcggcgatgaaggcgagcgcgatgaaggggaagacggcgaggacgatgaacctcacgtcgatcacgagcagggtcgcgtaggatatcaccacgacgatgaacctcacgtcaatttttttcggtgtagttgttgggattgagtaagaacattctgtatatttctatgttccgatattgttagcgtgtccagctctgccgttccaatactgtctctgagaaaaaaaatattgtaacggaaatttgatcattctttttttccgatcgttctcattctaccgcatggagatcgatctttgctagttatgctaggaaagaaaagaagagagcaatccatgcatcttcctcccccattcctgctctctctctctctctctctctctctctctctcgcattcggtcatctatatatatggacagaaccatgaatgtgatagataaaatccctgcatttaatgtgccataaaccatatccgaaaaatgtaatgcaaatataaaacaaacgctcgtctcggttacattcatggcatcatgatatgctagtagtactagctatgcagagtgaaaagaataagtaaatcataattctaatatttaatttgaaaaacagatcctagccccaatgagcaaaaatgattaatagcatacgacaagacaataggcaatatcattatgaaaggaacataatgaaatcaattaaacaccactactaggactggccctggagaggatcccagcgtgagtaagcaaaacccatagaattgttatcagctcacctcctctggcaatggcccttctatgagcatcaatattgtcagagggggcaatgtacaatatcatctctgaccaaaacccagcaagaaccgtccatcccatctcttcatcctcaattccctccacaagttgcttcccaagagttaaacctttgttcaatatcatatcgctcctggatttttcaaccaacaatagtaatatgtactcatattccaaaggtttatcattccggccactgaaaatgggatcgacaatcttcttaacagattcatatgatttcttcgaccatgccttgtcatctggcagtagctcagaagcagatgatagcaagtatgcacagtactgtgacagataagtggcggtgatcttattgctaattgagtctgcaatcaaaggctcagtcgaatgcctgatctcgaagatacaagttgcaatgtgccatacaagaataacatcagatgtgccatctcctttgcaagcccatgaaaaactcttgccgatatggctttgttggagtgatgtaatacaatcagttggtctccagttttggcttttgagagtgttgataattgcagccttcacctctgttggtatcttcacttgcttagtttggactggcagtccgagtagttgtttaattctaacaattggacctatattcatgttggtatccattagggaggtttggcccattttgtcactccagtagcccaagagattgcatcgaaattgtagtacgcaacgaatcaatctccgcatgcgaggagattgctgccatgtgggtttggttatgtagtagcaaatcaaggtaactttggtccaatttgagcacatgtatgagacaatctcccatacctcatcaaaaattagtactatcacaaagaggaatgatagcaccatgaaaaacaaaatcgatccgaactgtttggcttgatcattcttaccgcatatcaacacacaggttatctgatggtagaatggatctgatgacattggcccaacctgtgctaccgaaaccacatgttgaatcgtgcgtattgcaataaataagcagcatgctgtgccggcgaaggagaataagatgtttaatacgaataaccagaagactgaacaggatactgggagcgatgaatggtaaaaatcacatgcaaaagatagctcatccgcgacaatactgacaattctttcaggttcagtgtcactatcaaataatgtgcacaccatgtttgggccaatctcagatccttcttccacaactacacacctcgcaaatcttcgccgcagcagcttgaacagcgagaatgataaacacagatctttgagtggcggccatgagctcaaaacaccatccgttgatgacatgatctgaactttaccgatggtgaccaggctttcatttcccttcctgtctctaaatcgatagccatgagggccttcctccacctgctgctcatcctcccccatgactaagagtggcaacgcaacatttacagcttgcgcgtggtggctgctgctgctgctgctcatgatatcctgtttcagttgatccatgtatccagcaatcaggcgagggttgcgtccatgcgcgaacgagcgttgcgccttcaagaaagcatataacttgacaacaatcctgacaagaacgaagccacacgacatcgaaatgaagacacggtcaagtggaaaaataattctgaagtggtgaactgaaatgtaagaggtccagatcgcacgaacaagcagctccgcgacgggacgatgaacattttgacctccatggtcatcagcagcagctatcacgaagctgtttgctccgaaaatcagcgcaaggatcgcccatgcttccaggaagaacgcactcatgtccttgcattccttgacgtcttttggcaggccgcagttctcaccgccgatgtcggagacgaggtaggagactacaggcaggtacagggtagaggctccgaggaagacgaagcgggcgaaaccatggcgccggtggcgacggctgtagacgcctgatcctacaaggatcgtcaccacggcggcagcgaagatcaactgacctcgcgtgcgccacactcgcgcctgcatgcgcttgtagaactcatccaaccctgtgacgtcgcatgcttctcgaggccctgacattgacatcgttgagctgttgtttctttatctgttagatctgcatatacatgattcattcaagagttgcctcaaaaactactatatttggccagaaaccgaatgagaagtagtgtacaaactaataaacgagtaatgcaagagcaagaattaacagtttgaggtagacagtcttaggcttttagctagtcggctcagattagccaatcaaatctaattagcaatttatcactgaactagaacaccatagatcgatcgatgtcgtcgttttcaccttacagaggtgttatatatccaagcaattaattaatcggaaggttatgagaagagaaattaagaacgaacgtacgtatacctacctgcatgcagttcaacggatcacttgaatcatcgcttcatcaggacaaaggatccacaagatcattcggcaaggtcaaggctatcgatcaaggcaagaaagtaataacgtagtacgcggcaactgcaagcgtatgctacggttatcttatctcgacttggagtattatacacattttgtttgctctcttcgatcggtccccctgttatgctacaacagttccgtactatcaacacctcaactcctcaaggtggcctctgtgatcctgtgggtgcttcctgaatacgaagttcagcaggctggccgtctcattccgtacacccgtttgaacaagcaaagaaacagcttggcccctgtatgtccatcttccaagtaatcgcgtgcatcaatatcttaattaggccaatagaccaatcaaacttgcctctatttcaagagagagagagagatatatataggccaacttgccggtacacacggagagaaacagaaagtgtaacattgataaaagtcaacggtgggtaagacgggccagccatgtggttttggaattaaatttgaaaatatactgactttttttcagaaatatacgggatgcaaaaaaaaattttaagagatataccacccgcacaaccgttatacgaaaataacgtagtgcgatgtcaatccaatgagaaaagtgcgagaccgcagagtgaaagagcgagcctgaacggtctcactgaaccaatcaacaacaccatcccaacggctccatttgattagtgattaattaactagttaactattaactaacaacaattagtgattagttatcttgattagtaattaattaaacgctaatctgaataattaatcaatttgaaatcgctccctggttcagcgagactgtccggtctcgctctttcgtttcacaagactacgtgataccattcgcgatgtcacgtctacgttattttcgcgtaacggttgtacaagatcgacaatatatttctacaaaaaattttgcatgccgaatattcctaaaaaaatttgaatgaataatatattttcaaatttaattatgtggttttgtgcgacagagagcccgagatggacttgcatgccctttatgtgctcgctatgtgtatctgtttgccactagcagagcggccgaatttggctgtaagtgctcaattcacaaaattttcgagttgacaatgacatcgcggcgaagtgatcaaagtatatattctgttcaaaacttgttttgctgccatgatccgtagtccataggaacaaacaaaggcacgtacgcgccaggtccatccgattattggctcattaactcagtacagtttgaagcatgtttccgttggattcacagcgatccatcggcaaggccgaattcacaggccttcccctggaatgggccgacctaaaatatcggagtgcatgaggcatttcggccttatcaaacaaaaccaaggattcgcacaagtcaacccacggataattgttagcctatttttaataagtccacttgccatccctcaactatatgtcgagcttctctccaatactataaatcttcacctctaacctatataaaaccgtgcaattaggtctcgtagtagtatggatatctagtttcgctgacgtggcatcctagtcaacaaaaaatttaaaaaaaatatggggtccacatgtaagtgagaagaaaaaagtagggcccacgtgttagcatcctcttctttctttttcttcccaagcttgggaaggaggggagaggtggtcggcgggagagacagaaaacaagagaggtgatgttggaaacatagacttaaaacacatccttagagcaagtttaatagtataatcagttactagctgaaaaattgacacaccatatacaatcactttaatagcttacccatacaactctcttagtacaaagttatactcactaatttttaaagcttaacatgcaaagatgccacatcattatccactaataattattacatttaagcatcatacaagtatgctatattatctataatttaataatttattaaattttagagatttaaaatataagcatgttaaatcatcccacataattcacataatatttcaatatatctctccattatttctttataatatctcatattcctgtatagttcatcctcacttagattatttatttttcttttatctcattaagtcagatcacattaattgtttgtagtccttaaatgattaatatatggttcaaattatctctcttattttcttctctcattaagccatataatctcaattttttttagcccttatatgtatagtctaaattatctttcttttttcttctctcacaaagttacgtcatcttacttttacatttgaatcatcattaatctctatttttttaagccattagatgtatgggctaaattatcttcattcttttattctctcataaagtcatatcatcttacttttatcatcttacttttacatttgaatcatcattctacgtactatttaaatttaaatcgcatcaacttatgtaaacttatgtttatgtaagcttacgttgtttaaaactatcttacgcactatcttttacttattattatcatattaaacttctgcggcaacacttggggtttcacctagtagttttatattaatatatattataggcacacctctcatacacatattttggaggccatgctgcagttggttacaaatctatagtatatttttcttctctctcctttactctctcctccatccgtgcttatagctcacatatagcatgttattgtagttgctcctagtatgcaatctactactcttttccaacttttattccctcatttttcgagcacatgttttccgagtcattaaacggtgcgttttaaaaaaaatctatacaaaattcttttaaaaagtttatatttaatctatttttaagttctaaagcggatacttaattaatcatacgctaattcatcgtgtatttttccataccagagaaaaggttaaacccaaacgaacacagacgtggttcaggttacaagctccggatccaagctatcaaatccttgaattttggagctgacacgtgacagtgagatcctatagctgcggagtgatcaaagtctcatttgattggtttactaactccggacagttgaagatcgatcggccatcgagcatgtgtttctattggcatcacgcatcaccacgacgacgacgacgacaggaaccaacatcggccggttcgagcggtcccgttcgcagccccaacacagtgtatcaccggcgatgccgacgaatagtatcatgggcccccagactcgagggaacagtgccgaaaacgaagccctacttgaatccacagcccatcatccaaatactcgaattaaatcaatctacttgctttggtttggtgtccacataccatccaaagttatggctgagttcgggtcgcacgaaaaacgggtgttaacccattaacatgtgattaactaagtgttagtctaaaaaattgaaaaatggattaatatgatcggtaaccgcgaccgtcgatatttgaacaaaggggtccatctattcgaaggaactcacatgaaaaaaaaaatctattcgaacgaacatccttggccaatcaatcctttttcctttcggggaccatccatatatgtccctttttggccgtccacaattgtacgttaagtacgaagctcaagctgtggccatgaagaatctcaacaattgtggtcacaatcatcctcacgagagtacattagtattttgctgttgcggtgaggctgaataggaaatttatgttactccttgattataaggacgcaagtgggtcaacccgtgaacccacttatatagaatacttcatccgtttcacaatgtaagtcacattacttacattgtgaaacggagggagtaattaagtaggttgacgtgtgggttacccgcttatatttatgctataagtgaattggtcggtcgatccatttgcagttttacccgatggctttggagatgttgaatcttgcttgtatctgttggaattctgctcttactaccttgagcaacatctgccctgaagtgaaaagtgaataaaagaacactcaaacgatgtcagttttggtccgttctcagctagctgaccacatttattggttttcggtgactgattccttcccacagcgatttgatctttacgcaaactaagaccttttggattttggaaagcagagttttccttttttttttcttttttttttttgccagaattgaacctagaacctttttcctatgaaattcatgcacttaggctatgctgcatttgtgatgcaggatctaatcagttacgagaattgagaatctttactgaccttagaatgcttttcataaaagttttgaattcaaagtagaaataaaccagtgccaaacgtagtctaggtgtgatgaacaaataaattctttattactttcacttttatttcagaatgaagaggaacgatgtctccttctgaccatcattccctcacagggggcaacatcgatgtacatattcgaagaacaaaaaagaaggaaataaaaaataaaaggacaaaaaaagaagggtgtgagtgagatcaacggacctctgatcatatggatcctaccacaatcacaaacagataaggtcgacatgatcaatttatctacgatacagcggcacggagaaggagcagacggagtcatcagatcgccacaaatccatccctcacattatcccatcatcatcatcttcttcagatagggcccctcccctatctcatcctgataaaccaagaaacctgtatgatctggaaccattggtggtgtgtgctttgtatgtagtatgtactatgtacatttggcgattgggggtgagcaggatattgtcagccatgtagcaatgtggatgcagatggggacgacaatgtcattagcaacaatgcagcctcctccacacccatcagaagcctccttttcggaacaacctgcaagttgctgctgctatttccactcccactgttgcagttgttgctgttgctgttactgtcttttacttcaggtattacctcaccatgctcctgcttctgtggctggttcaggtccagcccaagatcctgcctcctcttcttccggtaccggattccgcaagcgttgcatagagactgcgataagaaattgaaaaataaggatcaacggatcgacgcatctgaatttattattgcaaaagggataacattaagaatcacctttctgccaattattggctatctagttactttatttccttagtgctacacgtgcttttgtgcctaatgttgctacgggatggaattgaggaaaacattaagggtggaaatgaaaaatattccaattagagaatcgaaatggataaagcatctctctctctctctctctctccatgtacacaattggtttggtggttagctctgttgcaaggaacagctcaactaaccaacaagttgcaacccagctgaatggagagaaatgtcaacaagattagtcatgatagattggaccaaaacaagaggtcaccaccaccccctgtgctaaatgcctaaatccaacaagacatcaagtaagcacagactgtcaacagaaaacttgatattttctcggagtctatttcaagtatatatatcattgtgccactaaaaggggacttgaggaaactttcgaaagcgtgtttgcgctaatgatcttgttgacagcgcattgattaagaagctaaacaaactgaaggccaggggcaggttagatatggacatatggtggaatgtggtaggaactttctcctaatgcaatgtacttagttctctagctgtctatgattaaagtgaagggcacaagatagcctctttgactcggtctttgcagctcatatatgtttccattggatcatccaacattagaatcttagcggtactactcaagtgcaccaaaaatcagtttagcattctctaaaagcatctgctaattattttttaccaaaatacagaaaaaagattagcatttcccgattagaacagattgcactaaagaaaataaatacctgttagtcaaaaaaataaataaataaataaatacctgataaaaatccacaaaataaagatcatgacgtccctaaacatccatatttaatggatcaaaacttcgctaggacaaagtaaaagttactaatagatgagatgatcgaccatgtagcacagattgacagcatgacacgaacaaacggaacaatcatttgcaccacaagagcagagataaaaattaatatgcatgtatatacaagtacaactactacgtcatgatcatgtaatcgatcggcagtccagaattaatccccaatcaatcaatctgcctgactctgatcataacgatgatgaacacagtaaccgaagaggaaagccaagggaagcgatcgatcgatcgatcgatcaagaactcaccctggggccggtcgggccgctgcgccacatgggcgtggtggtggcgcggcattcgacgcagctcctcctcccttcctccgccacgccgatccccaccacctacatgatgatcaccaaccaagaaaaaattgaacgagaaattgatcgagcccagaacacacaaacccaaaactcagattacacaagctagggaaacaacggagagagccgcacgcgcgcacgcacgcaccttccgatcggtggagcccatccggattaacacagcgttggttggagaagagaatcgttcgtattttttctctagttcttgcttctgtgttgttgatgaagcgtgtagtagaggaggaggaggaggagagagtagttgtggaggaagaagacgagagaaggagcaggagaaaggtagaggcttaggcggtggagaggtgaggtgaggaagacgtatgtacgccgcgcggcgcgcgggatagcggaggaggtgacgtggcgttggcggatggacaagggaagatatggctgcgattctggtttcgtttccgtttggatggtaataaaaagattttgtaacattggcg

SEQ ID NO: 12597 - DNA, 6613 bp, Oryza sativa
caagtccccctactctgctgaattaccagtgagaacatgagaacaggggagaggggaggcgaaagaaaagggagagaaggaagcgtaatagggcctaattctggatccgtcctaaatatatgattatataaacatgtttctttacttaaagaaaatgttttaccagtgttaaatatataggtcacatttgggtccttgaacgagtcaactttggaataaaggatcaagattttgatgttggtaatgttattcaatgctaaatgcttacagcaacaattaaagacactagcagaatattgccacgtgatcgggaacctttgcaaaagaaaagaaaaattaaaccccccctctgttatgtaagcatctcgtgtggatgctcaaatggttacttgatcaattgattgatgacgtttagagcaagtttaatagtatagccaattattagctctaatccatctataggcaatctaatagctcatttatataatagttatatactacactattaatatctggtcccatctatcatatacacactacgtcttagagtccgtgctacagctggctacaaacctgtagtccgctgctcttctttctccttatttatcttcttaaaatatatttgtagctgacttatagcctgctattgtacctgctcttgtaataacaaagcatcgagtgcctccataaccaatgatgacgtaagattagcagtcacgttcacataagcagagaatcagagatgacaagcagtaaaagggaaaattaaagcacgagttcaagtccctagcttatctgtttctcgtttgctgtcatcaaaaccaactctttcttctgcttctcagttaatctagtactaactacttttcttacaaaatcgaagtggtcataaagtgtagaacaacacataagcaaccaccgaaatggataaatcaaagatgacgtcatggcttacccgtcatcacagcggctttgtgtatcacgattcacgggcaacctttttctcctgcagtgtacagaggtcaaaatcgccgtcaggaacaaagcaaaacgtcactttgttcctcaaaatggttttgtgctgaaattaacagtggcatgcttcatccaacgtagtatttatttgtggagtgaatgctgattcgtcttgaattctgaagggtattaattcagatattcaactcagaaattattaacttgacgttttctatttcatcctactagtttacaactcggaaattatccaaagcaaccaacaactaaaaacggctagatgcattcacataactttgcaagaccgtctttaggggtcacttatgagaagaaataatccaaaggtgtctacatgatcaagatatcgctgacaagttgatcgatatctcgtggtaaggttaagaatatatagtgcgctccaaataggctattaatcaatctatcatgcttcaaaagaaactttacattcagtttaaaaagaacaaaaaaaaagaaactttgcgttgaagcccttgaaaaggtaatcaaccaaaaaaggtatgtatatttcccatcaaactataaaatcgtcgacaaaattgtatctttcatttgtaaagctcatggctggacatctagacttctctatcatttgtaccacctgtagtattatgtggcgctcgaatattctccacttctatttatttaattatttatttatatctcttccatttcttgtgtgctaagttgggttttagtcaactcaactactatttccttgactgttccatgaaaaatacaagagcttaaaactgtatagtacacttcttttttcacgagagcatgcttcctcgctttttcatcaacgttatactcactagtcaactactgcaccaactccgttgcatcacattccatgaagaccacaaaagcttatgtaagcatcccttcaatgttttccaatgttttgcggcacaaattcttcccaacaataatcacccaaaaaagaataaaattgtactataagtactcactttcctggcaaaacaatcatccaccaaaaagtaaaaaaaaaaggaagaagattgtgttgtcaacttcacagatagccaaacaaaggttgtacatgagattagctctcagccagatatttgcatagaagcagctagtgtcccagaggataaggggataggtaaacatccacattagagtgaagcttaaccataaactaaacaaaggctaaacaacaagctccatcaggaccaccaggcccactagaactctcaactctcaggtgtaaaatatgcgagaaaaaaagctgaaaagttgttctggtggtggtacggccttttgagagggaaaatccactgcaatccaaggctcacccagctgtcgaccagctgctcatgcatagatatgtgttgtgcactaatgatttgtgtaggatgggtttcaactttgtaaattctgtgatgattggttagggagaaagaaggttatgagatgaaggccaataatgggggcaccgtaccaaacgcagtagggcagcacagacaaagtactccaaactggacctggagctagcacacaattgacaattgcatgcgcatcatgaacagctgaacaattgccccccttggcgcacaagaatcttcggctagggagccaggcatgaatcatgattgctgcaatgaattaaaaatatggtagtagtaaaagagacagatgtcacatctaattttagctacttcctccgtttcattttagcatttatattgatgctaatgaatgtagatagatatatgtctagattcattaatattaatatgaatgtgataaatgctagaatgacttacattgtaaaacggagggagtatttattaatgaagaggtaacatgtataataaattacatctatgctaattctagtgcactaatcccaatagctttattttatttagttgtcaaacatgtctccccctttctctatttttaagtttgtgtgaaaaatgtctaactactctctctctctatctatactattctattcacctcatcaatgtgctattttaagccaagtgtttaggtgtgcatagtccttgctctgagacgccagcttctcttctcccttacacgaggctattaaccgagcgctgcagtgatttctaacagagtggcaggcacagaaaaagaattgcagaacagcagaaagcagtcacacttcagacttgtatcgaacaacattcttgtttctaacttccaatcgagggcctcgaggcatcggcacaggcataatcaggccagtcgattctgtactatcagttccaacccaatccacataaaggtcaatgcttagcaaaagaagtcagaacccacattcagaagtcagaacccacattcagacgtggtagatcgccagatagatagtggtgagtaagaaaaaacaacagtgcagacaaaattgtgttccagcgacgggactcgtaagaattccaaaacccactgggttctcatgattaacaacaatgtaaactatggctttacagcttccaagtatttttgtcttttcccttttttttttacctccacagacataccagcttacgctactgaaaggaaggtaaaagtaatagctaacccgacaacacaagcaagagtatgcccttccccgaccgaccaatttccagtacccacccccttgtgtggagaaccataatccatatgaaccaaccgctatacacaagacacccgaaccacacaaaagcaatgtacctaattgccataccctgaccttgctcttatcggacgaaccctgactgctgcctcataacaagttagcaggaccaaaccatgactcggataacttgactctccgattctggaaagccccctgaacagacagctacggtgcatttccatccaaatcgggcactgttcaaaaagaaaaaaataaagtcataagaactccaatgagtcaatgactgaccagttccgaccattagtaaatagaaagaaatttaccttcaccgaaaccgccaaactgaaacatttcattgtcagattcagattcacagttccaaccattagtgaatagaaatttacctttaccgaaactgccaaactgaaacatttcattgtcagattcagattcagatacagatggaataagaaagggctgttggtcatcctcctgcacccagtatgactcaagcacataaactgccttattatatatctcaacattgtcatggttctggagatcctcaattttgtccaagccatcagcttcatcaaccatcggcacaaatatgttcatattacaagcccccaagttcttcttagcctccccaaccctcaagatattatcaagggcctccaaacaagttaacactgttttggaatcttggtgaacaagtaaatcacaaagcggcttgatgcaaccctgactaacaagatacctggtaaacaaatgatgtgtcgttaagaagttgctaatttagttgcacagaaatgagcaaaagcacatataaataattgtcatcaagcttttcatactctatctgattgaatgtcccaccagatgtggcattagaaattgcccaaacagcctcctttttgacatcaaactcagcatgttgcaacagatgcaatagaggagcaattatgtttgaatcgatcacagcctacaagcaaatttctgaatgttactaatggataggtatacctttcaagatactacttagtgcttttcaaaaaatgaaggcttcccaacaaggggatatattctagagctgcaaatgacacgattactataagcatatttctcatgtttttttcattggtgaagctacaaacctgaatctgctctttagttccagctgtgatgttggagattgtccagcaagcttctctcttgacgcttttcttttgagttgttgtcaaaagattgaaaagacagggaagtgcttggggatgaccaacaatacactgtggtagggagaagaaacattaaggaaggataaaacaaaaactaattaatcagtagtagatgtgcataacatgacacaatatacaggcaaggctgctgcagtagtattaacattaatattgtaaactgagcactgcaaatataaacagaaaaatgtggacattatttcctagtaacagacaccgctactatgtgcaagcatatggatggcagggatgcatgtgttgggcaaactaacattaacctctcagtgtactgtacagatttctctactcaaaggactactactttgatcaaacatcagtagtaatggagtaacctagtgagaaggacttaaaagcagatttttcacagcagaattcaaccaaacaccaatgacatcattaccattaataaatgttcttgtatgcacaattgcactaaaatgttcttgtatgaacaaagagaattatgacatttaaaaaagaataaattccccatttaccattgcaatttaagcactcaggtttgcgagtatttatgataggtttgacaaggcaagcagtttgcaagggaaatatgattttctcaaatttcagggatgcacatcagcaatattaaagtctggaattaccagatgaaacattggatcatagtgaaaatgaacatgttacgaatttaaaaaatgaggatacaaccaaatgaaaaataaatgctcctctgtgctcagatagttaacaccaatttgagcatcagttttctcataaagaattttttaactatgtatctattggtataaattttatacaaaatcaaaatatgccttaaagcagtgcatggaggggctaataaccagaaggactagttcttacagcataacaaaaagagtagatgtagaaaacttacagatattttggcaaaattttcgcaaaaccacatatgtaaggcacaatattgcaacactagcaatttagaatgagagctataaaaacagaattttaagcatggtataccaaaactacagatttcatttcaaagtcccattaggacaacatcataagatctaactccttaattcagcaatttgaagtaaattgaatgctaaatctataatttcatgataccatgcttaaagtcagcactaaatctgtggttccatagtattgtggattaaatccgtagttttgcaaataattttgtccagtatctgcagttttggttaatttactctgacaggagaagtgacacagtagatagacaacaaatgtatcaggagatatggttaatacaattctaaggtaaaatgctatttaatcatgcaacacagagtatgatgtttttcataaaagttaacaagttaactgaaaatcagccaaaggttcaaatataaacacatctgaccatatatttcgtatgcagtttttgagaacttaagaatgaagtagttagcagctcaacaaagattcacaaaagataaaacccaagttagaaaagagaaaaaagaacctgggtctgcgcatcatccccagttacaatgttgccaaccgtgcggagagcaggaatgagcaccacaggtgaaggatggctgaatcaatatgtagttgttcatgtatcagtcctcgaatttagatctatgaaatgaaaaaaccgaacaaaaaagaaaacaaacttacc

SEQ ID NO: 12598 - DNA, 1795 bp, Oryza sativa
tgttaaacttccctatatgatcccacccatatgataggtataagaattcagatgttcaaacttagattatcaattgcttccatgcctgttcacggacatcctctcttggtgagctgaggagcttcacaaagatgggcacagcaccatgttcaataactgccattgtgttggctgctgttcctgaagcaatattggtgagagcccatgctgcctcaaactgaagccacagaaaaaagataagactcagagaccagctagtgattaacatagtaagtaataataatataaagtggcatgcctgcattgttaggtttgaggagcaacggtaatgtagttttcagttttccaacaagcaatcaatttgctttgctcactcgtggcttatactatgttcttagctgtaatggaactgttgatatgctgtaatagatacaaacctggagctgggggtactcctccctggtgaggaattccacaaagcgagggagcactccagatctaatcacctcatcaattggaggacaatggtctgaaacatttatttactcataaactatagcagctcacgggaatagttaacataaatttcaagtgcagcttcagcattgaaatcaaatagcatataaaattaaacaaagattcctgagccacaatgattaattgcagtaggagtttacaaaaccaagggagttttgctataattttgtttacgaaaatgctatacacacgacagatttgtaggactatcgtacaactagtcaacgccgtcatctgtgagcgtgagctgtttaacttagtgggctgtgattgttgggccttttaaaagcccaactccagccgaagctccatattccagcgtcgattcctcttctcgatattactctatacacagccgtgacttttcatcttctacatttgctttctcaccctaaaccctcattctaatcccctttgtctcctatccataccaatcagttaagattaatcagaaaaatttttttgcggcaaccacaacagagtattcaggttgaagctaacagaaggtattttaggctctgattttctaggccccatgaacaattctattaatcttttatctcaattcgtttttcaacatctcttgttttttcatgcttgcaaacatatacatggccatatttgatttttcaactgattttggccatgaatatggaaattgaagccgtggtgccttgcttttctatcaagtctggtcaatcattttttgcttgcatgttatggctttttttagaggacttgcatgttatggctgtgaaaatatattggtttcacatcctgaaggcctaaactaatctaacatctggagtgaatcattttaatagcaacctaagctatatcgatacatgtctcagccggactagcctctggcctcagtgtacagaaagcgcagtacgcaagcaaacaacaacgaggcccagtgacgcgtagtcatatctgacaccgtcattgctcgttttttccgccgtttcagtcgtacatgcgtcggacacatgcgtcgggcgtatagcaaagttgttttgtttaagcacagcttcagcaatgaaactaatcagcatgaacattggacaaaaattccatgagccacgatgattaattgcacaataataagtttacaaaaccagatagtttcgctacaattttgttttaagcgcaacctcagcaatgaagtcaatcagcatgaacattgaacaaaaattccatgagccacgatgatcgattgcagtacgattttacaaaagcatgatagtttcgctac

SEQ ID NO: 12599 - DNA, 1444 bp, Oryza sativa
ttacacagatcaaggctaatttgcgaacaatctattaaaactaattaatccatgattagcacctattcattgtaccactatattatcaaataatagaagagtaattaggtataatatattcgtctcgcaaattagcctccatctgtatattctgttttgttcaaacatccgatgtgatagggactaaagtttccttgtatccaaattaccccttaaactcatcttcaaatctctcattttatgagagcgttttacctatctccacacttattttatgtggagctaaatcattttatgagagcgctttacacatctccacttttattttagatggagctgaaactgtttggctgagctccaaccacagaagaaatggagctgaagctgaaactgtgtcaaacaaaccttacttgtcctgatgatttctcacttggcagataggcactgagtttcaattgctgatgggattaacgtgaaagcttcttgaggttataaggctgtgttcgcggtaggttaagctgggaactttccctccaaacacgcaaaacgaaatggttcattatcacatgattaattcagtattagttattttcttcttgaaaaatggattaatatgatttaatttttaaaccaaatttcatatagaaacctttttaaaaaacgtaccgtttaatagtttggaaagtgtacgcacggaaaacgaaggaggtgaagttgggaactcaaattaccgaacgcagccaaagctgggtatatataatttttaaaagaggttttatatggtggtgtttgggaaggagaaactaaactttagtccctctcacaaaaattttagtccctcccatagggacttttgcttttgtgagagagactaaagtttaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctatacagggcctcagtcccttctttccaaacaccacctatataaatatactggaaatctatttaactttatactctagagctcgatctgttttttttttacttttccaactcatctctcttcttttttcgcaaacttggcctaaactatgtgttttttacaaaagtttttttataaaaaaattactttaaaaatcatttttttttcattttttttagaaaactaatacttaattactcat

SEQ ID NO: 12600 - DNA, 22157 bp, Oryza sativa
atctatggttggaattatctccctcattttcttctctcataaagccacatcatattacttttaaatttgggtcatcattctatatactatttaaattatgataaacaacatcaacttatgcaagtttctatcgtctagatatcttacacattatttctatttcttattatcataccaaactcccgcagcaacgcgcggggtttcacgtagtattgataaattagaattacgtttggatgacttagaattatgtgtgtgtgtgtgtgcgcgcgcgcgtgtgtgtgtgacttgtgagggagaatagtaatactctcgagagtaagactatttaacgtagagcagctattgtacgccctgtctcccatagttcaaaaacccatttgtagactcggtcagataaggtgaacatcgtctggcccttctcccaattgagcctccttccattcctttagttcatctccatgaaaactgatctatatgcttagtgtttgcagtattttcgcagcaaggccccctttgattcctacagtgattccttaaaaaaggcccctttgattattggattggcaaaaaagatttacatagaattcgaattcctatgaagtgtttcttgcatgtccctttgtaattcataagaaaacgaaagaaactttccatatatggttgtatttatatgcttccctttcacagcaaaatcaccaagagttcttacctctttgtaaaactttccaatgtttttcctactactccgttccattttaagtgcagttgtgagttttcgtgtccaacgtttgaccgtccatgttatttgaaaaaaaatataattttttttaaaaaaattagtcacacataaagtattattcatgttttatcatctaataataataaaaatactaatcataaatttttttcaaataagacggacggttaaacattggacataagcagtgtaaaccaatagtctttctaggatggaggcagtatgacactaccaaagggcttctatatttttctcctgtgtttcaaaacacatgttctttttaccattggtcacatcttttttactgctttttagaacaagacaatcgaaaaccgatagaaaaatatatcaattatagcgagagatttcgtcttttagagttgatggtaccgaacatgagcatgagagttgaggaaaggccaagtgtgggtgacaatagcggacatggggatgaccctgcaagccgcgcttgtcccgtaggcacactaagacaggtgatgggagcacgtgtcgcgatggaatagagaagacaagggaaaagccattccattccatgtcaatggcgtcatcctgtcctcggttcgtgtttccagcgttctcaccatgcctaggatctcctccatcgcttttgctgctgcatcatccacttcaacttcaagttctaatccagtggtcaacatccaagcagacctcgagaagggtaagaaaacctggttttattcttggtgctagaacattacaaggggaaacattttattacaagtgagaaaaaaacacaaaacatcaaaataggccctcactctatgactctaagaacaaaaaagaggaaaataaaggtactagctcattatagtctagtacacatacatgcacacaacaatgtaaattatttcatcacacacatagactagctagctagctagcacattcagaccgaagcaaagacattaatatactccctgtgacatgagaaaacaaacataagttacttgcagctagctagctcacttgattccatccatgtactagttaatcaacaaaacaacatcaatcacgctgaatatcgacttcactacgatggacgatatggaaagcgtggccttccttcatagggagatcatagcaatcgtcagattcatcacgaggactaaaatttgtgatttgaatccttttcatcctggagtcaccgcagtcatttttggccatgagtaaccaagcaaaggtgatgagctcccctccactggccagttgttccacgtgaagctccgcccttgacttgccggcggaatagaggaggactctcacccacatttcgaccagctcgtcaagtaccccatctccttcaggctggtcacccactagtaacgagtcatggatatttttgtaatgctcaacatcagagatgtcattagtcctcctctggaacatacgttccgcagttttaatcgaggatattgcactggtattgagtggaagcatggaagggtggttaaccaaaagatatatcatatagtttgacagttttctgcagacatccaccaaggaatgattcccagggtattgcctgaggaaaacctctgtgaccatatgcatcatgagaagagcagtaccaaagtctgcggtgagaacatcttgtatctgttccaggaatgagccaacatatctccattctaggtattctgtatcctgaccatcgacttcattcattaagccataaaggccaaacacaactcgttccatagtatctctatccgtcttgacatacccagtgtgtatcagcttgtttatccaagatatctccttagcaccaactttgtttgctatgtttctcaaataggtcataattttgggtgtgcatgatgttggcgggctgatgcctaccaacctgttcacgcaattgtactgtcccattgaattagaccaccgtggcctattctctggccatccaatgcgactggaaaaaagataccatgaaaaacaggcaagccagttgtactttcgaaccttcaaccatgcccacgtccatggagacatcatgaaaataagcactgcgcaaacttcaaggagaagttctccaatgaatagtgacatggtgaccgcaatatcaactttactataccgccgtttctctgttgaaagaaagagggcaaaagcaacaattgaggtagatatagcaatgaatcgaagtgcaatacctcccttttttctaagaagaagtgcctttgtgtagaggtcatcatacatcatgccgagctgaagctgcaccaaacttaattcgggctttattatagtttcaattataattttctccaattctgcttttctattttcgattgatatttcatctccctccaattgtacttcttcatcaccttcaattggtgtgttatttcctgtggattgtatagcttcatcattctcagttgagattttattttccttcggttctactacttcatcatctttaattaatattttatattccttctgctctactatttcttgatctatatccacagacctagtggctttctccaattctactgcttcttcatcttctctcacggatctagcagcttcttccgattctactatttcttcatcttcactctcagagttagcagtagacctgagactgcgtgcagcaaagatatcatggatttgtaacatggaatttaaagcagtgagaacataatcgtaataggtcatattcgacccgttgctcgcttctggcaattgtatctcatacatgtgtcgaatagtggagttctcaatgctttcaaagctcccccacttgagagaccatgacctagtgaaatacttgataaatccagtagcaaacataaatattcctgcaagtagaagctccttgtgtcttccaatagaattgaagaaaacaaaaacagccagaacagcatagaacagaagtttccctgaacgtgtcaaccatgcattcttgtcctccattttaaaagcagtaatcgtgtcctgcccaccaagatgaataagaagaaatggcgcccaaaagaaagcaattgattgggggttaccctcttgtcgtgagaggccaccgagggcatagattgctatgatatctgcccctagataagttgatgagattaagaccctggtgaacttgtcagtgatgtgcacgtgaaatctacccgcaaagaataggaccacttgcattgcgaagctcaagagcacaggcacatatttctccatttcgtatctcatagcacctgttgattagaatagcatacaatatcattcagtgtgacttcggcaattggaagaagcaatgctttataaatggcagtacaatcaatccataccattcatcctttataatccaaatcttcatatttatttatactaccaaaccactcatatagtagattaatttttgtactgtggtagtagacttcataaatcaacagttaatatctccttataataatattggtatagaatactgtatcaccgtaaagttactcttggacaacatagcgaattatctagtcgatcatatactatttggttcaaatatatatatatatatatatatattatgttttagccttatgtacacgaatgtagtcactaccagtaaaagtattttatcttacaaaatacaaataatatacccaccacattaggtaattaacaagggtatctagagaaagttggaaggaaatagacaaagtgccaaatagattgataacctggatttttttttatctatggacattcgtccttgatactgaggtcaggatgtcaatggttctcttatataagaaatatagatcacctcatggattttctctaaataagtcatcgttagaacacttggataaaacatgaaatggtgggtctccatctaatttataaacatctctcaacacaaagccctaactcatgcactttcctctctctgatccatcatatctcctctcccccctctctttctctctctaagccattacctctgtttcccacccacttgtgtgctcttgattctctacaatgctcctttctccatctgcatagaccattgccatggcatcccttcctcccatgaatctacaacaccgcctgcctccatctacctcctaacctatcgtacttcttgctttagagtggaaattccactaggtgccatcccttgggatcaaatccatgctgctggcgaccttagccccacgaccactcaggagccttcctggttaccatcttttatatattgaacgcctctaacccacggacccgccatagatgttgtctagttcatctgttgccatccataccagctcaaatgactgatccactcttccgccaagtgaaacaatgtcgtcccatgcatatttttataatatagttggatggctgaaatttgaggttgaattcaagatgtttagcttactgattgcgtcttattcttgacatgattgatgaagttcatggagattaataaatatcttactttgattttatttatctggcctctaaactaagataataatttattttattatgtcgttaattacctttttatagtaaaattcttagaagattttgtaattacaagtgagtttatattgcattgactataaattttagatgtcattatcttacactagcctataaatttatacagatgagtgtaattgaatgaatatttttttgacgtgaacgtttgcatagtcttcaataaacgtgtttcatcatttatcttttctaatttatttagaaaatataaatggtgaaacatgtttattgaagattgtgcaagcgtctaaaataatggataaaaaatggacatagtggtatgcagaaaaaatgtttagttgtatgagaatttctgttttgtttactgtgaatacaggaaaaaatggctaagttgattatatccattagtgggttgttaaagtgatttattagcacatcagattctattaattagttgtctgttaattagtctatgaggtgagcctaaacatgcaacggttacggttgattgagtgatgaacgctttggatgttatcaacggcaaattttgccgtttgcctcaaaggcagacgatacgaacagacttggtggttgtaccgatggtagctaggttaccagagaagagatcttctatgtatgaatgggtttaaatagcaatttgtgtgatgtttgtagtgccttaattttatatatgattaagactgtgtttagatcaggggtgaaaagttttagcgtgtcacatcgggtatacggacacatatttgaagtattaagcgtagactaataatagattccacctataaactgcgagacgaatttattaagcctaattaatccgttatttgcaaatttttactgtagcaccacattaatgtcagatcatggaataattaggtttaaaagattcgcctcgcaatttacacgccactgtctaattaggtttttttctatatttaatactctatgcatgtgccaaacattcgatataatagggtgaaaaattttaccagggatttaaacaggccctaaatccttaaatatcagtttttatcttttatgacccggcaataaagttagctggccaaccgtattaaaggcaatcccacacgagaaaattgtaagtccccatgaccgactgcaactcttcctcatcctcaacaaccctacccacgtcaccgcctctcctagccatgccgctgctgcctccatacccagctgcaccattgtcctcctcctatcgtgctggagggtggcatcagctgacggatttggtggcaccggatcctagaccactaggaggagaaggagaattactaagtgacttttaatattttttttaatattcaagctaaaagtaaattatattagttatttacaacaaataaaaatagtttgtcaaactatatatattcagagagaaataaatttaatagactctgtatcagattgtagatgaaatatgatatcccgcactttgattatattgatgaatttatgttaagtattataaaaatgatggatatatatgttaaaaatattgtaaaaaataatgtgaaaaaaatgattggatgttgatttgtagaatgaattatatatgatattgcatgcttgcataagtttttatataattattgctagtggatgatgaggtggtatgtttgcatgttgagctttagaattagtaggttataactttatagtaagataggattcatagtgccgttcggaccccatgccgtgactcaaggaaaaaaagcaagatacacgtgtgcaagctgagcaggggtcaggacctccacggggctctctccccacgctactcacctaggatttggctgaagaacgagtgatcaaagttggatacagggattttaggtagatgtggtagaagcgaacgtggcacggaatattcgttaggggaatgatgcaactgaatgccaacgttaactcaacgcactgtaaacgcccttatccaacaaccctagagcctggtttgcggatgggatccccaccgtcccacgatgccgcctctagcgtgctggggaggaagtgagatagggagggtgatgacggcggcaacttaggatggctgacagatctgacattgcgaggcaaaggccaacggattgggcatcaggaaagctagcggccgacggatcaattgtacctgaggctggtggggccgatggcatgaagtgaatgtttgtgctttttaaatcaacttgatctcaagattttattgtaagattgtttagtttactgttgtgagttgatctttatgtaatttgatatctggattgaaattgtattatagattggagtaacatgttgatgtaaccatctattttactttgtccccaaaatgagtaacactggtggtctagatgccagtttttgaaacggtagagattggcctttctatgccggtgatagtcctatctatatatactactataaaatacaacaagtggtggtggttataataacctctctaccactactttagcaaattttctaaattagtccatcatattttatgatattatacaataatctaatatttgtttcaagtaaatactatatattcaaatgagcaaacaaacaataatagcatacttgataaaacaataattatctatgccatattattatatattattttatccatagcaaaatatgggcatttcgctactaaaattaaaattcgatgtgatgcatactagtctggaccaaatatttaaaatataaagtttaattggagtcatatctcaaaccgacgagcatttgttactgaggaaaaactgtttatggggataaagaaaacacacacatatacttaccgatggatggagtcgtcatgttggacctggatgtgcaaacttgctgcttcctgagcctcctcttgcatatgttcccggacctgcctcttgcctgtctggcttcaccttaaatagaagaacgcaggcaggcatatgcaacttgctactggggtctgggagtaccaagtaaacgctagtcttcctggtttctagggccgtggtcgatcgtgtggggactctcacaactaagggcagtctcaactcatagtgctcataagcagtgtctatggtgtcatatcaataagacatcacaatataaactacactctacgatccatggtttcttaaagttagccattaataaatgcatcatctctcttctctaccaatcttatttattcttcatctattatgaaaacattattctctccaaatgcaaaacttgatagtgtctagtgcatagattctcgtgttgaagctgtgtcttgcatgagacccagtttcctcctctcttcactctctcttaattaatatagtgttacgtaagctaaaagtcctacatggcaatgtagttaataccatagacaccatcctaggtggagggttgggactgccctaacgtgggtgcacttgccactcgcgtagctaattgggagtaaaatttatttaacatgtaaagagacccgtgtaatggtactatatatctgagtgcgatggcaaccaagcatattccatacgaagccagctttggtgtgctgttctgtttacaccaactttacatatattgtaggactagtcttgtaaaatttatatacatatccaaaatttcaggcatatactcatgagggaaattaaccaatttcgtctgcaggaacctttgggccactttatctggaaaaaggtggcaactttggggtcatcatacatttgctgatgcatttgggtaagttcacacgatcgcgaccctacaaaccaggaagactagcgtttacttggtaattaaagacttagaactgctaccgaggactcctccgttgcataattcttaacgtttcggataaggttgagatcaaactttaatagctttgcttatcaataactttaaaaatacttagtttaaaaggttgagaacaatatgtatagatttgtctttccaagaactgtaatacggagtaaaagtaaacatgtatttatttattgtgtatattataataaaaaataagattaaagatatattttgaagaccatattattatctaaaacattaagaattacgaaaccggagagagtatatgcccctgggtttgatccccgccgccgtggcctcccattcgcggcgttcctcgtggagggcaaaggaggatgggatgatgcagtcgtcattcaggggatttattttttttattagcaagtgtcattatcttctaataaaatcagggccagctatggggcagtacggatggtgcgactgtactgggcctctaaaaattaggggcctccaaaatatgtatactatggtatcaagcctgataggcttagagaaaagacagaagaccaattggcgatcgagcatatcgtgactgcttgattgtattttaaacttattagtgtgaaattcgttaatgacaatgagtttttaaatattatcttatattttttggtgtatgggggtctttttttttttccgcaccaggccacaaaaagtcagggccgtccttgaataaaaccctcactctgatatgctaactaaaagttgcctgctattctcttttctttacataagcgtagttgttcagtaactgaacctggcctgatggcattagtgctagtgacttattattagcagtggagattaagaaattcagcccaaactgtctacaaaggcattagaagtaagaatgttatatcgtaaatactcctcctgttttcgaatgtaaaatgttttagtttaaaacaagttaattatatttctcccttatggccatatcgcaaaaaataggatacaccagtttaccaactttttctaggaagtgcaaaaataataatccatgaaccaataaagcgtaatagacaacgaactcagaaacgcacttcaatatttttaccagatcagtggactacaataagcccatctaaatttccattttctaatattgatgacatatatagggtggcataggagttctgtagaggaatatatatttaagagtaaattgaatcttgggtcactcttttttgccattgttgcaatttggattaagggtaaacaaactttttcaccttagaccacgtatcgtctttactggtcgtttaagtttggactatttcttctacctctagctccccctctctcctctctttctctctttactcatgggcaggaagaactgttgagattataggtatataatgatttaatatattccataaataaatcatggcattacagatgtatactagcattaacgcatcattagatctacacatgtaaactatacatgtaaactaagctgtaaaacataaacagatcaaatatacgcaacatattaaacacgtaccgaggtgatagaaagaccggctgctcggcaggaacttttcgcgattgcaggcgtcaacgaaggcgcacagcatgcgagcgaagaggatgacgagccgtcacggacgaatagggagcagtcgcgctaaacgcttcccaaaaaccttattgctgccttctcctggtgcaggaagtcgaaggcagatgttccggagacctggtctcccgatcgccggtgcacgccggcgagcgggatgtagtaatctacgagcgacagcgcagcacagagtaggaggcaaaccctagattgatttcgcgtgtgttgcgtgaagacggcaggtcggtttatatagagaagggtcgcttgatcagggcgcccgcacgatctccactatgcgtaaccaaaccggataagtcacgcgtaacttatccagactccaagccgttttcacgcaccggatttttcggaacgtttccaaaacagaaacgaatccgaatttgcagcaaaacaaaactgcaaaaggaggctgcatctgcgcaaggtgaggaatcaattttggcggaccattcgacgtatacgtcgtgcacgcgcgccgcctgccctgccaggccaggcgaggcgagcgagcgcgcgcgtgtgttccccctcttctctccaccacacatgcttcaagtggctaggaagacatcctcccttttaaggaggtcccctttcctagaataagcaaggtggtactaaactccacatgcatgccatcccatgaggtgggcttttgtgattttctaaagaattaatcttcgagtgggctaaggcccatccattaattccaacaatcccccaccaaatgtcaaaatcccactgagatttgcctttaccaatgtactgtttatataccagcggttcgatggagaccgattaaggttgaacatccatctagaactccaagctacacttactcacaacttgaacaatggactacgccttgaattgcaagtcttgtgcaagcaagtttcactcaaagtcttatctggtactagatcgtctgtacactacccctcgggtggagcgtataagtcatactcctaggtctttagtaagcttcctagaagattcacccaaaatcttcatagactgcgaccaacagtcaagctcacaaaggtgagttctttcaagaatgctctgcaggacagcatcttcgctaattaaagccaacagaactcattaaggtatagccaacctgccttgcagctcacgagagtacatgcatcttcacttagagagggtatatattggtactctcctctagtttactaatggtttgttcttcccaggatctaatttacgggatctccgatcacatagactgggttaccaccatagtataactcacatgggtctcaaacccatctccttcgatgtattgtctatcacatttcgtgatagtcccttcgtgaagggatctgccaggtttctagttgtttggatgtaatccaacgttataactccggagtttctcaatttcctgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagccattctgcctcaacagtagcagtatccagtgccgtcaactccgcttccatggttgacctcgtcaaaatggtctgtttgcaagatctccacgaaacagcaccaccacctagtgtgaagacatattcactagtggctttgatctcatccacatcagagatccagttagaatcactatatcattccagtaccgcagggtacctagaatagtgaagccccaattccatagtacctttcagatagcgcattactcgctcaagcgcacgccagtgatcatctcctggattagaggtaaaccggctcaacttgctcacagcaaaggagatatcaggcctagttgcactagccaggtacatcagcgagccaatgatttggtagtattccagttgattcctagcaattctcttgttcttgcgaagcaacaagctaggatcataaggtgttggagaaggcttactatcaatgtagccaaagcgattcgagatcttctccacataatgggactgcaagagtgtaatcacattctcacctctaattagcttgatgtttaggataacatcagctactcccaaatccttcatatcaaatttttgagacaagaataatttaacctcatttattacctcaagatttgtcccaaatatcagtatgtcatcaacatacaagcacagaataactccctcacccccaccatggcgatagtatacacatttatctgcctcattgactgcgaagcctgcagatgtcaatgttctatcaaatttctcatgccattgcttaggagcttgtttcagaccatacaaagacttcaacaatttgcacactttgccttcttgaccttcatctacaaacccatcaggttgatccatatagatctcctcatccagctctccattaagaaaagctgtttttaacgtccatttgatgaacgagaagaccatgtgaggctgctagggaaagtagcacacgaattgtggtcaatctagcaacaggtgagtaagcgtcaaagaaatcttcgccttctttctgagtatagcccttagcaacaagtcgagccttgtactttttaatagtaccatcaggcctaaacttcttcttgaacacccacttgcaccccacaggtttacatccatagggtcgctttatcacttcccaagtcccgttagcgataatggaatccatttcactacggacagcctccttccagtagtctgcatcaggagatgcatatgcttctgaaattgacttaggagtgtcgtccacgaggtacacagtgaaatcatcaccaaaggacttagccgtcctttgtcttttactccttcgaggagcttcactgtcatcctccttagtgacatgttcatgtgtatgttcagtttgttctggtggtgtgattgaattggcaattatttcagaaggttgactagaactactatgtgtatccttcgttgggaaaaaggtagcatcacgagactccataattgtaccaacatgcatgtcaggtacctcagatttaactattaaaaatctataggcaatgctgtggtgagcatatcccagaaagacacagtccacagtcttaggtccaagtttgcgcttcttcgttattggtacattgactttcgccaagcacccccatgtgcgcaagaaagaaagtgatggttttctcccaatccatatttcatatggtgttttgtccttatttctgttaggaactctgtttaacacatgattcgaggtcagcaatgcctctccccaccatgccttaggtagtcccgcggtgtccaacatggcattcaccaagtgtgtccaacatggcattcaccaagtcagtcagtgtgcggttctccctttcagcaatcccattagactcaggagaatagggaggcgtcctctcatgtataatgtcatgttcctcacagaataagtcaaactcgtttgagaaaaactctccaccacgatcagacctaagtctttttatctttctatcaagttgattttcaacttctgccttataaattttaaaatagtctagagcctcgtctttcattttcaacaagtacacatagcaaaatctagtagcatcatcaatcaacgtcatgaaatatcgttttccacccttcgtcaacacctaattcatttcacaaagatctgaatgtaagagttctagaggtgccaagtttctctcctcagcagccttgtaaggcttgcaaggttgctttgattgcacacaactatggcacttagaacctttgacaatggaaaacttaggaattaaacacatgctggaaagtcgagacatcaagccaaaattaatatgacataaacgtgagtgccagacattagcctcatcatccacactgccataaatatggttcatagactcaaattgtgtttgagtgcagtaccgaaacttctccaagatggaggaagtttcgcaataatgcacccggccacaaatttgtcgggtaagacacacttaaggagttcgaattccttagccatggtttgtatcttatgagcctgttcgactacagaacggttgtcagccatcttgtagtcgtgaaactgctccatgatatacagatcattgctagcatcagtagcaccgaatttagtattcagtgcatcccacaactccttagcgtcggtcatatgcatatacacctcgaccagacgatcgccaagaacgataagaatgcatcccacaaagagagtagtgacttcctcgaattgcttctgctgttcagtagtaagaactccttcaggtttgccagtactcacccagaaacatttcatagctgtcagccacagagtgaccctgatctgccatctcttaaagtgcacaccggtgaatttatccggcctcagtgcatcggcaaaaccagccatagtaaaatcacagtgcctataataaggtttttggattgttgagattataagcatataatgatttaatatatttcataaataaatcatggcattgcagatgtatactagcattaacgcatcattagatctacacatgtaaactaagcagtaaaacatgaacagatcaaatatgcgcaacatattaaacatgtaccgaggtggtagaaagaccggctgtgcaggacgtcgaaggcagaggttccggagacctgctctcccgatcgccggcgtgcagggacgtcgaaggcagaggttccggagacctgctctcccgatcgccgatgcacgccggtgagcgggatggagtaatctacgagcgacggcgcagcacagagtaggaggcaaaccctagattgatttcgcgtgtgttgcgtgaagacggcgggtcggtttatataaagaagggtcgcttgatcagggcgcctgcacgatctccactgcgcgtaaccgaatttgacgcgtaacgtcgtgcacgcgcgccgcctgccttgttaggcgaggcgagcgagcacgcgcgtgttccccctcttctctccaccacacatgtttcaagtggctaggagggcatcctcccttttaagaaggtccccctctctagaataagcaaggtggtactaaactccacatgcatgttatcccatgaggtgggcttttgtaattttccaaagaattaatcttcgagtggactaaggcccatccattaattccaacaagaaccaccactacaagtgagcaggttgagcagccacctgccagtgccgtgcttgcgctggaactccgccagcaccagcatcaatgccatgtgattgaaaaatggcctaaggaccttggttgcacttgacagaaataaagaagataagggcagaagaaattccccattgccaagtggaggtaaagctcgagctcaactaccacgacatgaatttagatgtgaatatgtgatgttgctggagcacctccattgcaaggaaaccatcattgcgatggatttgggtggcagcgtccgatttgtgcaacagccacaagatggctctcatcgtggttgggcttgtcctgcatcatcccctacgaggatcagaccatggactgattgggggcgatgcagtaatgtgttcacctcaatggcagcaacccctcaaataggagttggccacagcggcgcagttcgtgatgtggtcaccactcgttgtcttcggtgaaacgagaagagacagataggaccttggaggtagagaacagagcagaaggtagaagaactagcctaaactgaatcaactagtaaagataggtggtttaatatgtaatatgtcactctaacaacgtgcaggtataaattcaactctacaattttttaacaaaaataacaaatttaactctaattattatacgtatattcacatacgtatattcacagttgaatttgatataacatgtagaaatcaaatttaaactacaagtagtttgtagaggtgatcttgtcaataatatatgacaaattttttcataattatttatttgtcatgtaataaatggatgtacatccaccctgattagaatcgactgccaatattgcgttaactggttgcaacatcgtagtcgcattctcgcagcagcagttacgattgagaaactcggttcagagcttgcttctcccagacccagctgtccctgtgggtgcgcgcctggaggaggaagaggcggcggcggggaggctgcccatggccttggcccgctcccgcagcgccaccttctgcaccttccccgtcgccgtcttcggaagctcctcctccaccaccaccaccgtccgcggcgccatgtatcgcggcagccgcgcgcggcagaacgccatcagctcctcctccaccgccgcgccgcctcctcctcctcctcctcctcctctcagcttcacgaacgcgcacggcgtctcgccccagtactcgtccggccgccccaccaccgccgcctcctccaccgccgggtgcccgaacagcgccgcctccacctcgaccgtgctgatgttctccccgccggagatgatgatgtccttggaccggtccaggatcttgatgtacccgtccttctcccgcaccggcaggtcgcccgaccggagccacccgccggcgagcgcctccgccgtcgcgccgccgtccttgtagtacccgctcatcaccgtgttcccccggagcatcacctccccgaccgtccgcccgtccgccggcacgctccgcatcgtcgccgggtccttcacgtccgccgcctccagcccgacgtggtggagcccctgccgcgacttgatccgggcgcgctcctccgccgtcagcgcgtcccactccggcttccacgtgcacaccgtcgccggcccgtacgtctccgtcagcccgtacgagtggatcaccaggaacccctgctcctccatccggaacagcacctgcggcggcggcggcgcgccgccggtcatcaccgtcaccctcctcctcctcccgcccggctgccgccgccgcatcgtccgccgtcgcgttcacgatcatgctcagcaccgtcggcgcgccgcccatgtgcgtcacgccgtgccgcgccacgctgtcgaagatgtccgccccggtcaccctgcgaacgcacacgttcgtgccgccatggtctgccacgccccacacctggcaccacccgttgcagtggaacatcggcacggtccacaggtacaccggcgtctccgccatggcgttcacgatcacggcggcaaggctgctcaggtacgcgccccggtggctgtagatcacgcccttgggcctcgacgtcgtcccgaaggtgtagttcagggcgatcggctcgttctcgtcggccggccaccggatcgcgaagtccggcgacgatccgacgtcggcggcgctcagaaggtgctcgtactcgtaatcgactcgggtgaccttgatcttggcatcaggaggtgatcgttcgttttcgtcgaggagctcgctgatgagaaccaagacgggacgcctggctccggcttcggcgacgagcacgagggctttctgggcgacgccgagcagagcgcggtcgacgaagacgaccttggcctcggagtggcgcagcaggacggccgccatggcggcgtcgaggcgcgagttgagcgtgcagatgacggcgccggccatggggacgccgaagtggagctcgcaaacagcaggaatgttctgcgcgaacaccgcaacctgcgcatgaaccaaaatgtgaatcaccgcgattaaattacagcatttggcatgcgaattcacagcgattttgaggggtgaaattaatgttactgttacagtggcgtggcgcctgttcatacgtaccacgtcgtggcgctggacgccgaggagcccggtgagggcggcggcgaggcggaggcagcgggcccgagtgtcccgccaggtgcgcgacacggccacgccggcgctgccatccgaggcgacaatagcgagacggtcggggtacacgagcgcggtgcgctcgaggaagctgatgggcgtgagcggcgcgtggttggcggagcagagcaccgtgccctccatcgatatcgtcgaactagcagtggagaggaggagagctgctgctgctgctactggagtctggagctcgagagaggcagccatggagtctgtgcatggctgcctatttatagcgcggcagccgctgcaggctagggtagtgaggtggtgggtggggggaggttggaatgcaagccgcagagtgcgcagaatcattgggccgcgttggttagttttctgattcattcagcggcgcggccgcccgccaaagcacactagcacagcaccggcacaatgagggttagaattagattccaatttcgatacttgtaaactactccctcactcctatcttaaatacggttacagttgacatgtatggcgtttgatctgtcttatttcaaaaatttataaaataaataaaataaataagttacatataaagtattatttatattttatcatctaataataatataaatagtaattataaaattttttaaataaaacagaccataaaacgttggatacggaaatttataactgcacttaggagccgaggggttactagtagtatagctttattatccatcttaggttacatgacagcattggaagccagatttcaggtatcatatcatataaaactactggtaataaagttggtgaagtgtcatcagtttcgcacatagctcaccctgtgaatggtcatccagcttgaccgtggatcttctcatccgagatccgacactagcgcccgtcctattcagaccctgctgacataagcactgagctacgcctacaaccgataagtcatgataaaataatcaaaataattaaaaaaaagtttatgaggaaaactactttcatttgtatcaataaatgtttaaaaaataatattgaaaaataaactacggtataaaaattttaaaatcagcactaaaattatcttcaaaattcaaattttaattgcaaccgataaatagataagcaaacaataaaagaaaccttgtgcagctctgtcccgtcaaatccatccaccactctgccgaggggacataaaacaaaaaagagaatcagtgcattcaggcatgtcccccttagaaaagtttgtttagaaaagttcttctagaatctctctccctatataaattatgggatattttaaatgtcatgttaccgttgatatgtactatacttttattataaccgtatatcatattgaaagttcatactccctccgtctcattttaaatgtaaccatgagtttttacgtccaactttaatcgttcgtcttatttgaaaaaaaaaaattaattactaccaccgttccaaaataagtgcagtcgtcgaaatccatgtccaacgtttgaccgtccgtcttatttgaaaaattttaaaaaaattagtcacacataaagcactattcatgttttatcatataataacaataaaaataataatcataaaaaattttcaaataagacgaacggtcaaacgttgaagatgaatagtgcaaaactgcacttattttgggacggaggtagtagtattttgttgttatgagatgacaaaacatgaatattactttatgcgtgacttacgtttttaatttttttcaaaaaattttcaaataagacggacgttcaaagttaggcacggaaactcatggctgcacttaaaatagaacggagggagtattaaacaagacatgcaattagattttttttttcaaaaccttggacataataaacatgaagttgttgcataaaaatcataaaactctcaacttagtatattgttagtatattaaaaaaatttgatattattggttaagaagttctaatttatgtgaaatgctcttaaatccaagccagtacattttaaaaataaccaatacatctagcatatttataacatactcccttcgtttttaaatataaagatttttagattattaagcaaatactaaggtttggttgtttagttatttcagttggaagttgtaattttgaattgcttagatctttttcctagcatgtgattggctttggacccattgaaacagtgatgggaattagcgtaagaatgcttatattgtgacacaaaatttgaatcatataaatcgttatagtttggattagcgaacaacaatatatgtaactcacggggttgatgtctaccttattcaaatagcataataatagcataatagtatctccattttatttatgaatgaatgatttaaaataacaaatgttgtcattattaaacaaatgattttttttctggccaaacaccccaataggttgcaggcaggtgggccataagtgttcacgtctacaaaaatcaacctccattttcgcatatcgcaggctcgcatgtaaaaaacaatttttgcaagcgggtcttttaacaaatcagatattttcgcatgcgaacatgttaagtgatatgcatggaaaaatcacccattttttattctccactcctccctctgtctaactcctcctctcccctactcctccttactccggatgactcctcctcttccctcgaatccctcccgacggcaggcaccagcggcaacgtcagcggtgggcgagggcaagggcgacagcaacggccctcaccctccctcacatggatctggcggtgggctcaagcgggaggccagtgcaggagcggccccgcgcggatccgtcggctgcatcctcccctgcactgatctggtagccgccgccctcccccacgtggatctggtggtgggcggtgaattagggtttgggatgactccggcggtgacaacatctggcagcagcgggctagggtttgggaataaatcagggagctagggtttcaacttttgaatttttgagattttattgttttcagacttttatttttgcatgtggatgacataagcacccatacgcaaaaatctgattttcatgtacaggtgcgtcacgaacacagaaataacgatttttgtagccccctaggtgcgtgcgggttgcccagcctcctgcaaaaatctaatttgaccgtatggaaaaaaaatacattttgtttcagatgggcaaaaaaaatcaacatattccctctattcataaacatttttatgttcaagacaagatttgaaagttttaaaacttgaagattagtgtacaaaatctattaagtacatataatattatatatgacagtaccttttcaggataaatctacatatagcttttttttttccaaattaagggtgagatgttattggtgatcaaacttttaatagtttggctgaattttactctaaatatcaaatatttatgacctttgggagtaatatgtaataagcttaaatataattataatgaaatgtctcttggtgtgacatgaata

SEQ ID NO: 12601 - DNA, 6505 bp, Oryza sativa
gttaacaaaaaaaatggtggaattcaaataaattttataaagaaattgatttttagtttgaatatataaattggctgatttactaacatggtgtctgcaactgatgaaaatgagaactcattacacgtttaaacaaaaaatgctataagtgcatgattaattaagttttagttattataaacttaaaaatatatttattcaatatttcatagtagcgtttatatagaaaattttcgtacaaaacataccatttagctatctatttatctattatatactaaaagtatattaaacttcctacaaacactcttaaaccgtcttaaaccgccatgtggcactcctataaacgtttctaagccgtcatgtggtactatctaatctcaccattgatttttacttaaattggtggacccgttattctacaccattaggttagatctattattgcgaaatatagaaacgatactaccgttctcaggtctcgtacgtacgacgtacgagtagtaggtgcaatttaaatttcaactgttcacggaagggaaaaaaaccatactacttcacaaatataatataaatatatatagttaaactaagatatataagaaaaacatagaatacccaataaatgttctttaaacaatcttctaaattattttgaaattatatatccaatttgtgatcatgttgtatttctttaattaaattataaaagttatattatagtcctaaatacaccatggcacatgaggctgacatatgtatgataatttttcaaaaaaatacatcatattttagggagggaaatatcacttcacaaatatacaacattaatttaaatctgcatatgtaaaaaataaaaacaacacaatttagttgtgtttttcaagtaggtctgattaaattataatttatttgagattaagattctcaaagtagctttatacttttagaactatttgactatatatatttgtcaaaatataaataataacatgatgctctggttattatcgtggtgttatgtctcattagatataattttttaaaaataccatcgaacgattgacctcagtcatattcaaaagagagtattctatctatataataaaaaaaatgagttgtaatgatcaacaacataaacaaatcgtgtctacactgcaccacaaatctactcaaaacatttttaaaaactactttggtcacctccatcttctctttgttcttccctaaaggacaccaaacatggacaacaaagtttattatggtgtcgcaagtttagtatggaatatacggctaagttaagacagtcccagtggagaccaccattgctaatagtactcaactttctacttaccaatgcaaaactccatgagtcctatttcattctttggttttccaaaagtctaaatcctatttgtagtcactatgtgctatattaaattttttatcggaaccaaaaagtcattttaatacttattgcttgcatgttcattggttttgtcacatgatgaatgagttgactacaccttgatcttagtgaaaaagaaatataacttagacttttggaaggagggagagtacattaaaattatgctccaagctggtcttcaggagcatggctatatcgatgcgggacccatgtttcaaggcaatggagaaaggaagtcttggtggctatgatcgactttacccatgatgatgtgaccatcaagtatatgcatacatccaagcacgagaaatataaaacatggctaaagaatacatcgagtgaatggaggatctacaagatattaaaatccaacgagttttggaatctagttcggcctccagagatagcactgacttcaaacggacctagcgccttcatgccaactccgatttgggtaatcttggacttcatggaaagattatctctctacctttcaaacgcatctggtctcatgtccaaattcatctcgagtcaacgggaatcgccaaaacaagacagtgctgttgctgaaaccaaacttgagccttaggctttgtaatagactaggcccatctcggaagtgtctccctccacctccacgaattagcacttaaccctagctttgttttcctctataaatagctttgtacatcctaaaaaaacaattgggttttgtttagttgaattttgccaagtgccattcactttgtctctagtcctcgctcgattagtcggcgactattgattcagagcccccaatagttggtgtgttgatttgccgggtcaattagatctactacttcaatcgcaactattcctttgtgcttaatcacctattcgcaatatttagattgcatcttatcttgttcttgtagtgttctctcgtttgcattgcagggatcatcaaccgcgtatcacggttggtacgacatcgtttgtggtgtaacgattgcacggcgtcctggacttgttctggttggtagccacgtcgcaaacgtcgcactcgatcaaagcgagagttatcccctcaccagaagatcgggccacgagagagagcgtcatcacatgagagtagtattcatgtttaactttaatggtgatattccattaatggatagaagtggtcgtatttttacaatatttttaaatggatttagaaaaaaaaatgagacataaaacgtaagtagtggataatttagtgtattaataatgtattaggttttagggtttgttgtcgaaccgacaactgcatcacgtcgaaatgcgtggttctctcaatagtagttggaagtaaacacaattgtattacatagtgaaaattttttaatctccctattacgtggccttagggggctatttatagccctattacaggttcctcctttagggtttaggttttacaggggaatttacatggttacccttatgatagggacattattgggggcacacagtgtcctttacatgtatgggcccctattaggctaaatagctcggccaatttatttggcaaaatcccccgaaagcgcaatggcccactgggcctccttacggtggggttcggtacttggcgaagcctgtgccttcgtgccaaggctttcacctcaccgtcttcgcccatgcggccttctaacgaggtctttgcctggcgaagcccgcgtgttccgagccacggttttcgccatgtggctttcgcccatatggttccattctcgaccttcgctgcttgcctccggtttgagcctgtcgcctaagttcttggtttcggtagatctggccgaaggccctttgtggtgtacctccaacagggttaattggttttaaagcataatttagtggtgacaatatgagaatttatatgtcactcgatcaaagtgtatttttaatctgagatatattcttattattttataacatttaagtagaaatagtgagatgtaacttcttttatcattatttttataaaacattcaataagatgcctgcgcatctacgcgggctttctttctagttttagaaacatgttaattgaaattaaggtagaatttgttcttgaccagaagaacgggccctaaatttatcaatgcaaactgacttagcaaggctaataacgacaattatcacatcatgcgtttacatgtacggttggatccatgccataacaaatttaccatattagaaaaatgccacccctattcgtgatatcagttgagtgccactggaattttgtaaaattggatcaatgtcatcgccgtcacagtttccatttttcacatggaccaaaataaccctgaacgtgggacccacacatcagtttcatcttcttcctccatcctcctctcttccggagggcatgacgatcctcccgccgcctctctccaatgggaacgactgccctcagcggcggcgcgcggggagaaggctacaaccacagcggtctccccccattagatctagttgggaagcgaatcggtagcctcgtgggcatgaagtcatcggcaagcccaatctccccaagtacactctcccattccgccggcgagcctaagctgctcctcgttgatttcatgggcatcgctgatgagtaggaacgacatctagtggaagagctcattgatgacgagggaaggaaatgccatggccgcctcaccctgtcgccgcagcccacggatagccatggcccgtcatcgccggcatcgtcttgccctctcgctgcatgaggacatccatggctcgccgcccgccatcgctgtctttccctcttgccgccctcacacatccatgcccgcctgctaccatcggagtcaccttgcccacgcgctgctgcggacggctgtggcttgccacccgttgttgctgcctttccctctcaccgcccccacacatccatgcctggagaggagaagagcgcctggccgacgaggaagaaggagaggagaataaaagaagagagaataaggagagcatgacggaaaatatgacgacgatggtatggatccaattttgtaaaattttagtgacacccagctgatatcgtgatttgcaaatagtaatagtatttttctaaatagcaaatttgcaatgataggatccaattaaccctaatactagtagtagtaaaatagtactaataattaaatgttcatcacttcagtcttcagtggtaataaatagtcgagcccagcacaggcctcaggggaagcgaaactatggcgaacgcggggctgcgcgcgtaccgggaggtgctgcggctggtgcggcggctgccggcggacgcgcggccgtactacgccaagtacgcccgcgagaacttcgtcaactaccgcgacctctccgctgacgacgacctcgccgccctcctccgccgcgcctacgcccactcctcctgggtcctctccaaggtgggtggtagtacggtacctaacctacaaacacgcccgccgcttgagcggagcgcgcgcgctcgctcgccttccaccgcatcggcgtgctggttcaccgctctttgctgccttgcagtactcgatcgacgcggatgctgcggcggggcggctcaaggaggtgtgcggcgccgagggcggagcgtgagcacgcgtgcgcgcgaggtgttcgacgaaatgcttcgccgcgtcatgccagcgtcagttagctctaccccgttgtttttacttgccttgctagcggttggcgggcatttggacttcttgttttttgcaacagtttagttgatagttgataaaaatgtgtggggaataagttgaatactctgcttctgcacaccgtattttagtttgatccctgctgccgcctgcctgtttcagttggtgttgaactcaatttgccgggattagcaaattgcgtgtttaactgtgggataaccaagcaaacacactttgcaaattttgttggtcaaatctagatgttaaattgcctaagagctccaaatgattttgagatagaattacttttgtgaagagtgtgctgtgtgaatacaaaacaaaacaaaacgaactaaaactactggcaaaccatatttcttgtgactagtgagtgtgcacgtgcaaggcacgttgaaatgtaggcgtataggcaattgtcaaagtttctgttgtagaatgtgcacaaaggtcgacttataggcatataggttagttaaagtttctgttgtagatcatgcacaaaggctatgtgaagcattaggaggagcgccaattggtgctgcaagtcccttttgtatctacctcataatcatttgcctcttcaatggcatttttaatgtcatcgaaagtccattgcaatgatcattattagcagtttatctttttttttagcaaagggactgagccctccatttccattaaagaaatgatgtagctaatacaaaggagtcatcccatttaagggttcatgtcttcagaagtgaaaaaaacagaaacacaggtgccagagctctttgctcactacaatcattttgacctgacaaaacaaaagatcttctacttgcaataactcccagaactgaaccagactttagctgaggattccggtccacaaaaaaaactctatcttctgctcttttttgtccatccagcttcatgtgttgtccagcctgcacacgctcgatctccatccatatcttgatttaaagacttcacttgttacctgctttaggagcttggctccccaaagcaactttctttgcctttcctccgaaatctgtaaaataccccaatcggagatccaattacaagcagcaaacaaaatttcagaaggatcagatggcagtttgttattctatcaactccaatcagcagtagctgtgatgtcattctatcacagttttttgttcaattctccaaggtttgatgtaaatttctgattggtttaagatcaaaagcacaacaaaccatattccaggtaaatctagccatagggcaatcaaaaatacaaattctgcaaagtctctttttttctcacagaattgacatgtttctgttccttttttccatcctctctttctcaagttatctttggtta

SEQ ID NO: 12602 - DNA, 2687 bp, Oryza sativa
  unsure (1)..(2687): unsure at all n locations
ttttttccatcctctctttctcaggggtttttatctttggttaaaatcctattttgcatcatcaagcccaacccaatttaaaaagaaaattcccttgtaatttcctttttaaaaaaaggaattttgattttccagatttttttgtgtatccctattggcctggggattgtgtcatgtgttttcagagctttataaaaagatttaacactaaactctccatttttttgtcaaaatccattttaaggtgtctctccctcctggtaatattaccgtctcacataagttttttatattgatccagtctgcaagtctatctcctgtcaaatttcttctgaaagtaatagactcccaccctttgtttttaacagaagttaaggtcactccatttgcattggtaattctgtatagattaggatatctttcagccagagattgcttccctgtccatttatcctcccaaaccaaagtattacagccattccctaaggatatttcacagaaatgaagttttcttttatctccatcaatccatgccaaaaatgggaatctccctgcttgattttttgtgctgtaagtggtttcttttttagatatttttctcttaacaatttttgccataaagcatcagtattctccaacctccacagccatttccccagaagtgtcttgttcatagtttccaaatccgaaatacccaagccccccatgtctctaggtgaacacactattggccattgcaccaggtgatattttctaatcccctgatcttcctgccaaaggtatcttcttctaaagtaatcaatcttttctagcgccccttttggaattctatagaaagaaaacatatacagaggggtactgctcaagctagagttaattagagtaactcttccaccaatagactgaagtttcccttgccaacacccaactctcttttctattttagcttcagcttgtttccagtccttatttaagattcttttttgatcaatttgcagtaaaaaaatgcgaagagaaggattgcgaagcgctaatcggtgctaatctggcgctaattgcagtgttaatccgacttgtaatttacattgttagattagaggatccaacggttagaaacttctgggtacacttttctgggtggatgtaggaaagaaacaactggtactttttatattagtatagatgactttagccattggttgctggagcggacacaaaacgtagaacgggatttgagattagcattcacatcaatgaaagggcaccatcatggaaacctgaaaacaaactgaaacctctcatgcttactcggaaatctaaattgatcaaactcaaaatcaaagtaaattcaggaagacacaatgctgtcacaattcatcaaagatgtgtttcagcaaaaagaaccaagcgaaaagagaggagttgcatagaatgctatttaacagatcacacaatttaaccaaaaaggctctccagtggagatctgtgtagattgaatgaacaaaaaaatctgcatttatttaattgtcaaatacagcagcatttcttgagatgaagttattgcctctgctctgcctagtatgagctggttacaacttacaaggaacttgttacattttctatgtaccgaatgaaaataaactctatatatgagactacaccatcttctacgactacatctaagaatggcatcttcttcatctcctctggaagttgaacttcatgattgcaaaactgaacaggaaagcgaacatcacagtgaaaacaacatgcacaacggcaacaagccatagtaagtcatgatggaaaccatagtattccgtaatgaactgagccacggtttggtctttgccatcaagtttagtttggatatttccaaactgggaggcaaccaatccatacaatgtccatgcaacagggcaaatccaacagtaccacctccaccagacaggaattttctgaatttgcgagagttaaatgcatgagtcacattagaacaatatggtaatgaaatctaaatgaaaacaaaaccatacgcggcaggaaagtaacctacaggtcgaggtataagatatcctgaaaagaggttccatgcattgtagattgctggtgaaatgatagctgcaatgctctcgtttggtgtcaatcctactgccatcattccgaagaacgtgaaatacagcaatgtgaagtacatgaagaacaggtaccaaatgaacttagcaacagtccattcaaacccaatcattgagtagactagtacaccatataccagtgtctgaactaggatgtatggcaattcgatcgcaacctacaaaagagacaaggaagtgaagttagggttggagcccaaaagaacttatgacttttaagttttatgaacagtagtgaatagttcttttcattgaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12603 - DNA, 827 bp, Oryza sativa
  unsure (1)..(827): unsure at all n locations
tttgaaattagatcatttttttaaatttgtgtttttacaaagtacgcgaaggtccaccctcatggacaggaacaacgcttttttgcaacatatattttatacgaaatctatgctttctgtaaagttaaagcacactaaatctaaagcttaatatacaaccatgccacatcatcacccactagcaataattatatatttaatctcatacaagcatacaaatgatctacaatttatttaattatacaaatcaaaatacaagcatccaaccatcatccgtctccgtcatacatttgcacaatatttcaacaaatctatctattacttttacaatatttaacatatacttatcaatatgtttcacactaaagcacgagtattatttgactgataaaccctaatgttttgttttttttcttcgtaatcctagtttgattgtaaaaaaaacatattgagaatttcttagtaaattttacaacaaagcacgggaaagcgtgaggaatcacctagttatactatagttatactagtttcattgtttgtcgaaccacagtgaagaagaatctattgattaatagcaccgggcttgaaatcggtgcatttatacgcactcatgtgactgctgcaagcctgcaacggacaataattaaaatgaatgaaaaaaacgaacggtacggagtttacttactgttactggattataacaagctggtctgacattgcgcttattcttctccgtatcgncattgaccttgtctacaactaggtattgtacttgcatcctataaccacttactccggagcaagattattgcaacaagtacttgtca

SEQ ID NO: 12604 - DNA, 616 bp, Oryza sativa
attttattttaaacacaccgacaccacatgtcgggttttgaaggcttcacaaacccatttcccaagttttcgacaaacaacggtgtatgtgggttatttggtatacgcgctcagagagcacgaataccgaggtaccacaagggtggagagacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaagggtgacttgccttgctcaaggtcttcacaaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttatgtgaatactggaagttgaacggagtcaatcggaccagcggttggggagatatggatttcctaagattatttggattttctgtctaaaggaaaaggatttatcaaatcctttggaaaagaaaa

SEQ ID NO: 12605 - DNA, 905 bp, Oryza sativa
tgaaagatattctaatctatacagaattaccaatgcaaatggagtgagcttaacttctgttaaaaacaaagggtgggagtctattactttcagaagaaattagacaggagatagacttgcagactggatcaatataaaaaacttatgtgagacggtaatattaccaggagggagagacaccttaaaatggattttgacaaaaaaatggagagtttagtgttaaatctttttataaagctctgaaaacacatgacacaatccccaggccaatagggatacacaaaaaaatctggaaaatcaaaattccttttaagataaggatttttatgtggctgatgatgcaaaataggattttaaccaaagataacttgagaaagagaggatggaaaaaaggaacagaaacatgtcaattctgtgagaaaaaaagagactttgcagaatttgtatttttgattgccctatggctagatttacctggaatatggtttgttgtgcttttgatcttaaaccaatcagaaatttacatcaaaccttggagaattgaacaaaaaactgtgatagaatgacatcacagctactgctgattggagttgatagaataacaaactgccatctgatccttctgaaattttgtttgctgcttgtaattggatctccgattggggtattttacagatttcggaggaaaggcaaagaaagttgctttggggagccaagctcctaaagcaggtctcaagagaagtctttacatcaagatatggatggatatcgagcgtgtgcaggctggacaacacatgaagctggatggacaaaaaagagcagaagatagagttttttttgtggaccggaatcctcaactaaagtctggttcagttctgggagttattgcccgtatgaagatcttt

SEQ ID NO: 12606 - DNA, 754 bp, Oryza sativa
  unsure (1)..(754): unsure at all n locations
cgtcgccgggtccttcacgtccgccgcctccagcccgacgtggtggagcccctgccgcgacttgatccgggcgcgctcctccgccgtcagcgcgtcccactccggcttccacgtgcacaccgtcgccggcccgtacgtctccgtcagcccgtacgagtggatcaccaggaacccctgctcctccatccggaacagcacctgcggcgacggcggcgcgccgccggtcatcaccgtcaccctcctcctcctcccgcccggctgccgccgccgctcgtccgccgtcgcgttcacgatcatgctcagcaccgtcggcgcgccgcccatgtgcgtcacgccgtgccgcgccacgctgtcgaagatggccgccgcggtcaccctgcggacgcacacgttcgtgccgccctgcgccgccacgccccacacctggcaccacccgttgcagtggaacatcggcacggtccacaggtacaccggcgtctccgccatggcgttcacgatcacggcggcgaggctgctcaggtacgcgccgcggtggctgtagatcacgcccttgggcctcgacgtcgtcccggaggtgtagttcagggcgatcggctcgttctcgtcggccggccaccggatcgcgaagtccggcgacgatccggcggcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnattactgggctgca

SEQ ID NO: 12607 - DNA, 629 bp, Oryza sativa
tgaaatagcaaatgcggtatggtcctgtgatttaagctggaagatccgatgctgtgttgggaggcttggacacctttcacattctgagtctctcaagtaggtttctatactacagggccatcctgtacctgttgtttcttgatgtgtagagtatgtcaaccttgcttgcttgacatgtttccttaagttctccatgttccatgcattcgacgtaatacaaactgtagaccatccttctgaaagaagggctcctagcaaaccatgtacatcccaagtgaataacccctaattaacttgctgttgtggacttgtggttctcttttgtgtcatctttgtgtatccttcatttgcggtgattgttggctgcttcccttgcttgtatgtgcttttccattcttagaattgcatgctaatacactgttaatgcacccaaatttactgaccaatgttgcgcctattgattaatcttgaaagttgaaaccaacaactgttgtgttcttttttgcttagatcaccatcagatggaatatgacatgctacctatatggtccatgtaaaacgactctatatggttggcttcttggattctttagacaatgtacggttaggcgttttgatgtgcttagcgc

SEQ ID NO: 12608 - DNA, 36849 bp, Oryza sativa
gaagtagatccatcaaacggaagaccttttcacttgctccaacagactgcatcagagaggaccagttgtctccaatccaccatgttgacaaaattagccactcagcatagagtatgaattttgtcagttgctcagcagttagcttcccagccatgatggatatccctccaatcaacactgcaatgacctacacaaagcttatttgcaagaatacatcatcaacggtacaacaaattcatatcagaaccaggcattttatattttacaaaattgctaatttaaatatgttctgattggagtatcattatgaattgaacagaaacatcaaactacctgagtagaatggtatagatagttcaaactcaagctccagcctccataagccattgtttgccgaaagcttacatcatatagcttatctagccactttgcatatctatcagagtacaaggcatcgtgagattttgtttttgtgtgtatgtatgagcgtgtttgagatagagagagagagagagggaggtagagattgccttttaaactcctgcttttctgttccataaacccgtactgtccgaaccaaacttatcacctcttgagcaacctgatttagtttaatgtgaaaactgagatgaaaactttgccttatgaaatgctaccttcatccaaaaatataagggatttttcccatgggacagaggaagtagcttattgtaaagagtacaaacttacattgttggcacttgcagtgaactcctgtgcaaatttggctgctcttttctgatacctattaatcacagtatcataatgatttctctcgcatggatcacaggtgttaagcaacaaaataaaaacgtggtggtgcttccttgaactttcactactcaggtaatgtaatatgaaagacagctaacacagaaaagggagagacaatatacaaggtaaataagagtaggtttttaccgtccatgaactagcataatggtcgacaatgtcgcacaaatcaacatagtgcacattccaagtggccaagataagactagcagataaattagtgcgcctacaccctgaaataaagtgacaaaatggtacgtgagtttttgaagctactggttacattttcatacaagactactaaacaaccttttcacctgaagcaaattgcgtgagataagattaagatcattgccaatgactcgtgacacttgctggcagtcagaaccaagcctacttgtcaaatcaccaacagtttcttcatcaaaaaaagcaatgtcctagcataatttaaaatacagttaaaagcttcatacttgggtcaaccaaagtaaaacaacagaaaactttatgtacattaatgaaatttctttcagcagtaatattttttattccttttgttttacctgagaaagaatagaatcaaacagcatttctctcattcgtttgacctacggaaaattttcagatgatgaaggttagagactggtcaaacaaaggggcaatcgtgaggaataaacttggaaagttacattaagaaatctaacatggttttaccaatatcatgtttgcaacaccaaaacagcagcttcgcacaccactgcaaaattggataccagctagtaagcaaccacaattgatttttcacaaaaaaaaaaaaaaacatgcagaagacaaacaattttggtttcaatgcagattacggagtatcttgctaaatgcctatagtgcatttgacaggacactggtaaatgtagaaatttgtatttatgctaccctatagtgccatgagctaccaaatcgattcatcagcataatagaagattttcaatattcagacccattgaagctcaaagcatttccattcctgccctagatttggactaccaacacattatatgatattacattgtcaaccacaccatccatggaagtgatcttatggacctaaacgtctaacgaccttttcagttttcaccacaacaacaatgtgatcaggtacagttgtattgtggacagaaatacagaatgcatgcttgaaaatgcaggattaccaacttctttggtttttccgatgaatgcagcatcacctacttgttggcttctctaatgatcgcgttcacgacttaagcacagttttaacaaagcaaagaagcaataactgacctaaacactccggaaatcaaacacagaacaaccagaagcttagcgttccggtagaacacagcccctccgttctgcgccgagaagatggacgctgcgaggagatggggtatcgcgatctccgcgagctgcaaccacaaccacacgtcaccgcgttttagacccatcaacgagaactctgcagcagcagaggtcaaacccagaaatcgccattaccgcagcgccgacgagggacgcgaatccgacgaagacaacccatcggtcggaggcgacgagcgcccacatccgcctgagcgcggaggcggccgtggcgccgctggcctcggcgcggccgcccccggcctcctcgccgtcctcgaggcgccaccagcttcccccgggcagcacgttccgcagccgctcgatgaactccccggcgagggcgcgccgctgggccagcccgccgaactctcccccgatcgccgccgcggcgcggatcctcgtcggcctcgcccgccccggggccctcctcgtggccgacgccgaccgcagaagcagcgacggcgccctgggccccaccgtcgccacgcccaccgacagcgccgccgagccggtggccgcggtgaggagcagcgccgccggagtcggcattctccactctcgtcaaaccccctctatccctcccctccacccccaccgcccgattcagattccgattccgcgttcgccggtgagagagtccgccgcctcggcgagcaccggcgaggtttaaataggcgtacgccgctgcgtcctcgccagagttggttgctctgacgtgcgcggcaccggcgccgtaacgtctctaccttctccggctaaattgtattttttccgcggcttttttaatcctttttctcttccacttttcgcgtgtgcttcttttttttttctttttcctaacgtgttttttttttgcgattttttctacgagaagaaatggatggaatgaggcgatgtggtgtggtggtggtattttgggggatttaaaacaattttctggaggagaataatcgtcgttggattttaggattggacacggagaaggattgaaagaacggcttcgtgcgtggtcgtggcattggaacatgaggtcggtgacacactgacacgggatgttagagaacaggtggtggtgccgtggtggtaggccctatatagactccatcgtttgtcatggagttgaggtagtgtttgtaaagtgctcccggttttaagctttaaagtagtgctactgttgttgtaaaaggtcaactaaccacttataaacgttgcagtatgggttagtataaaatattatctcgatcacaaaatatgaaaatataaccacatttaaatagattggatctatcgtactatgaatctagataggggatttgtatgattcacccgttcaaaggttgctatattttgaacgaacgaagaagtaatttaacatagagcatgatgatatatgtcacaccacaaacatttcagttcaaattttatcttcacgaggaaaaacaagttctaaagaaaagctggaattgaatgagcatgggggcatggtacgatgcatgggattcgatcttcgtcaagagcattttcttacaacatattccattcgtttcaatttgatcgtcacccataatagccctactcctattgatcagccaatatataagcgtggaactcgagcatagtggttgaggttagctgttgtaagctacgagattagaggtagcttgtattgtgttatctctgtttcttattggtggttccccactcttctcttgggccttgtatttctacactcaggtgccatcttatccaagtagaagtgtagaactaggatgcaaggatggatacgatccgagtggtcttggtcgggtcaaagtacgattgtattttttttctttatcggggactcctttattttctactacggactctaatataacatacttgtttccgtatatataggacttggaacatggtgctcccaccgaggtatgtacacgtatgtagaatatcctatatttaagaacagtaaaaaatattatgttgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcaactagctctcggtgacttggctcctcgtaagctccggcttcgtaggctgtggagattgtgttggctctgagattcaatgcctaaaccctccccggggggccccttttatatcgcagatctggaggtctccacatagaactcggagatatcagaccctatacgatacgccaacgacccagttctgcctaagtaggattcttcccatctgtagattccgtaaaaggtttccttagaatatacaggaaatatctgcatgcgcgtgggtatgccatatcgatatgtaacgtatatcgaagggtaaagggtatgcctaacccgtaaccttgacagtagcccccgacttctgcttaaaatgaactcgtgcaaccatttgcgacttcgggtgtcgagactattgtcattcccggtgcgaggaccgcggagatagaccgtagtcgagcacgccatttgaagcccaacggtcacgagcgaattttaaactgaagtccaaaaaactgccgcgcgtaacgggaccagaaatttccggcgggcatctctctctgttccctggaattcgcaccgtcggtagtgcgcctatttaaaggaattttgggaatccattttgaagtccgccaaatctgttaaacacacaccacctgcaagcactctttgccttctccgccgccgcaagaaaccctagttcatcaacctaggctcgttttccggcgaccttcgatcagcaacggacctcggcaaatcggcttccaccagtgcaacgttgaagaaactccaggaggatggcgctcttcctggccgtggaaccatggagagtgaagcaggaggtactaatcctcagcccatcttgggtcgcatggttgcgatcgaagattatgttctctgcggttttctccctcctccttccgaatttcttctcctggttttgaatttctatggtctttctcttctccatttgaaccccaattccatcgccttccttagcatctttgtgcatctttgcgaggcgtacatcggggtagagcctttccttgatctttttcgcttttactacgaactgcgttggatggaatccaacagggtatctggttgcgtcgggttccgacttcgggatggcctgaagtcgcgttacattcccttccagtgcccttcttctcgcagcaagtggaggaataggtggttttatcttgagatcaaggactcgaaccctgtcttcgtggttcccggagatcaaccggacaagattccgtcttggaccgccaagccccccttgaccccctctcttcagtcgtttattgacatcatcgacgatctccgagtacgggggtttttcgggatatgaagtcgttgcagacttcgttggtaggtggatccagccgcttcaggctcgggcccatccagcttataactattccgggccaaaggacgtgacccgagtttctcctcggggtatctttctcgcattcatcttgacatacttgtgttcgcattcctcttgacttatcgtaggatggttctcgattaacaggtctgagcggcgaaaccgtggagcgtcgcgtcggccaagtgatgatcagcgacccgaccacggcgagtgacatccctgtgcccctttgtgaaaagggggcagcagaacgtgatgaagccatcaacgtaagtatattcgatgaatatcccgcattctcctttcgaaatcactttatgacttgattgagcgtaggcccttcctttgactgatatcatcggaccgctcacggaccatcaggtggcgtcatctctgaaagtgaaggtcgtcaaggaggtatctgatgctgccaccactagcggtggcaatgttccaacaaagccgaggaaattctcgtctgtaagcggacaatgtcgcaaggtgtcgaccccctcggtaatttattttgttgttaaatcatgcagcaagaaggatttttccttactttgcgttgattgtattccaggcctcagatgcgtctcccccacctccacgacgacaacgcattgtgacgatcggcgagaagtaagtagatgaattcttgaatccccgcgcttcttatttgattgttgtctgactcgtggtcgtcctgtagggaggcgcgggcaaaggctgcgcaagccaagtccggaggagcttccagtgcgtcgcccgtcgtggcctcgacggatgtcgtgcccgcagccgggagccgggaggcgacgcctagtggccccgtcagcgaccccgcggcaggtcgtgatctaccagttgcagtcctcacctgggaggagctccaagtcgagatggggcgcctcctcgaagccggtgctcgcagcatcggccgcgaaattgcggaggcgaggtcggaagcggcgacggtgaacgtgcgtgctgacagactggtgcgcgagttggctgaagcccgtgaagacctcacgaagatgagggagttggcggctggcaacgagcgacaacggaaggggcttgaggaccgaatgtcggaactcgggaacaacctatctgagatctggggctcgttgagggtcacctacaccggccttcaccagctcgctggggaatgcggcgtcacgtccacgatcccggcgaatcccgatgagttttcgctgacctcctctctcgcggaactggcgacggcaatgggggaaatcccctccaagcatgcggccaggattgcggaggagacgtcaaacggaatctacaccggggcgtgtcatgtcctcgcgtgtgtaaggctgtcgcgtcctgaactcgatctgcgcgagatcttggaccagggggcggccagcgacacgcgtaaggaggtgatggaagaagtcggtgatctgggggagtctgttctccccctttttgaagagtaggacttcttgtatttcctagataatgtgtaaaactcgaactctgaccgcctttgtgagtgcgattactatcccggcttactttggtatgctgacctcgggaacttttgtcctcttgtagagatattgatgacgaggatgtccagcagcgcgggcagcccgagtcactggcagtaattccggtactcgagtttgaaccacacgtctcgcctgaccatgtggatcaaccccttgatatagagggaaggatggcgacgacttcctcaggttagtagtcccttcaccccttaatgcccatctgactaggtcagccatgttcccgaaagagatgtacagctcgacttagtgattatcacgtttagcagatctcgagggtgcccttgctagccaagatcgtcgtatccaatactggaagcgaagtttgaagtggcggagctcgagagaaccatgctggccgtgaagaaagagcaggctgtggaaacgctccgaggccgtgaggtatggtttaactcgtacttgaagagttgctgcacatccatggccagagtatgcagggagcttcgagtagtccgcggagatcccgatgagtcggcggccaggtacatctcgtggcttaatggggcctgtgcccaactcgatggaatcggtaagcgtatcgacgaggccttgaagcaggagtgtcgtcgatcgagccgatatgccggggggcatgtgttggcttgcctacgagatcatcgcccgcacctggacctcgaacatcttcgtgagggttttgctcgttctcggagggctccggcggagatagaccatctggcaaggtcaatgtcgttctcccatcttagcgacgaatctgcttagtgctgccatgcatccggttagcttttgtacctccttgagtcttgtaggcgacttcatgttctcgattgccttgatcttctcggggtttgcttctatccctctgccagagacaaggaatctgagcagcttgcccgacggtactccgaacatgcacttctcaggattgagcatgaggcgatatcgtcggaggttgtcgaacgtttcccgcatatcgtcaatcaatgagttgcctgtcttggttttgacaacgatgtcgtcgacgtaagcctcgacattgttgccaagctggttgctaagtgcgccctggaccgtgcgctggaaagtattcccagctgttatcagtccgaacggcatcttaacatagcaaaataccccaaatggcgtgatgaatgctgtcttctcttcgtcctcttttgccatgctgatttggtggtagccagagtaagcgtcgatgaagctcaataactcgcaaccggctgttgaatccaccagttggtctattcgaggaagtggaaagtgatccttggggcacgccttgttgaggtcggtgaagtcgacactcattctccattttccgttggccttccgcaccatgactggattggctagccactctggatgaagtacttctctgatgaagccagctttgagaagtttgtcgagctcttctcgtatggcttgttttcggtctggtgcaaatctccgcagtctttgctttactggcttggcatcgggtcgcaccatgagtttgggctcaatcacctccctggggacccccggcatgtcggacggccgccaagcgaacacgtcggcattgtcgcggaggaaggtgatgagtgcgagttcctatttctcgtttagtgtcgccctgatcttgacggtcttatcggggttggcactggagagtggaacaatcttgatggcgccgtctggtttcggcgtcttgtttgtcttggtcactttcttgggtggctcagtcgtggcgggtggactgggcgtttgctcgaccatgtcgaggctccgcttgtcacattgcaccgccagctttgcgttcccctgaatagtgattgttcccttcggtcccggcatcttaagcacttgatatgcataatgagatgcggccatgaacttcgcaagtgtagttctcccgatgatggtgttgtaagctgtatcgaattcagcaacatcaaaggtgatctgttctgtttggaagttgttggcttggccgaaagtcacgggcaacgtaatcttgcccaaaggtctggacgatgattggggagtaattccatggaagggttgatcagttggtgtcaactcgttttgtggaattcccatcgcgtccaaagtgctggcgaaaagaagattgattgagctgccaccgtcaatgagaactcgcgctaccttgatgttccgaatagtaggttcgaccacgatcggatatcgtcctgggataacggcggtcttggggtggtcttcttccgagaactctatcttctgctcagaccacttcatcttgggtgtagccccctgtcatgtcgaacagacttcatgttccactttcttgtattctcgcttggaggagtacgttgtggaaccgctgaagatgtgtgagacgtggaggtcggagtctggatacgctaagtccggttcgtgaggagccgtctcttcgttcgtctcgacaacgcgtactcgcttgcctttttcaaatgccatgtgcttctcgagcgactttttgaaaacaaggcaatcttccagagaatgtctgtccgtcttgtgtatggggcaccatgatttcgttgtgtcactgctttgtgggtctgggcgtttgggagggttcgcgtattctgctgcgaggacttccgcttgagctttccttttcccgtttttgcgatttttcttcttgcttgactcagatgtgtccatggctggtttcttctctcccccggtcttcggcctatcgttcttgcgtcttagcgcatcatcagcgtgggcgcatcgctcaacgatctcgaataatctccgagtggttgtgatgcgtcttgtcgccaactcctgggtagtgtagcgatctctgacaccggatttgaaggcgcgaattacagaagcatcgatgatttcaggaattgtgtttctgcactcgttgaaacatcgaacgtattccctcaatgattcactctagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacatggtcggtaaatagtttgctaacgcgttgtcgtctgcttcggcagcatagagtactgtggagtagacttgaagaaactcctctgggtcggtgctcccatcatacttttctattgctccgggtcagaatctctcaggccatcggacatcacgtaaggaacgaccgaaagccctacacccagcgttgggggcggtgggttgccggcggtcgtgtgtccttcgtggatgtctgtctgacgatgaggaggaggcggatgatgacgatgacgatgggtcgcttggttccggtgtacgattacgaggatgacggcctggatctcgacaatcctgtcgtcgtcttccgctgttgtctcggcgccgatctccatcgtcgtcgtcgatacggcggcgaccatgaccagtattgtctggcacccgtcgttcgcgatcgttgtgatcgtggtggttgtcgtggtcccggtcctcgtttgagcgatttcctcgatttccgttatcatggcgccgtgaagagacatgacgccgagagcgattcacgttgtctcgtgtgcgtcgtgcttcccggcggccgttgatttgatctcgaagatcgccagtgccgcgaggtggaggggtagcttgttgaggtgattccctccgttccggatcttcaccattggcctctccagttggtggctgctcctggtgtgctgcggtagcggcttcttcaaacgcgttgctgaggttagtcaccgattctcgtagacgttctgtccaacgctcgaggtcaacgttcagaacgggatcgtaaggagtttccctcagtatcgcttgaacggccctgatgtgctgggctggagtagtcgattgattccccgcttctgtgttggcgtgcgctgacgtgccaacgtcatcgatagccaatacctcccgcggcgcgctcgttgtcgatgacccatagtcctcaaggagatgtaagaccgatggttcgtgaggatcgatatcgattaccccaacgaatcaatctgaagttggagtcgctccttgttccttgccgttatccctgatggggatatatgacttaggagactgagctttcatggcgccgagaaagactttgcagctcgagaggacatgattctttgtcttgtgaataggacaatagacatcccgagttggagaagtacgctgaattccacgttctttgcaggcgcgaatttcagcacggacgttgaggaaaacccagcaatcttgcagggtgtgtttcttggttttgtggataggacaccaagaccttgtggcttcgtaagtcatctttgtcggctcgtggttcatgtcggaaggacaaggtttggccgtatcagaatccttcttgagcttggatgtcatcgatattccgttctccgtctcgacgggaggatttttcgacatggaatcgccttggttcgtagccactgcgttctcgtctccggtcattggaggaccggttgagatcggtgtcgtggtgtaaaccgggaagacgatttcgccgacttgagtccataccagcattgttgaagcagggagtacttggctgaggctggtgctgacgttgttgtcgacgaagctggatgacatagtagtagaaccttgagtaccaaggacccctacctggcgctccactgtcgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcgactagctctcggtgacttggctcctcataagctccggcttcgtaggctgtggaggtggtgttggctctgagattcgatgcctaaaccctcccggggggggcccttttatatcgcagatctggaggtctccacatagaactcggagatatcagacccagttctgcccgagtaggattcttcccatctgtagattccgtgaaaggttttcttagaatatacaggaaatatccgaatgcgcgtgggtatgccatatcgatatgtaacgtatatcgaagggtaaagggtatgcctaacccgtaaccctgacatattatttaaaagatattttacatgtatgatttacaaagtggatcatatataatagacttactaccgtaaacgtgtggatagccaaatgggtcgcccgactcggcccgagcacaaccaggccgaggctgagttcagtcaagtcggcacgacctgacctacacaccaggacgggccatgcccgtccaagtgttgcaccaacagcccatgaacgactagaaggcacgaaagcccaccatgctcctccttggaaaaagtctattttgtctccctgatctctttgggccaactctcatatggctcaaaataagtatattttgaatccctcatctctttgagccgtgtcgagccagcccatcgcgccgaggcagaggcccaagcacgacccaaaggtctggtcgggccaacaagggcctgactgcttgggccaggcccaaacccatgccattggccgagccgtcgggcctagggcgttttggtcaactatacttctttccacccgatgtactttgattttttttatttttaatatatttttgaaaataaactatttgaaaacttattttcagctctgaacctttttagcttgccattttaactgacatggtaggacaacgttttggcactttcaacagtggcgtatggtaatggcagtgaagggagaaaataaatcgcggatggcaatggccaaaagatttatttttaaaagtaagattttcatagggtttgttttaaaatttttagttaataatggttagaaaaaagatcgagctacttagccaagcctcataaattctgctctgttttctccctttagtgaatatactagtagcagctagcagagctcctgtttgtcttatgaaaaagaaaaaagaacagagaaacatccgcaaatgtaacatggcaagtttcgagtgtgagaacgagttcaataggttaataaaaggaccaattggataaatttcccataagaacggttatggtcgtatactaaaccaagtgctagcccgttaattaatttggtcaaacgcatgcgtgtaagtactatgggaagatgctctctcaaaaaaaaagtacaacgagaagataagtttggtgataagccagctcaatgcatgcatacgaactttgatgccgaaaaaaaccttatcaaattgtcaaaattttggtatagtgactggcaggatttcttatatagtcacttttttgacaactttaccaaaatttgataaggttgaaaatggcatcaaagttaacaggcccgaaaattcccattagtggctctttactgaaccagtgtttttctaatgttgacttcttttcctcgactcaaaacgataacttcctcatttcttattactacatattctcgaactgctaaaatatacatcttatataaaaatcgttgtacataaaattttttaataaataaataaataatatttctaatatataatatttaatatgtaaacaatcatgcgctaatgatatgttccgtttgggagccacaaatagctctagccaaactacattcgaattaggactaacaaactttatatagcgaggttcacataggtcgactcaatctgtacgaatacaaacaggagctcatgcattcctacagaagagtgtcctagtctcttctctgatctctcttgtacatctgatcctctacatttttttaaaaaaaaaaagcagtgtaacttccggctcgaaaggagctccctagccgttgttgccgctgccttcccaaacatcttctccgccgatgccgctaatgttgttgtcaagctacggtggcggtggcggtggctctctctctctctctctctctctctctctctctctctctctctgccgcccaacaacatcacgaagcagataaggtcaaaactcggccatcaaaatacaaattggattggactacgttggcttcgctgccatgtccaacattacttgtcatggttgcctaaagccctcatcactaggtgtgatgcaaaattgattcaatctggtcgtgcttgccatggccgttggaggatggttgttggctttgtttaaaactgagcatttgatgcttccttcctccatgtttcaaatagaaagtgtttcttccattcacctgatagaggcaaataaaggaggccaaagctccatcctgatggctacactttgatactatttggtctttgtcgttggtgaccatatgaggatgcatgctactcaggtggtgtcgtggcaacctccattttgatcgggaagattggtcagcgattgttgaaatcggtttagaagatccatctttgattttttttatggtagcagttaatttcttgtccatggtgcactcgctttaactagaaggtggtacagagtgcaagcaacaatgactccagggtgaaaaccttgagatgtaatctaaattcagcagtgtcagctcttgtttgtcatctcatcgttgaaggtgtcgtttgaagtgttggataaaaatccagccctatttttggatgacaatgtggtagacaggggccaagtcgttctcgaaggtgcttggatccgagtaggtgcataataccgaggtttgttttcgttacggaattgctaaaaaatcgtgcgatagtttttttcaaagaaatttgtcaacgcgctttaactagaaggtggtacagagtgcaagcaacaatgactccagggtgaaaaccttgagatgtgatctaaattcagcaatgtcagctcttgtttgtcatctcattgttgaaggtgtcgtttgaagtgttggataaaaatccagccctaaatcgatcccgccaccttcatttcactcaggtgtctcatttaccaccaagctagcattgtttttgtgttccaaacccagttacgtacaacttccagggtgtagttacaatgtaattgcttcgcaaaaaaaaaagttacaatgtaactggggtgtagctagacatttttttgccttaaaatctgttgacagcgctataggtagacccttggtaatgtgtgttgagttgctccaagataatatatgtctgtcttcgccttcccccccccccacccccttattcggaggacccaaaaaaagttgtctttgctagcttctcaccaactaaaagcgccatatcataatttgaatatggtagatggagttatattttcacgactttatcatcgcaccagtgatgttttccccttccgattgttcactcgatgcatatgccatgataagatccgctttccactttttctctgggggatgaataaaccttccatatatgtcccaatgtaaggtatagctatagctagaaaccatgcgcacgaacgaaattaagaaacgaacgcacaagaggacagggcaccaatagtacgtaccacaccactaccaatcattacaaaaacatatcataatgtaggaaaagctacaaaatatatacactaattaatagcatctataatgttgtccctgtagatatctgcattatgttcgcgcaacagcgcaccacgggatccagaaagaaattcgccgaaacaggcacatcattgccttatccttcacgaacacaacacacacctaagcctctagatagctatatccgtctatcgctctacctatcctgtccccttctttccttcctcccataaaaaaacaaggaaacaaacaaaaaaccaaaagggaaaaaagtggaaaaaagagaaaggcagaaggtccatcaacatctggtcgctcgatggggtgatcgatcaagcgcacacagttccaatcatgcatgtgactaatgtctacgcgacgaggctctgcagtgcgcgcgggcagaagctaaggttaaaccctgtttggtagagctacaactcctaaattttgcttcaggagttgagtctggagtgaagttatagagctatctaaacccaactccacatctctaatttattttgtgagagaactccacccagctccgatcacattttaagtggagcttaaactgtttggctgagctctaactccaggagagatggagctagagctgtgccaaacaaacccttaatattatgagaagttagtatagttaagaatttggagaagctgacaaaccaagcttccagtttttgtgtcaatttctagattctactgctgtagttttttagaatccggataaaaatttaaaatctgaactgtttaaaaaaaatttcagtagctagagattctacgagaaattacggctgacagaagctcccaatcaaacccgagataagatgagaagatgcggggttacgtggcgttgtgagagagagagagagcctcgaagcggggccaactagtttatcataaaaccgagcgtgccatatcgccttgtttccacaagcccttagcacatggcgcgctctcgtcgctccagcctggcagagtgaggcgaagacaagagatcagaattcagaagcagctagctctccaccaaacaggctactcttttactttagcttggttaatttcgtccagatcaagaatcttgctaggtggagagatgcaccaccaggaatcaattaacctgtgcaaggggttagtcaaactcaaacagcttgggcgggtcatgatgagatcatgcatccttggtccatggaaatttggccatgcatgcatgtgcaggcttgtaatattctagacacatgcatgcagggatggtcaatgtttttgatagcatatgcagccgaaatgccgaaattaatactatatactctagctagccgagatgggtttttttatgtgctagtattagtagatccacacaaaatatgcatgtaaatcctaaccagatgctcggctaaccacgcagaaagaaaaaaaaaaaaggtagtaactatattaaaaacatgatcctatgtctgcttgttagccgcaatggacacgacgattaaggtaattaattaattccataattcgatgcatgtacaggacgacgacacactacaggggttcaacgatgaacaaccaaaccatgcgtacttaagcgtcactggtacggggactacgggttactgatcaaatatcatccctagctagcgctacgattcacatgcacaacttaattaatttttttaggaggttttaccatcggttataatacggagctagctagctaataattaaccttcaaatggactgaagcttgctgctgctgctgtcatctgtttcttcagatgctaaccgccatctggctcatggaggcggcggcggcggcctcctggcgagaacgccgcacgccgtgcggggacttgcccttgcagccgccgccgtcagccttgcctgccgccgccgccgctgcggcttcggcactgtcatcgccgccggtgccgtcctcggcgccggcggcctttgtattggacgagacgccgggtttctccggcgagccatgcttatgcttacctaccgcccccgacgagttgccttgctcctgcgccgcgcgcctcaccttcacaccacgtatcagctgctaataattaagagataaattaagattacggttaataattaattagctgctgcttgcagaaattaacagaagtactccataaacaaagatactgccaaactggtcatccgaattaaagacaaacagtggcatgcagcaactatatatagcttattggcactcaaaatcacatccaactgagttgagttaaagagtactcgaaagaagtgggaagggcaatgatggatgaacattacatatttgcctgacttgatatcggagtagatcacaatgaaatcaccctcctgcagctcgtttgaacgaacaaaatcacctgaaaaaacatatgacaacgattaatcaacaatacttgagagccacaaattaaggatggaagttattggcatggcttgtgactgtaaaatttgaataattcaaaagtttgctattcacctgtgttttcgagaagatacatcctgcttttgttgttgggccaaaacctgtgttcatgaaaatcaatatccattaatgtcagtgaatcaaaatctaagccatcatgtattcgaataacttgtgcatatataatattgccaatggaaataattaaattaattaatcaaaaacatgagctcagcagaaccagcaaaaatcatatgcataatgttagtactgaaaacagcaggaaaagatcacttttatttttttgttgtatgcacttgagcatcaacatagaacacgatgaatgcatgctcctatttgactcccagattccaatgatatgttcgtatgacccacttgcccaattgggaaagggaccatcccatagtcatttactatttctggttcagaggtttctatcccctcccaattaacaaagaagcaagtggacttaaacaagcttaataagcaatcccaaatcatgcttgatgcttcgatcgaatgttgattactcaccggtaccgcatgttccacacctgagacgtcccgatgtcttccatggggatggagacaccatccctcgtcttcagctccggcaggtgaacctctgcttccttctgaaaccatccacagatcaagaaaggggagactttttagttctaccatgatcggaaatgtgaagagaaggttcaggcaaattccgtctttgattaggggagaaacatcaagtatgtgagtgtgtgcaagtgggatccttccatggaatggatttgtgccaagtggggtagtggatttggaaggagaaggtgttcgagatggtggtgactgtctcactttggggagcacgatgcggccgaggctcccgacgtcgctctgcttcagcaccttctgcagcaggaaccgcaggttcttgtccgtcttcgcctgcagcaatccaatcgatgccgtttaattagctaggttgataaatattggagattctatccctggacagcgatgtgagtgagtgagttttgagtgtgtggagtgtgtgtgaggaggagaatcgagttctcactcgcgtgagatcctagctatggtggatagcgattgatgtcaatcgtctgcatgcatgcacacctgccgcttctctgaagccgtcgagcgctgaaggctctccgctccggccgtcgccgccgcctgcggcttcggcttcggtttctccggcgagggtttcggctgcttcgacgtggcgggaggaggattgggcttgtttgataggggattctggatgatctgggccgccggcggccagatgccccagctccggcagccggccgacgacggggtgaccggcgccgagtgcgcggcgcgaggggagggctcctgtggatggccggagatgtggatctggctcaggttgagctgctggctacgttgctgctgcaggcaggagaggcggcgctgcctcgccatccgcttcttccgggcctcctttgtcgaggacggctcgactccggcgaggcgtggagagcacatggcgtggccgccggagtactgcccggggaatccggcggtgaacggcggtggcacgaccgacggcatggtgtaggagctcgtggaggagacggggaacggcgcgaattgctgcggccaggccatgttccctccgcccgacgcatgcatgtcgcccgccgccgccgcggtcggcggggagaacggctggctgctcacgaccacgctgctcttgctgcagctctgctggaaagggaacgggccggcggcgcctgggtacatggcgtcgccgccgtacgcggctggcggcgtgaaggcctggtagggcatccaggatgtggcggcggcggagcccatctcctggccaccggaggggaactcgtagccggggtttgcgccggggctggggagctgagggtccgacgacgcggcgccgtcgtcaatcgccgtgcgggggcgcttcttctggaggtggtggttctgcacccaggtgaggatgagcttgagcagctgcatggtgccctggcgcccgccgccgagccgcgcggccgccgcctcgatggtggatcggcggaggcggatgctgcggaggtcgtcggcggagatgtactcacggttgctcgtgagccactccatgaagaacgccggcagatcgtcgggcgcatcactcccctccatgcatgcgtcgccggcgtcgtctcctcccccggccgcctccatcaccgccttcgtatcgccgtcgccggtacagtcgtccgcctgatgcggttgcccggacatggcgtcctctatcatcatgccaacgtcgtccgggaacagcggctgctcggcctcccacgggacggacagcgacgcgaggtcgaggagctggtctatgtcggcgagctcaccaaacccgtccgccgccgaggccggctcggacggctcaccgccgcaaccccctcccgccgcggtggtgaaagcgctggacgagttcgacgacgacgacgacgagaaggttgagcttgacggggaagaaaggcacgggaagtccgggagcaacgggaaggtatcgtcagcgaaaaagacgtcatccctcgccgcctcacccctgatctccgccgccggggccttcccccgtccgccgccgccgccgccgccgccaccctgcttccccgggttcccgtgcgagtgcggcgccgacgagccggcggaggcgtccatgcagagtggaggcgggcggggggcggagagcgcgagatgtaggcgaggcggggggtttggctttgtttgtctgtgtgcgtgtaggtgtggaggtgggtgcagttactgagaaaggagacgaacaggagaagcagcgggaggtggagggtgggagagtagagagagaagagatgcggctgcggcccacacgtggcggccgccgagggctgtgggaagcgctccaccgcccacgccagcctctcctcagcgaccgtacctttcgccccccgcacggcacggccacgtcccactgacccgtgggccccacatttcctctgggcccacttatcattgctgggggctgcgtttctggtgggtggggttccccttttttttcctgagttgtaacggtcaatgacagtggggcctacgtgtcagtgggaagtacgggatttcggcgcgtgctggttttgaccgccgcggcagagggggagggagaggagcgttcttgcctgtggtccaatgacatgtgggacccaaaaggaaaaccatagagtggtagggtcgtgtgcgcgtagcgatttatgcgcgccgtaggatgtccgtgtcgcgtccgcgccgactaaggggctacgcgtccggtgtttccgagccgtccgatccgaaccaccgcgtgatcgaacggacgccatcttcgggaggagacctgtgtgctgtctggattaggaatatggggtgcgttttttctacgcgcacgtacgaaacctacacgagctggagatgatgacgtggaggtgtgggtcgcaccttggttacgatgacgtgggattttaccattggttgcagtggaggtggcccgtgtgaacacatgcagcgaacggcccagctcgatcgatcaccagcagccgggaagcgtaagcgctaagcagaggcatggcaatgccatggcatacgtgatcttgttctggccgttgcgtgtggaactgtgggtggagcatttgctttgtcttgttcgatcggaggatgcggctaggtaggatacatgttttgcaggggtaagagcaaatttccactttctctttgcttgtttgcttcgcaacaaatgcatttgaaaatgacagacaggcccccaaaatcagattaaaaaatatgttttctttggtgtccttagtgatgaggagcacccaaataacccatgcgacatcatccaaggattttattttttttttgcaagtttgtactttaaaatgagccaataaatctataatacacatttacgactacgtgtccttttcaatatccgtggaatcaattgatatattgattcatggatgcaaacaaaaacaattgtaaattttgggtcattgaacgatatatatctctctaaaatattatttatatcaagatgacgatatgcatgtatctttcattattaattgttcgctcaagcatatcgtatcctttcgagggaatgaagcatcgaagctcttgactcacatccaatacattgtctaattcaataattggatttgaacatcaaatatattccatgcgttgtgcaatttacaaatcatttttaattagtattttactattctcaatctatattatcgataatatgtattttactattcgatagcaactgtaaataaaggtcgttgggtgttacaggtcaacaatcatttgagcgatatggtaggttgagtgtttcccctatgttgttttggcataactttcatattactatgacaacaaggttattttgaagagttaataccgccacgtccattgtgcatatttataaaaagtaactatcaaaacacaactaaacccgtagcaaaccacatgcatatatattgaataagtgattttgtaaaaaaatatttatagattttgatatatgagggatacttgtaaacttatgtatataactcagccatgtcatcatctcaaataattttagacaatcggattaatatatatcacatcatttatacactgaccattcgattggaaaataccggtttgcaacattggaatactactatactttagtcatgattgatacaaatttcgatttaaaagtgtagttgcatgaattttgattcatgataatctatactgcaattatcatttgcattgtgatatattcatgattgatgacttcgatgctcggccacagggtttgtagcgcgcaatctatttgagcgtagccatgtagcattgtaccatgaacatatcaatatgtggtgacttcatgcattaaaagaagatggacacgttgtaaccacaatacaactttcttatctcccaacaacttatattacgtgcggacgtatataaatacaagaggctgcaacaacattttggctctttgtgattcattgatccgaggtaaggtcataaccttacaatggttcaccaccatgtatttttcgaagtacacccatgactacatctatacacgtacgcacggtgtttcgataaaacaattttgctatgagtatataggcttatggttcactgaaagacacacactaataaaaagacacaagatttggctcgtgttttggattcacgaataaatctggaaaatattttcaatgacatataaaattttctactatccccataaaaaaatgtactaactttctttgatcatggaaattaaaccctacaacaagattaacgcatatactccatctatctcgatatatatatatatacatatatatacatatatatatatatgcgatgttgttaaatcttagatatatatttgattttattatgtatataacaaattaaagttattcataatatatcgtaataaaagtttgtaataaaataaaataataattatataattttagtaagataattgaaaatagcgtaactgtatcattcgtgttagaataaacagaggaggtactcctaattcctttcactggagaccaaactacatcatcgactcatggcgtcgtaccacagaagcactagctgctggcaaagccgtagatcagtgggacgtggcggaagccaagccgtcggatcatcccagcgaggaaaccacccgcgaccgcgacgacgcaacagcaggaaaacccaaaaccggtcggactccacagcgacccctccgccacgaagcagcacgcaccaaaaaaagaagaagaagcgaagcgggggcgaattgaggcccaaatacttgggtggggtggagggccgagcgcgagagatttcggagagcagcgcgaatcccccaaaaatccacccccaaatcccaattccaaatccgacctccctcctcggccagatctcgccccctctccccggggggcctccgatcgaatcggcggctgcaccgcggccggcgattcccgggaggaggaggaggaggaggagtaggaggaggggatctcgccgagatttggattgggtttggtggttgggtgggagggagggagctggggggtgtggccagccatggcgtcggcgcaggtgtcgtcgtcctccgccgccgccggtgcggcgtcgtcgtcgtcctcgcggaagaaggatctccacgcggggaagaagctggtatgtctgttgcttgcgatagacgtagtcgttggttacccgatgttggtagtttaaccttctggaaatgctggatctttttgtccagacacgtttgattgaatagggagcattgaccgctttgcgttagagatgtagttccatcgatcgttttgcttatggtagagaagtcaaatgcgcgcaaattacccccgtcatcagcacgctcagtttgaaatgttgaattttcgttacctagatcttgctatttcatcaactgatcctgagtgatgatttgatgcgaaattaagttcaagttggttgtagaataatgatgtcgtgttttctgatatatccagctggcggagtaccgtaagaagaagaacaaggcggcgaagaaggctgctgaaactgcagaccaggcaacggcgcctgttcctgatacactagagaaccctcctccaaatgccaccagtactaactcgggagacaagttggtatcggacgtggatgtgaacacaacaagcacatcatctgtgccaccagtctacgagaatggcccaacgagttattccagaggtgacgagcccttgtcaaatggacctgcccctgtaaatgtgccagtcagtgttagtaatcctgccccatcgcatgatgtcagtagtgttggagggagcaagatttatgggaacttgagcttctctgacttagttaatgggcataatgaggattggagaggcgatgctgctcggaaaagggaggaacatagtcctgacaaggacgtgactttaaaatctaaattgagtgcctttggaaactcagatgaggtctcccattcttcagatgaggtcttgctgagtcagggaagaaatccagtcttgagggaagtaagtgacactgagcagtctagttcatattcatctggcagcctttttggaaagttagaaggcacgcaaagtcagggttactctgcaaacaatgatatctttggtcggttccgaggtatatccaagccctttttcatattaaattatgctatctgatgagtgatgataacttgaatatgtggcacttttaactctttacttttgctgctatgcagccacctctaaagactcttcccaagcagatggcttagcgtatgccagcagccgggagtatggaagtgccttcaataattcttggaatacatcaaattccacacctgtttgttttgataaacaggatccttttatgtcatctggttatccaactacatacaatcgatctcggccatcttttcttgattctattggagtacaaagagctccaacaactgaagtcccatacgtggagcctgcaaaggctagtaaaccatttggcaactcgaattctgagagttcattttttcagccaccaaatcaacaatccgctggaagcaatgatgtggatggttctctaaaatcaggaagacaagaatataacaacgagaagggatcatatggaaattccattcgtactgattcctttccttccaaagatgaacggaatctgcaccatagtactcaaatgttccaaaacttcacaattcctgggaaagatgatgattttgctgcactagagcaggtgatgagtgctcgatctatgttttcattgtctgtgctttcttgaggatatataatattttatatgtatgtcaggaatgacctagtaaaattggacattggacatgatattgagagctgtgcatttattaacaaaatctaaacgcttatttatgtttgtttgaattgatgacgcttacacctgaatgctattgtacacaaaacaaaagtttagctgaagttatgtctgtactagccatatgtccaaaagataattttaaaaagtatatgcttcataatatgtaacaacttgtttgactgcgtgctgcgtatagttactgttctgcgtggtgcagcttctgggtctatattctagacagaacgtccaaatcttgtgatggacgtgccatattctactaaattaacagccttatccttgattatatatttttacttctcctgaattgcatgtactttttgttatttacgagtatccgcatcctactcatgtctgctctggtttggctgttagctcattgaggatttgacaaaagagaagttcgccttacaacgtactcttgagaaatctcaagaattggctcaaactttggccacagacaactcagctttgactgataagttcaaccaacaggtatttccaaatctccattttggtttttggagttggatctagtatcctcacaaacttttgccatttattatgcaagtccacaacagaaaaacactttcttcacaattaataaaccagtttctgctataacgtagtatttcaatgtcaaagtttcattctgcccgtttctctgtctttccttgttgctctgccttattcacggtgaatgatattcaactagcataacatgcttgcaaaagtgtctctagcaactagaaaatgctaaatgagaatggaatagctaagcaatcacccaaaatttaccttacagtcaatacttcttatctgatcagtaaatcatcaattcttttacagcattggtataaggacagaatcaatactgattagtcatatttccagtcacttattgtcttgtgtatcatatttattattttgtttgcaaatgcttaggcacaagttatcagcaacctgacatctgacatggagagattgcagaacgaaattcaagctcaactggttaggcttattccaccttttctagcaatcattaagattctgtaattccatgcttgctatgctgacatgcttttgttctgttggttttttagtagtactatcgctgtgtaatttggaaatataatgtgctagttgcaagacatatgttagcatagaatatgacttatgaaatgtagaatgtctccggatatgaggagctagggaatgagttcataagatcacatggttcactatgtacccagcatgcacaatatgtttagattttggtgtttgactaggcaactggctgaagtatggcgctgaactattgcttgctaaatgcctaattcatatgaaagtatctccactaaatgtttaggttacttagtgtacatttgacttactgatgtttctggtagttagcatcatctgtgcactcagtgctagtatctatcaatatgaaacttatgatttagggccagtttgaatgtgcatattgcctgagcttacttaggggcacgcaacacagaacatgttatcagtgcattattaattaagtattaactattataaacttgaaaaatggattttttgaagaaacttcatatactttttttttttgcataaaacacaccatttagcagttcggaaaatgtgactaacaaaaaacgaggaagttgtagtttggagttgaagttttctcataatttgtatagttttcttaccaactccaatttttcaacagctggcacttgagtctgtcagaacggaatatgctaatgcccagctagaatgcaatgctgcagatgagagggccaaagttcttgcagcagaagtcattctacttgaagataaggtgcttagctatatactcgtctgcttcctctctaatgttgcaaatcaacctaaccttcttagtgggataataatattgacactgtttatagtttttgaatgctcattattttgagcaatgtttttttggagtatgttattatactataccttgagtacattaagccctagaggtgtcacaggctcacagcaacaaatcaaagtataatgacagatatcctatacacctgcaggtaggtaatgcctattatattcaagttttaatgcatcagatgtaaatatataatatcccttgatatgccaaacatgcagctgctgtttttttatctaacacttctctttaaggcactatttatcaaaagcgcatgcagtttgatatatcgctattttttaggctcttagactgaggtcaagtgagttaaagcttgaaaaggaaattgagggtttgagctctgagatttcttcatacaggtgaggttttctgctatgagtgcatggtatgtgttttacaaggtggggagatcaattgataagtgaaatgggcttcaaatataaatgtgaaagaaagtttctggtttttctcacattggcattcttgaaattgttatgcgaaaaaaatatgtgagtcttgtgttaacatgcaaaaaacatgacatgagtttaagtttactgaactcacacactgatcatccgagggtactgacagtgtttcctttacgattttcttttactatgcacaggcgcaaagtttctagtctagagaaggagcgtcaacatcttcaatctactgttgaggctcttcaagaaggtagttaccgttttactctgatgtaaaacttttttgaactcgttctttatcccatgcccaactcaattatctggtgagtcctagaaaatcattagttgtgttcacatcttgcacgcacatttttgttccctattatttaagccccatactcacacatcctttagtgtcacttatttttggctgtcaaataactaaaactaaactagaaatttatctgtaatattctagttggaataagacttgcatgtgtgtgatagacttaatttatgcatgaatattgccggttgtaaacttgacttcacattgatacttttggacagaaaagaaactcctacactctaaattgaggaatacttctgtgactgagaaggtcaatattatagaaaaaccttcagctgataaaagagatgcatcaactgcaacagaagatctaggtatgaatgttgatctccccttttgtttgatatctatgaatatgtatttcaattttcaactagtagtctgcttgacacgaaatatgcatcttcagatacaggggaaagcagctcttcagaaacccttaccagtgccattgacacagtagaagatggtgaaacatctgtatcgcggtccaataatgtggctgattttacttatttagaagaggtgtcttctagcatcccacatgatcagcttagaatgatcgacaatatcaactccttgatgtcagaggtaatctctttgatgtgcaaaaatccagtgtggttggtactttatatcacttacattgatcgattgcacctaaataaccttaaaccacagcacttgagtttcatagcctacaaaatttacttccttgttaatagtaattgttgcattgcagttggcagtggagcgagaagagttgctgcgagctttgagaattgaatcatccaattgctccaagctgaaggttttgttcatttcgcagcaactttgtttctactatttttgattcattgagcctatatttcttcctgtccagagcttcgatcgacccaatataaatgcgatgcatgtataattaagcactaagcctctagggtatacaaatgcctagggtcttgtatagttgcccaagggactatcccagctggcttaacctaccgggccctttcctccggatgaaatcatgtccaaatcgagggctattgtgtactgtaactttgtcatggtgtatctatcttatgcagtccattctttgtcttaaaggaattgaacaaggatctaacgcaaaagctggagattcagactcacagacttgagctgttatcttctcaaaggatggctaacgagaatgtccttccaaagccgatcgacacacgctccatcaatgatgcaactttgtatgctgatgaaggagatgaggtaatttagtttctgttatctaagcatctaacagcaaaactcacagatcacataaaagaacatctctttttcattattgttataaagccttttcatgtgttgacagcttgattttttttaaaggttacaacttatctgatgtaacatatttgattgcctttctccattagatcattgttatgattgtctgacgaaaaatatatacaggttgttgaacgggtgcttggatggataatgaagctcttccctggtggtccaaagcgacgaaccagcaagctcctctagtggaaagtagagttttggtataccataatgttttcttttcatttatatatgatatttttttgccctgttttggtgatagcatgatgagaagttgtatattggaggagagccccttgatgtaaccattcttttttctacagaaaatgaaatgtatggtttgacttctgtggagctacacttttgtattggcaatgaacagaatagctgccagcaggaaaaatacgcccccttatatattccataattatacgtggggtggaggtgtatgttgtaattgctgtatccatttgttatttcattcacttgttatccctagctctactatctccctcgttcattttctcttctgttatttgctgcaacttgtcatccgatttcctatattgctctggctactggttacaccggaagtggaagtgtggaacacacataaggaaaattatggtcctaaatcctaatccatatttatcgttactctaattttcctatggaaccttgaacaccatagcgctctctctctctctctctggtaattgtgccttgtagtttgaagactcgttatcaatgcagtgaaaattgtggatgcgatttatacacttctactcctagcaatccgaagccaaggctaaatgacaataacaatagaaaagactcaaaattatttataaaatgaagttctcaaattataagccgtgtcacaaagaagcaggcctgacatcctgtgtagtacactataatccacttttcagccatgcagcttgtgaagtacagaaatggacaaatcaaacttgcgattcttcggtcgactaaaagactttcctgttctctaaaagaatgcgaaagtcgatttttatccgcatgggatagtatgatctgaccaacgaatagactaaaatataacaagaaataatatatgatgactatttcttgttatgggtaggaacgcttagatagaacttggtgttcctgaaatcatcaaggagtggattatatccatctttggtcctagtcttcaacggcagtccaaactcttccatgaaggcagcagaatcaagctaacgatagttgacaaataacatcatactcgtcagtgcaccgaagtttgtaaaagatgtgatgcaagatgaactaggacactaggttgcatagaaaacaaaactggcttaaatagtctgaacttacaatgatggttctcctcgtcttaactggtttaaatgcaccggggttcttttgctgttttgagaaaccagagcagtcatggtcgatcttctccaaaagccagaaatcggttgggaagaaaatatctgcgtcaccctggcaagtaacataaccgagttcttttaataatatataataacacatagcacaacaacttaattaaacacatagcataacaacttaattgctcaaagttatttagttctttttccccatggggttggacagtagggtcaactaagctacgacatgtttgcaacgaatctaatattcagatataacagaacagaaacattattcaaacctgagcctcaagatagttgcgatgatccaaagtcctcccgtccttctgcaagcaggacacaacatcaacgaggtgtcctagagaaattgccttgttggaaaaacgcaccaaaagtcagtgaaggtcttgtcacctttgaagaaaccaatggagctctatcgccaggtatactgacatcaggaagatagctgaaatctgaagctataagggacatgcttggcaaagcttgatgtaaagtatctagtattttctgcatatgtcataacacatatttcagagattctggcagtaagctgacaaactcatcagcatatgatcacatatagaataacagtttataacctaacaagtggaagtgggttcaaaagacataccaagcatccagttggtaaccaagctctccgaggctttgggaatacttttgacacaactccttttgcagcaagtgataatttgtctctcacagacactttctcttcatttatgccagtaatctcgacacagcgggaaactagtgggtcttgtaatggtttgtatacctcagagccttgtgaactatttttcataaaaggcaaccatacaaatttaatgaagtctgtcctcattagttaccaggcaatatcaatcaatacaactgtccagattccagaagcacaagggcgatcgactatgttatactagaggggtaaggaatcagcccttcaacaataatatatcgaaaatgataaatttatctaacaagaatctagtaaaagaccagcatgagagcactataaaacaagcagaaccttcccttaatcttctgttgaagaatataccttttttcctttccaaaatataaagtatgtatactaagaataaacttatcttatgtagcactgtgcttatatatgttacaaatacaatacagtaatatatagaaaagaaatcataagatcaatagatcattagccacgaggtaacagaagagaattcagtaaaagaatttcactacagactgtcagacttccatcattttttttttacccacaagaagcataagttcattcatttcatcaaattattccaaagtccagatcatttcattgaacttgcctaaagccgcacataaataatcggtataagagcaaaaaagatactttcatatattgtctgaagcatacactctcaggaatcagaaaaaggaaaacacaaacctgccatttactttttcaatccatacttccatccatggagagacctgatctggcgaatagacaaggtcatgtggtagattgtcaagtacctgacaatacaccaaatgaatgttgctgttgaggctgctgccatcatgtctctaagatatgattgcgaagctaagaagtccatatgataatctaattcttcacttagcaaacaaaatgatactagcaaccagtgtttccctacttgccatcatcagtcagtccagactactggcatggtcatacaatggttaataagtgatggttggtagaatgtctaaagaggatcctatatctggttgttatggcaatagtgagggtacgtaaaggaacagcgcccaacgttgatacagtgttttgtttgcaatatcattggcaaagagagagtaatcaagagtttatgtctgctataactttataacctactcttacatatcctttgaaacacaaaataacacacagataaactcgacactgaaaaaaggtatatttgcagtattcacatcttgaaagcctaaataacatttgaggtgctgctacacattctgccaagctactaagttagtgcaaaccagccagaggactgcagctaagcgtcaattaataacaggaaaggtggactgtaatgatggtatattgcttctttgattcatatgagacatcaaagaaacaaccgagcagatagtcaaggcagtacctcaagcattaacacccaacaaggttgaggatccttgcggcctgtaaaatatgacaggaaagtaacccaaagtggtcaaggaataaaagtgcaacaatataaagatcagaagataaaatccgatataagtgtgatttgacatggagggattagtgggaagtctgtgtaagtgtaacccacacattttagactgagcctatcagcactacatcaaaatatggtgtaatagcattagctgaaaatttgcaagctgaattatcaaagttcatacattattttttaaatagaatgcattttagagtagattgccctacagaggagcagggacaagaagtcagcttaccccatccagctctgtcagttgcgtcacgacactcaaccatgaactttgacaaatggcttcgcacctcaccaacagtttccaattgcttctcagctagagaggaactaatttctactgagctagcaaattaagataaaagcaaggtcaaagcatattcgatcacataacagagatcataaagtgaaggaaggtttccttacatgtatttcatagtattgtatactttcggtggagcatttaacatcatgtagtcaagtatgcattttgcacatgtgccagaaccaccaccaatttcgtaaatctgatccatgcaggggaaaattcatatggtttggtgaaaaagaaaacagatgactatgtgccataatattataaggtaccttttctccaaaaaaaaaatttggcatgagaactgcagtaatattactagttgagaaggaatgaaaaaaagaaaaggaaaatggtgcagtagcacagccatcatttattaaatcatatgtgagcggttatggcgcttgtaagagcaaatgggtggatggaggtctagaactatgctgaggaggaagttaagaatgcaccttcagtgggactgaaagatttgctgtacggaggattgatgcagctattgcataggcataccatggctgcaccagagaaagaccacgcatcaagggtcaaactgacagaaaaatgacactacatgctattgaacagcttaagaaaacaccttgaagagctccactggagtgaaccaagcgatgtcatgcttcttgtacaacttatcaaggtactgcatatacgcactcctacctacataagcaaattacttccgtttctagtcaaatatccaagatattaaaacagcacaacacagaatcgtaattggcaaacaatcaatggagttcaacagtcgtggaagaaaaacagaagtcccaaatttctgcatgagaggaacagtggcacgcgcaacgtgttcgtcgaaatgccacctcggcaaacaaatgttagaaccggcctaatctgattcccgcaatgccggaacacacacaccaaactcccacatccaaatccggtccaagcaatagaatgatccaagaagcaggtagaaaggaggattaccgtcgagctggttgaagcggatgctggagtcgagcacgcccacgggtcccgaccgcttggagaagtagccatggttggggtcgtacagcgccgacctcacgaagtcacgcacctgcgcgcacgaagctcccaccaaatcatcacccgctacaaggagatctcactgcgcccctcccagcccgcgaaacctccgccccgagcgcttaccaggatgggcttgttctcggggacgatccccgacgagaacatcgccgccggataccaccgcgccagcgtcgccgctcgccggagcgccgccgggacggacgccatgtgcggcggcgccatgggggagtcggggagtgagtcgctgcggcggcggcggcggcaatgcccacgcggttccgggccttttccccgaaagaaaagaaagggaagtccgattcgtgttcgggcccaagcccaacacgagtccgagtcggagtcgtgggctgcttgggccgtacggcccgcggcctatttaagtcgcgcgagaggagacgcatctcctcgcgcacgcgcacgctcgagaaattgagagattcattcaattcgaagggcgggagagaaggaaggggagagatgatgatgacatcagcgatgccgccgggcggcggcggcggcggcggggaggctcctactccggtcaccggcgtcgccggcgacccccgccatgagcagcgcatgaggctggtgaggaaggcgagcgagctcgcgacgcggtgcgccgtccccgtcgccttgtccggcccggccatcggcggcgtgtgcgagccgctgcgctggccgtcgatggacaaggcacgggatatcaacaatcggtacaaagcgctgccggagaacggtcggaggaagatctccgtgggcgacgccgccgacatcgcgaaccaagccgcgacgcagcagccgcagggcgtccccgccggcggcgagtcggccagcgcggcgggggtggccgctgccttcggcgccatgcccgaagaggagctccgggagcttctccgatccatcgactgctccctggcggccgcgagccacgcgatccagaaggccgccgacgaggccgaacagaagct

SEQ ID NO: 12609 - DNA, 3657 bp, Oryza sativa
ccgccgcaggcgaaccggaacggcgtcgcctacgaggccgaacaaaggcgcgcgtgcgcgctcatggtggactcccaggaggatgccgcgccgccgccgccgccgccggcgagcgggaatggcgtcgccgacgacggcgagtacatcaacctgggcgggtacatgatcgagcgcaaccgattcgaagcaatctggcgcgaacacgcgatccctcctccacaaagcctcctgccggagtcgttgccggacgacgacggcgagccgctgcggctgtggtcgttcgacgccggcgagagggtaatcctttgaatgtgcccgcgttgagttggcctctagactgattttgttgttgataagagtaatgctatatttactttatggccgtgtggcttgtgacagaagtaagatgtaatctattttcattaaaaaaacactttaaaaaatctgtactagtcttaattagtagttagttaggggccgtttagattgcagtcaaaataaatctaatgctaaaattttagtagtttgacaatattataaaaattgacagaatttcttatatatttactaaagttggacaagaaactaaatgtatgcacatttttaataattttaacaaaaatgatatgatttaaaatgacatcaatctaaacaacccttcagttagaaaagaatgggcttaaaatcaagaatcaatcatattttatccacatcagcttttcaagatgctttttctagacaaataacagatttttgtacgcgtataattttccttttgagaaggttttgtatctaaaacagtttcatttatgcagagctcgagaaaacagcacaaaaaaatgaaaacggctgcgaggggaagatcaaagctcactggacacctgtgttgacgacattctgtaccggctgaagggtcttcgatcgatgatttcacttagatagcagtgcagtggtctgccttttttgtgaacttgatgtttctgtaaatttctatgtgagattcagatgttgctcgatctgtagctagttcctgtcttccagctgtaactgtaactgtaacgagaattaacaggcaaaagaactttgttatggggattctttaataaagctggataactaggtgatctgttcatctaaaaagtagtcgtgggactgatcgagtttgctgtttgccgccttccgacagttgaccttcatgtcgccgccgcagttgccttttgctgaaaattggatggaaaacgtgcatcgagggatgggtatttgattgatggataattggatgtcatcaaacaacaacatggataatatggagcatgctgggtggcttaccactagcttgactctaggcattgagagacaacacaaactgtcaaagattggtggaagacactagctaatacggcatgagtttgagaggtttgcgcaccctcatcctcctcatggtttgggagatatggaagaaaaggaatcaacgaatctttcagcacaaggaggctacatcatctttcctcttcgccaagatcaaggaagaggcgcggacttggacgatggcaggagcaaaacgtttgcgggaccttctgcccctccatatataatatataaagagtacaaagtttttcatttctgatccttaagagttgttttttcttccactatattcaatgaaaagtcatgatctagtgccgttttgcttaaaaaacaacatgattgtagttaatagttattactccataaagtgcactttttttaagtgtaaataagtaaataactgatggatataattggaatatcgtcgaacaacgattggccctttttttcttttcattggcgtttagatcgtttgacgtagcgacgtccggggtcgttgcgccattcgatttgcatcggacggaaaagagggagtacagcgatagaaggggctattgctcggtccgcaacaacaaaaatcaagccacgaagattgtcctgggcccatggaaacaatacgacggtagcattgattccgaggagttcctctacatccattctacaagtgcaaccgtatatatcatgtctaacctgaccgtccgtcttatttaaaaaaattatatacttttattattaaaaaatagtcacacataaagtaccattcatgttttatcatgtaataaaaaatatttatcataaaaaatttctaataaaataaatggtcaaacattggacataaacaatataaaactacactattttgggatggagggagtaccattcttaatgcaataggggcaaatgacaatgcagtagcgaattatctatcgattacgttgaactgctcatccaccttatgtcatattctcgatcaaccgagcatcgtttttatataacgggtaatattttcaaccgctactgtttttttatatataaatgttttttctaatttctttctgcatcgtactggtgtcaacactgagtagtttaaatgatgaatatgatcaattatcgaccgatcgatcattgtttttgaaaagatgctattgattctgaatgttttcgaccgttttcacctcttttaacttccataaccatgaggatactccatacaatctctactattataaaaattaaagatgtttttgtcggtactttgacacgttatccgtgtatggttcggtttttaagttcgttcgcttttggaaatacgaatctgtatttgagtcaagttttaagatcgctcgcttttgaaaatacaaaaggagtcgtataagaaatccccttaaaagaactaccatgctaacttgagatgatcgaactcttaactacacatcatgattttctagaaatatatatatatccaagtaaattcccaccatgaatttcaccttaactaaaccatacaacaataataatattaaaatagccttcgtccgttgtaacatacgggcattttttaccgttattttcagggtagttataaaaggcacacggtcgaggacgatcttcacgggttcccgaacttccaaaaaaaaggggcaattacttatttgaccctgttttgaactgtaattgatgatttggccctactttttgaactttgcttatttgaccctccttttcgagtacgaagctccggtctgaccctattccgtttgggtgaggtgacggtgttaattttggggtaaatagtctattttgcccttgcttatttgacactgttatatcccttttgtttgcttgtttgaccctattttgttataccgtgtatatattcaacaatgttgaaatatttgtaataatttttgctcaagtaacagatttggcattaatttgacagatttgaatcattttgtgaaatttgacttaaatttgacagaattttgtgaaagtgaaaataaattaaataaaatgtgccccaattatgacagatttggcataaatttgagaaatttgattcattttgaaagatttgactaaaaattgtcaaatttgaggcaattatgatagattttgttaaaaaaaaatcgaacagcatcgacgccatcgacctcgctctctcggcagtcggcatgacagtggcgaacggcgcgcacggcggtgcggccgacggtgagcgggggcgggcggtggcggacgatgcggataggcaagcgggcggcggtggagaggcggtcgaggcgagct

SEQ ID NO: 12610 - DNA, 236 bp, Oryza sativa
cgccgccctcccacagtcgcagcgtgtattacccgcaagcgccgtagcccccacagctgaccgccctcgccccctcagataggcgccgccccgcgcccgatcaaaccgccgccgccgccggcctctatctccacgagcgggcgtgtagcgcccgttccgtcgtggcgcctagcgggaaaattatctcttaaaaaccctaattgtgaaatttgtttcttcgcttgtcgtctagtgtc

SEQ ID NO: 12611 - DNA, 832 bp, Oryza sativa
gctcgtctcccctcgtctcgtgcaaccacccggtgtgctcgctttcgccggtatcgccgtggttcgctccgccgctcgccgctgtcgaccgccgtccgttccggtcggcgtcgtcgtctacctcccgccggcccgcgtggcagccacgtaggcgccacgtcggcgccagctcagcctagaccgggtcgagccgaccccggtcagtcccttcccgtgcgcgcgctccaccgcgagccgtgaggctgcgcgtgggcccgccgcacccgcgtccaccgcgaaccgcgcgcgtgcaccgcgtccttccccccaccctagcgccgcgtcgcgtgctccctccgcacggtgagccaagccgctgacaagcgggtcccacctgagaccgcgcgtggtgagcccggtccaccggctctctctctcctccctcccgcgcgcgcgcgtcttgggccgttctgggccgccttcttgggccggccggcccgttaagctcggccgagccgccccttttctctcgggccgcgccctagccgcccgagggaagtctaatttccatccctcttttcttttcttttcttttcttttccaaaaaggatttaattaaatccttttcctttagaccaaaaatccaagaatcttagaaattcaatatcctcccaaccgtagatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccccagtgcgaggatttcgaggatcaagct

SEQ ID NO: 12612 - DNA, 1140 bp, Oryza sativa
  unsure (1)..(1140): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcatttcaggatagatctgcagaaagatactagtgtttctctttctgcaaaccatctgcagaagttgcggttatcttttcaactgagtacaccactcgggaagacatttaaacctcaccaggttgctctagaatttaaccctttttttcccagtggaacactatggttctttccctgacttcattgagcaaatcaattttcaggtgttcctcaagttaaagcatgatgaaagcaaggttgagcatttatttgttgtaccaggctctgcaaggcagtttaaaattgttctagttgagtaccccatcccccagttagttacactcatctttttcagcttgttctatgttttcgagtgctacgtcatcatcagtttcctgtccatgcattacattatccagagactagttatatacagagcagtttctcaatgtggaaaggaatagctaggctatgtagcttggtttgctttagaacacatggccaccagcaccatttgaatttgatgtcagccatatttatatgaacactgttggtgaaagttgagatttgaagaaaaagactaccatgtgcatagcatatacattgaaataaggcaaaatttgctataggacacccgaaaatcgtgtaattggctgtgagacaccgcaaaatcttggctttgcccacggacactacgaaatttgtgaaattggctgtgagacaccgaaggcaatattttataatttttgaggcaaaagaggtcagataattttttaaaagaccaatctacccctgcgcccagctgtccatctccctccccacccgatttcccagtcctgaaccctaaccctaggcgacggcggtg

SEQ ID NO: 12613 - DNA, 4024 bp, Oryza sativa
cgccggcaccggcggaggcagtttcggcgccagcgacggtgttgaggacggcgacgacggcggccgctgaagctgtgatgatgacgcagtaaatcgatccctgtggcaaacccgacgagtcctgacggcaagtgcgcggtctggcggtttcaagccgatagcggcggacggcggatctcagttgccaaatgaagggcacgttctctgcacagtcgtcagttaatcaactaattaagttgtcctttggtgacaaatatttcctggtgccatagaccaattagcatctgagtggattataacagtaggtgcatcgtcaccgtgcaggatcaaggaggaagaagcagccaaaggcagtaatggagcgcaggcggagaagacgagcgagagattttctctgtatggaacgcgctaggcacggccctattcgcgtctgtgcgcggcgaggcgcggtgcgcacatgccatgccggcatgccaattgcgcaggggtagattggtcttttagaaaattatctgacctcttttatctcggaaattataaaatattgcctccagtgtctcacagccaatttcacaactttcatagtgtccgtgggcaaagcccagattttgcggtgtctcacagccaattacacgattttcgagtgtcctgtagcaaattttgccttgaaataaacaactgatttatttatatatgtttcaacataatatagcggggatggatcttcctgtatttttcttggattcagcctgtatttgctactatacaaagacattctcatgttaccacagattataatatcatgggatttgtcagtaacaagtgttcctacgtgtctgttcaatttgtcataggactttcttggtttggtggagaaattctactacctttctggaagatatgacctggagcttgcagttggtgatgctgcaatggtatgtaaccatgttactggactctcattcccgttttgttgcccttgctgatttctttttgttctcaggagaattcatttctacgagcccttggccatattgaattggacctgcctgaggccccagaaaaagccccaaagcctccggcccaggctgttgatccattctcaaaatttggtccgaagaaggaaatatcgcacatattccgttcaccagagaagaggccacccaaggaactctcatttgcgtttacgggcctcacgcttctgcctattgttgggttcttgattggggtgggtcaacaactcctatgtgtgtttcttcatttctcctttgcagttttttttgtttagtctaacgtgtcactcttatgttgtctatgcttgtggcattcgtttgcagcttatgcgtctcggggtaaacttgaagaacttcccgtccttgccagcacccgcagcatttgcctcacttttccatgctggaattggagcagtgctgctgctctacgttctcttctggattaaggttagtaccgttcattgttggtaaagcataattgcattaacaaaggtttctgctggcgctgacattcattcttgttgtaatagctggatcttttcacaaccctgaagtacctcagcttccttggtgtcttccttgtgtttgtgggccatagggctctatcttacctttcctccacgtcagcgaaacagaagactgcttgagaggacgatccaaagaggagtattccgaatcacaaaattttcaagcgtcacaagttgcttaggttccttattttagcaccttcgctttgatattctgaccatttttcttgagcaacttcgagttacgagggacgagtcgatttcagttttgtgggggttaagaatactggagctagaatgtaggacctcaccttcttgtatgatgatgccctgatgtgttctcaatagacgtatgtttgatgatagaattaataatatcttattctgcaaatgcatagtatgccttttgcaaaaattgagttccatatgcagaatatgaacactcttaatcccgaggcccatatgatatcacgaacggtgacttcagaatttagatatgattaaactttgcacgggggcattcgcgtgctccatttcatcagaccatatggttctggaaacacaccttcgctgcaacctgcaacttcgaaaaataatgtctgtttatcgtgacacggtcacacaggtatacaaattgtaagtatacaatttgagaaataagtatacagtgtaatgctctatgcaaattgtcaaaactggagtaaactttccctgcagagtatataagttatgatttccgatggtcttgactctgatcagaatgcctatacatttgtattacaggttgcgcctgatgacatgtataactatttgacttctgtaaagaatcatttgcagttacaggttcccggatcctccatactaccgacccgttttatggtgggaaacaacttcttagtttgattagttatcatcatttgtaaactatccagtttcacctgtttggccaccacggtcagggtcactcgtaaagaatacaccaattactaagaactctccttgcctgccgttccacttgaaaaaaaatggtgtggagtagaccaatctctgtgaattcaggactaatcgagggcgtcgttttgtcgcctagctaatctggaatacaaaccatcgtgcttattaataagctcgctgtggtttccatcctgcataccacacaaaagaactttaagaaatctgaatgacatcatatcatgtgtatagtaggatcagattagttctggtttgcgttttcagtgaagcaacagcggccgaaaacatacctccacaatattaccattttccatcacgataattctatcagccgcttgaattgtagatagtctacaagagaaatgattgtgtcaactaaaatcttaaaattcaaaataaacaactgcagtatgagcatacattacctgtgagctatgatgatcacggttcttctagccttaggatcagtactaaactttgtgattacattctagcaaagcaggagggagcgaatcagcaagccgcccataggcacattgtatttatatctaggtacataattggtcaaatatcttgatgaagaggttaccttcacataatgttcactctcagcatcaagtgcactagtggcttcatctaataccaagatggatgggtccctaagaagggccctcgcaatagcaacgcgttgcttttggcctccactaagaagagcatcatcgacaatggtgttataaccatcagggagagacattatgaaatcgtgagcatatgcctgctttgcagcccactccacttcttcattgctaacttctcttggacaaccatacctaatattagaactaatatccattcggaatagcctaggttcctgcacacaccaatatatgtggctatttaatacaacaaaagttctagtggtagcagagccttgagttagatctgaacctgtccaacaaaaccaatcctttccctgaaccatctgatgtcaagctcactgagtgggacaccatctactaatatctgcattgatcacaaaacataacttcagaccagccaactggtttgctttgaagcgactgcatgcggtcatgtggcacagacaatagtttgacgcagaaattatcttacttgcccatctgtaggttcatatagccgaagtagtaggttaactacagtactctttccacttccactaagaccaacctttaaaagtttcatataaatgcagccagtttgttagtcagaaatgagaattcagaagtatgaaataattaaatcaactgtgttcttctacacaacacacacacatagggagagaactagaaagcaactgtgttctctatctcttacaattgcaactacttcatttggatgaagtgttagattcaatccacccagaattggtacctgttaaaaaaaaggagatcaataatataaggacacaaggtaacagaagattcctcttatttacataacaaatatgataattatgaaattgttctgctttag

SEQ ID NO: 12614 - DNA, 8440 bp, Oryza sativa
  unsure (1)..(8440): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacagtacgcccacctcgaacaaccaatgcctgatcaatgatttcctgggcatcctcaatactaagcccagcaagcataggaacacggagagatcgccggctacctgaggacctcaaccctttcctaatcaccttatccaacacaatctctgcctgctcacctcggccagccgcacagagcgccaccagcaatgcccggtacaccacaacatcttcgtcgcatcccttctgcgacacgcgccacagcatggagtagagaacgtgtgtggcctcatcgagcatgccagcatcgcagagcgcaggcacgatcgcgcgataagcgtccttctctggtgcgaggcactggttagacatttcatcaagcacctgcagagcgagttcaggtctccgcgcacggcacaatccagtgatcaacgaggtgaggtcttctgacgctagagagacttccggcctccccgcgaagtccgcaaagagacgggccgcttcgggaagcaagccatcggagaggaggcggcggaggagggcggagaaggatcgtgaccaagacggggcgagggaggatgggagggaggagcggaagacggagactgcggcagcgggagggaggtgcgggatggaggcggcgaggagggagtcggcgcagggggaggacgggaggatgcggcggaggagggaggggaggagatcggaggaggatgcggaggccgcggcgaggagcgaggagtggacggcgtcgttgtggcggtaggaggagcgcgggtagcgccgcggcgcgtcggcgtagagatggacggcgtcgagggggctcttctgccggcggatggcgccggcgaggtgcgccggagtcagcacccgcggccaccgcacaggcgtggcgaccatcgccgtcccggacttccagcaactttggagtggtcgtgcacgcgatggttttcgtgctactcggcccggcccaatctggtagctgactcgactttgctcagcccacctagtacaatattgtacacgaacttggtgggcccagttgtaatatggaccgagagcctgagtaggccttaataccgtccaaactccagagtccagtctgttaacacctccccctaatgtaaaatcgatttgaatccctggagataatatgccttccaaaaaatcaattgctttcctacaataaatctgatgactacagtttccatgaagaaaacctttctaaaacattggacgcagctaggtatcgggcgtctgactagtggcgaaaaaaaaataatcaaacgtcacatgatcaaaggaaactgtctatccattttgtcgggtgatttctctctagtgaaaaaatcacttgtaagatgtatagcaaaatcgttttagtaattgcaacgtcacaataaaatatctgttgaaatatttcactgtccggtataaaacacaatattttaaccatctaaacattttttattagaatataattacatgatattttgtactagtagagatttaattgtaacaaatagggcgctgtattcggattacatattagataagtataatttaagataaaatatcatttaaagttcgttaatgaagtcgttcgttgcatgaagaggagcgaggatatggagcgcaagagagagcatgtaacatgggaaaatacgagagagagagagagagagagagagagagagagagagagagagagagagagagagagagagagggaggaagaactcgaacgcaaaaggcccgccaaccacaatagcagccaggagccaacgatcgagcaagctgctaagatcgacgagagagcgagcgatcgatcgagcggacatcccgcgcgcgcgcgccgcggaggcgccggccgcgcgcacacttggcaccctctcccgtcccgccgcggccgcgcgtttctcctgcacgccacgaccctttcctcgccccccgcgacgcacaccacgtacttaccaccaccaccgcgcgctcgatcgatcccgcggccctccacccctcgcgcccagccgctccctccccctcacccatacatacggagcgccacccaccgcagcgcgcgatcgatcggttaatctgtaggctgctacctcgctagctccgtccgccgtcgtccgtccgcgagccaccaccaaccggccggccgcgcgcgcgcgcccatggacagtaaggacaaggagaaggagcatgagcagaccgcgtcgggcaggaaccccgacgtgaacgacgtcgaggaggaggaggaggacgaggagggcaacaagcgcgccgtcgtgctcggcccccaggtccccctcaaggagcagctcgagctcgacaaggtacgtaatataatccactgcattcctccattgttgttgatctgatgctaattgagtctgaatatagttttaacttttctgcgaatgcaggatgatgagagcctgaggaggtggaaggagcaactcctcgggcaggttgatactgaacagcttggaggtatctatctacgcttgtttccaattcatcattatatatgcttctcgcctgaattcgttgacacattcttgatgtgcgatctgtaacgacattttgggcgtgcgcatggatatgcagagactgctgagccggaggtgaaggtgctgaacctgaccatcctgtcgccggataggccggaccttgtactgccgatcccgttcgtccccgacgagaagggctacgccttcgcgctcaaggacgggagcacttacagcttccgcttcagcttcatcgtctccaacaacatcgtgtcaggcctcaagtacaccaacactgtctggaagactggagtaagaggtgacacacaacgcacgacttgaacctgcgtattttattttgtagatcagataaaatggcgcttgaatttctagaaacaacggcacaaattgatcgttccattaaatttcccatatgatcttcatgtatgtgctgcaatctcttcataaatataacgacgacatgccattttagatactgatcttagatcattaggtcattttattcgaggattttcctacattcttcagtaaagaaatatgttaattaagagaaatttaattatgcatttaaggtattcttttatctatggaacaatgaactccaataatgtcatatgatgtgtcatatatgtgcattctgacttgcagttgagaaccagaaggtgatgctggggacattcagtccccagctagagccctacacatatgagggtgaagaggagaccaccccagctggcatgttcgcaagaggttcctattctgctaaactaaaggtattcaaactcatcaagttcagctctgatgtgttaatcgaggtaattaccttactaaccatggctgtaattttttctgttaaatcagtttgttgatgatgatggcaaatgctacttggagatgagttactactttgagattaggaaggagtggccaaccatccaatgatgtgtggaactaaaaaagggcttcagaaacatgttagctgctagctaagccaagtcagatgcgctgttgcttctagaaatgattcaatgtgtcgtcatcgttaaacgccttttaatttgttttgagcttgtcacactttcttttttctctttttcttcctgttcttcggtcgcataatgtttattcaaacctatataatcgattctctatacatggagacgcgctgatatatatttatgtactactgaattctgttgtttacttgtttgcctgaaacacaccagctgatcaattcctttgagctaatgattaattgtcctagacatgcactttcagatcgaattcgttgcttaattctgaatgtctcggtggttacagtgcagtggtggtagctgagttttcctttgacgaaatgatgaatgattctgcctgtcaagtcaagatttttgcgtgtgatttaagatggtttttgcacctggcattgctctcggcctctcactctggtctgctactgagtatagggtaattagtgcattaggtgcaggaacgccgttttcttgagatggatgaaagcaagcttaggaagagtgacataacagctaatgctcgttacagagaagcaacgcatctctgctacctggaggctactgtactgccggtggcaaagcaccgtacgtacagtataaactgaaagttgcgtgtcacctggtagggctagcttctagccttctactactccagttcttttgttgcagtatgtgatccttgttctttcgttgccttggatatcagccagtgtatttccgcatacgatgaattaattagcaagattgctttactcaagccgtcaagcgtccctgtgtccgtgattgttttccgtactaatttgtactccctcagttttattttatattataagttgttttgaatttttcttggtcaaactattttttaagttagatcagtatcatagaaaaatttagcaatatctaaaacaattaattttattgaatttaacattgaatatattttatatgattatgattttgttgctacaaacattgtaatatatgataaatttagagttaaaaattaattttggaaaccgtgctaaatttgaccgtgtctaattgaatgcgggggagggagtaatatgcttattttgtgttggaaatactactatatttttctataaatttacttttaactaaaaaaatcaaaacgacttataatataaaataaatagattagaatatcaaatcatattgtccaaatagaactttgtcaaacaatccacctaaaaattgcatcattcacagttttagaaatatcatatccgaatcatgcgctatagcatataactatattatatgccactccaatttggtccaatcttccgaatgtacatctagagtaggatatgtgtgtgtctttatagggtgagtctgtgtctgcttgctgctgccctgttgggcttcttttgggctatgatctacgggccggataggcataatgaggatagcagggaaaaagtatactttgactccctcaagtatggcccgagtatgattcatgaccttcaaccacaaaactgggtatatggactctaactatcaaaaccgatacaaactatatcttttggtggttttggaagcggttttggttcaagtggtgcctacgtggcggtgttgacccggtctttgtcccacgtgtgtcgacgtgtcgcttatgttgtattagaataaaaaactaaaagcaaaaaaatatgtgggacctatatgtcattcacaaataaatattatgggacacagtgacatatgtaccccacatgtcatcatatctctcattcccatcttcccccttctcgctctccttatcgttacgtcaccctacactgggatgacgctccccattgtcacctccgtagacgatgaagtggccacggcgggggtcgacgtcgtcaacgctgagtcgtctctgctgccggtggaatcgccgaatgacggcttgaggacgagcaagaagggacggcaaggccggagccaagaaaaatagagaggaaaagtggcaagttgggcgcgtaagagatgcggagggaggggaatgttggtgtggcggtggcgagcaagggacggaggtcggcggggtcacccgcggtgagggaggcaacaacggcctccaccgccatcactccggcaccctcatgtccacccgacggtcgtcgccgcccgtcgccgctctagtcctcgctcgccctcccgcccgccactgccactcctgctcccgcccaccgctgccagcgtctcgttgcagaacgggtacccccttgctcgccgccgcaggaagaggaagaggaggaagaggggggaggaagaggaaggagagagaagagaggagaggaagaagggaaggaggaagaggacatgtgtcccactttttttttgtatgaatgatatgtcggtcccacatatattttttactctaatgccacataagcgacacatgagacgaaaaccgggtcaacaccgccatataggcgccacgtcagccaaaaccgcttccaaaaccactcaaggatatagtttgcattggatttgatagttgaaggagtcgatatacctggttttatggttggaggtcatgaatcatactcgtgtcatagttgagggagtcaaagtatactttttccggatagcagccaaggtctgctaggattcttggtgggcttcgaaacttgagtcctcggggctcaggctatagcccacgcagccttgaggcctctttcctctcccgaccctgacgtggttcactttgagtatcgcggcgccgccgtgctcgcgattaacccagccgtcgcagctgcagtctccgccgccgccatggcggctcgtgcgctgctctcccgcctccgcttcgctcctctcagccaccaccaccaccgccacctcggccgcgctctctccgccgccgccaccgccgatccaccacccgacgagtcgccccctcctcctccgcatcctccaccgccaccgacgccgacctccaactcgaagctcttcgtcgccggtaaagcctctgttctcccgcctccgattccttccccgcaatccaatccccactctgttccatggttctcaccttgttgctttgctacgctttatctcttgcgagatggcgcgggcgggcgtagggttgtcgtggtccgcggacgagcggtatctgacggacgccttctcctctgtcggcacggtcacggaaggtaatccccgaatcgcgaccttttgtcacttgaaacagtttcgtttcagggtctagagaataacctattgagtggttgtcggtgggggactgggggagggttcagatggtgtgcgcggtaggtgttcgatgaaacggctcggaggaggaagtgggtgttccgctcgcgcgcgacctcgccaaatgttcgatgaaatgcctgttagggatttggtcgcatgctcggctgcaatctaccggcatgcgaagagcgggttgtttggcgaggctgtcaggctgtttgttggtatgatgagggtgggggtgagccccaactcgttcacattggttggtgctttaatagcagctgctgggatgggcaacttggtgcttgctgagtgcatccatgggtgggctatgaagagcctgttggaatccaatccttttgttcggaccgcattgcttgattcctatgcgaaatgtggacgtcctacgaaggcctgggcattgtttggtgaaatgagggatcctggtatagttacttggaatgcattgatttctggtctagtgcacaacgatctgtttgaggaagcattgctggttttcaagaggttgctgttttcatttggaccagttcataatgttgtgactatgattagcattgctcaggcttctgctggttgtggtgaccttggattgtgtgagagtgcacatgcttattcagtcaagattgggcttgattcagatgtctcagtgacaaactcaatcttgggtatgtacttgagctttggtagtcttgcgattggaagagagattttcaaaaagatcgctgttaatgatgttgtttcttggacgatgatgatgggtttccttcttgaggaagcccaggctattgaagttatacatatgtttgttcagatgaggttgagtggcatagtgcctgatagggtagcattggttacagtggcgcaagcttgtgcacatctgggtgatggaaggataggaaagttggttcataacgagattgtaatctgtgggttcagtggtgagcttcctgcagttaactcgttaatcacaatgtattctaaatgtgaggatttaagttctgcaagactgttgtttgatggtacaatggagaaaagcttggtttcatggacggcaatggtgtcagcgtatatagaaaatggatatgccctagaagggatgtatctctttgcgaagatgaggcatgaaggttcctttatgattgattctgtgacactggtcaccttattgcttgcttgctatgaggttgctaagtttgaactatgtattcaacttcatgcatattgttacaaatcgggtttgtgtctgtacaaacctgttcttaataccctcattgcagtttatggtaagtgtggatatgcgactttagcgcataaagtgtttgatgagatgatttctcggaatgctgtctcatggaatactatgattttatcttatggtgtgaatggccaaggagagaaagcagtatcacttttcaatgaaatggagaaatctagcgaggatcaggacagtgtgacttatttgaacacattggtagcatgaagccgttttgtactggtggatgatgggatg

SEQ ID NO: 12615 - DNA, 68175 bp, Oryza sativa
tgcccagagcatgtcggatgcatagttgatatgttggcaagagctgcccgcttggaggaagcaccaggagtggctagcttgactcacaataaattaggagcaaatgcttggaaggctttgatgggaggagggcatttgcatggtgacatgaaatttactaaagttgctgcaaagaaggtgctcaccacggaatcatttgattatgggcatgttgtgttactttctaatgcttatgcatcatctggcaaatatagagctgctgaatctgtcagatcctgttatgcaaagcgaattacaaggaaaactttagggcttagttccattgagatagtgccgtacagcagaagatagtagaacaactcttacctagggaagagagaagatacatcaaacaattagtattcactgtctgtctgtctcaagctattggaatctatctcaggcataagttgagtattcactttcaggttgccaagtctcctgtggaaaaagtaaagcatcaagcatgattttcaaatgcaagttgatgaaatagatgattgccttggacctttttctttaaaagaaaaatatgccttggtctatggaacatgaccaacgatatcacatctcaactcactattgctccaggaatctctaacacgtgaatatggattctaatggtactgacacactaaggtctaaggcagcttgtttagtgcatactcatttttcattacttcctttttttcatttgtctttttttttcctttttaaaagttgccttggagtttttacggtgatcctccatctgaccttatgccctcatctggattgtgcatgttgactttcctacatgctaggacaacaacatactattgatagtaaaaagaattggtgatagagcctgtaaataccagctgtggcagtttttttttttaaaaaaaaatgagcagtatattggggctgctgggtgtgcacctctacatatgtgcaagtgttgctttgcacttccatttcatttggcagcctggcagtccctattaatcagccactttaaaatttatcttggatgtttgttcaaggatctagtagcgttgtcccacttttctgccttaaaggtgttaacgtttcatgctcccaccaacagatatagttcacaaatgttgacactcgatagataatcatagaggaaagctatatttgtttcatgacatatatatctaccaagtactaacacttctcttcaatcaatgaacatttgtctgctctgtaagtctaaattatcccacatatttgtatagatgctgccattcatgtcttttcatgcgtatgccccagtgtcaatggctattgcttctgtttgaagcaggttcatatgtggcgtgattatttatcacctatcatatagttttattctgaaagatgacatctcaatatgcatatgccatggaattatctggtggaggcatattggtgtttgcctggtataagatgtgtgtggcaacatgtgttttgctattgtttattctatttaccccacaaattgcaatgcttaatcccttccttacatattcattacgctggtattagtgaacagaattatatgaagactatttgatgatgcagtgagaataatgtatgacaaaaactctggaaggtcaagaggttttgggtttgtgcacttctcaaacgagtatgaagctaagtgcgccaaggatgctatggatggaaaggtactgtttgatgaagagaaatgtctaacagattgtaatattaactgtttcagtgaaaaataaacaggaaaataaacatggtctttctttttattctacaggtaatgctaggacgaccattgcggataagttttgctcttgacaaggtccgtggtgctccagttgttgttccacgactttccacggtgagtttaacgattgacatgttcattacatttctggaatgaagatttttttggtaccataaattctttattctatataaacatttctgtgatttttatcatataacattttaagcaatcaaataagatctctccacctggcatgactttttttaataaaaaaaagttacttatattagacattaagtatacgaaggatcacccacactgtgtgagaatgtgagattaccgacagcaatagttcaaagatgacacaactattaatagagctcacttttttcttattacctgataaatggctagttactgcaaatcatgttcgtaaaagcatctataagaatttcaaatattgcacattaaaggctctaatagaaaaagatggtgtatgacctgtgcttacttgtcgcataaccattatggacttgtttaagtttcataagctatcactcacactccattacttcgaatacaacaggacaggccatttaaactctttattcatgtttgctagataacatgtcacccccttgctatggtacacttgtttttgtcacatccataagatgacacagaggtctgtttgatgttacaaacattagagcctcttctaaagtgaattcgaaattggaatttgaatatgtcaccatgtccaaaagtatattccttgtgccagatcaattagactcgcagttgcactattcatttgctaggtgcatctgtgtcaatgtcgatctctgtggcttcttcttccttggtaggtattttgatggattcttcagaatggagtgacattaccttatattggtagaagtgtgagcatataagaaaataaataaggttcaggactcccataagggcaataaaatagaagtaatagtcgagtttgccaagattaatgttgtctgttaaccagcttgagtgaccatctctggtcgtgacctttctcatgatgtttgccagagcagtactcaggtagtttgctccagctatagtacagaagaacagagatcctgctagggtttgcatgttctctggaaactgcttattgtagaattctatttgtccaactgcattgaaggcctcagcaatacccattaaaacaagttggggtgcaagccacaagactgacataggcgatattcctccattcgacaaggctgagttcctcctcttacgttcgacaagtcctgctaccaccattgaaatgggagaaatggccaatcctataccctgtctctgtagaagtgtaataccactttccactccagtgaatcctctagctattggtactaaaatccggtcataaatggggatgaatagagttagggcaataagggatatggatacaacagagcctgctgggatttcaaagtgcgtcccaaagtgacagtccattgtaaatgtttgcaagattatataggtgaattgctgagccaatgcgacaaagcataagactccagaaatacaaaccggcacaattcttattaagcatttgacctcctctatttgttggacgttgcaaagctcccaagagtttcttgcagaaccatcaacatttatatcatcacccattacaattgcacccttgttcagaaacctgaggatgagtaacatgcatcaaactatgatggcatctagcatataattctttgaaagggtcagtattttgtttgatatgaccagcatgtttcttcttaactccatttaagcatgtggtgcattctatgcatttactagaggaaaaagggtgtatatttaccaacaaatatgaatttctgcattttcttgcccagcacatagatagcaatatagcatctatcagtaaatatttatgtgtgctcgtgttgataagcatacaaaatactcgtgcaagttatgatatgcatgatctatatgagtttaatattcaactgtataaaaggtatctgagtcttacaacttggtaagaggtaatgaataaaaatcactaaattcaacaacctgattaattatttggtgttgctttgctttgaaaacttacaatgttttggcaataaaatagaacaatgtcaagaacttatgtttttcaaatttcgtttttttccacatgtacatatatacatgcaacatcataatttcaaatgtgcctcgggattgatgcagatataaatttcaagaaaaccaacccatatccgattcattgtaatgttcttgcaaaaactcctgaagcacactatacgcgtaaaagtgtgtgcacatatacatatgacaatgcatttatcacttctcagtttgttggatgttctaatactttcactatgactagtcattgttttagtttttcctccactctaagttgattacatctctagctacattagttccaattctgttcatctttagtggtaacagatgtttacctgaactgggaagtaagtggcaatctgaatacgcggttgcccttggaaggagggttgtagagcatcaatccttgttggtttatatcatgaggacaaggaagcttgagatttctctttttaaatgaagccactaaaacctgggcaattccagcaaatatgcttccctctggttgtacatggacgtacaggttggtacccagaaataacatgataatggcgagaaacatgagtaatgtgggtatgccaaatcctattggccagctgacattgttctggatgtagatgatgacaatcatagataacacaagggcagcagtacttgttccatagtaccaattataatagctgtttagtccctttcgaccttcttcgtcggtcttatcaaactggtctactccaaagggcaagctacaaggccggatcgctcctccaccgataattagaaagcctagagaaaggtatagcacacttagctggagtgttgatggactgttgcagcctccgcctagtcgggttttttcatggcagatcggtggcttgagagctggaagtgatgcatacaaagtcattcccagcatcccctgttattttagcaaataaataaattaaaatgagttcatgttgatgaactacactcctgggaagagcttaaatcaacaaaaatgttggatgtgcactatatatcagtttcttgcatcagttggggcttattgtacattcttcgtttctaatgaaaaaaaagcattaagctattgctgatctttttattcgttgggtgaagccttatttgacaatgacaagtgaccttgcatttctttctgctgccaagcaggtgaaatgaaactactaagagagatggtttggtcatcatatggacataccaggaggctggcgaagcatccataggctagtgttttgaaccttcccaagtagacgtcggagatgaaggcgcctagcaatggcgcaaagttaagcgtaccgaagaatatgttggtaatattagctgcctcaatttgcccaatgttgaagcgcttcacaagatagaccgtcaaatttgctaccactccaattgtcgcaaccttttcaaatgtctcagttgctacatagatacaatcagaaaagggcatccattcagtacattataatgagcattttgatttgatccgcttgaagtacaacataattcattcgtgaatccctttttgctttgatttgaggcagggtgtatcctgtgcagggatcaccgggttagagcacccatgttgtcatgtctaaatttagacaaagaagccaagccaagccagaccaaatcaacatatacttggtctaggctcagagtctgaaaatactcttatattgaatggatattagtatatgatttacggtagtcatgtagaagtattaatgagatgattcacgaatacgagtgattaaaagagtcttccgtacgtgctaatcgaatacgaataccatggacatatacatctatgatctatatatatggcccttctcaggatgcaatttattttctatattatcaaaggaaatgaattgatctttcacatgaaactatctataaaaaggggacttcgggcatgtttaaattgtagccaaaataaaccttgccattcaatatgtgtaggtaggtgtgcgtgtgtatacatacgtgtatttgagcgttgcgtctatcttgttattttcaagcctacggtgtagccgtgcagcatttgagaggtctaaggctgcgttcgtttcttggctaaggaactcattcccttcacacgtaaaacggagtggtccattagtgcgtgattaattaagtactagttattttttttcaaaataatagatcaatatgatttttaagtaacttttgtatagaaacttttgtaaaaacgcactgtttgaaaagcgtgtacacgaaatatgagagggggagttggtattaggtccctggaaacgaacgcagcctaagtaacatcagtgacggcagaggtattaggtctagtaacgtcagcgacggagctagaaatcattaaagagtgaacttaaactagtgagttgctttttttttcttaaagttacatggtggtttaagataatttaaccataattctgaagacaagtctaaggctcaagccctaactactctaggcctgccttcgctcctttagggcccctttgatttggaagaaaaacatagaaattttagaggatttcaattctataggaaaattttctatgaagccatttgaaacaaaagattaaatcctatccaattctttgaaattcctatggaatgcacaatcttatagagattttagagaaaatttagcatgagctttaacctcttggtaatttttctttgagtttatctctctcatccaattcttggggttcaatcaaacggtaattcatgtgtttttcttacgtttcgaaatcctctgttttacacttatatacctttttaaaatcctgcgtttttcctattcttatgttttcttaatcctacgattcaaagggccgttaacatactatacggatcgcaaaacgtagaaagaaatcactggaacgggagcctcacctatgatgaatggcatgcacttccaaccttgcggcgtcttccccctcttgcctgccacaacttcaccaccgacgacacccccgttctcaacggcgccgatctccatctccgtctccaaagcgtaccctcgctaccacagcaaccaccaccaccaccaccgcgcggaacggcggaggccaaccaaaacaccggcgaaaaacctcgctctccgcccgccggtgcgcgcgccagccagccagcaccagcggcgccgcgcgtatgtgaaagtaggcaatgctactaccaccagttggtagaagtggtacatcacgctacactgcacatatatgcgtgcgtgcgtgcgtgcgtgggtgcgtgacggcgtaggagtcttgtcacgctagagctattgggtgcaccacgcgttgtcaagcgccgcggagcggacgggacggttttttttgggtcggcgtgatgcgattgctcccgtgtgtttattgcgaaacggacacatatgcgtccgtccgccgaaacagtgagcacgtcacagcggctgggctggcggacgggcggttgggtttccgcggcctttgaggcggcatgacgcgtcggcgtgtctcatcctgaagatacacgtaggtttggatggagacagtccatggcggcatctagggatggcaattgtgcccgtttttctatttacccgtggttaaaaaccctattaggattaaatttgttctccattttatacccatagatattttattgggttaaaagctatgcctgatgggtaaatgggcatgggtatgggtaatcactacccatgcccgctttgcccgtttacccacgaaatctaacttacatgtaggctagaagcaaaatccactagaatacataagccacgttctttgttttctacggttttccttttatttcccttattatctctccctcttactctatcgccgtcagaggagagacaccacaccgagacagagaatatttgatgttttaaattcgatatcgaacttagaagcttgtagactttttattccactacttttgtagtggcgggtaaacgggcacgcctgcgggcacaaggcgcccgtgggcgatgggcatgggcaaccattcttacccgtcatgtagtaatagatatacccacggaaaaaaataatctcatgggcacgggtatggataggcactacccgtacccgtcgcacccgattgccatccctagcggcatctgatgctttttggtcatgttgattgtgtgcgcgcggtactgacagtccagtccacattctcccgtgaatgaatgaagaaagtttggtttttagtgaaaaaaattatcgtggaaattaaacatggaagctgatgagtacttcctccgtcccaatatataagaacctaaaatcggatgggatatttcctagtactacgaatctggacaggtagcctatgatgtccagattcatagtactataaaatgttttatccggttctaggttcttagagcatccccagcagctcctttatctagtcatccatccgatatttggagtatggaggagaaaaatagtgctccagcaaagtcaccatcacatactccatttttggagattctccaaacctagcccttcctatgctaaatatggaggttctctctcctcactccatcctcaactacccacttcccgagattttttttaagtggtgaaaggtgagagggatatgagtaaaaatgtgtggtagttgaaaaatattaataaaatataggatgttggtatatttaggatgtaatatggatgatctgttgaagtgaaaagttatatagagtgagaatttttttggatggctatccaaatgggagtatggaggatgaaatttagatgagctgctggggatgctcttatatattgggacggagggagtatgttgcaaataatgggccgtgactatcttggacccacaaattttgtggatgatctcctttgtagcccatgaagcctttgcacagtttattgggcccataaccagtactgggcctcgatcaaaggtcgcccattagaccctgtatttccatgtattattaaccccatgacctaattctttaataatcataagaggcatttccggccgggacgtcccgaaagctaagacaacgcatccatcatgccgcgtgttcgtacttaacgtgcccatgcatccagcagccggcacccaatcaagctcatgattaactaaaacacgtccaaaagttaaagcctttctaagatccccataaaactaaaccttttattagaccaactaatccttctttctgtagccgctagctaacaatctaaactaatgctatcaactccggctcaggtggaggggcctgcacttactagtacgtacgtgaccgataataatcatagagtgacaaagtgtaccatctgtttgtcctaatcccaaatatcccaatcctttccctttcctttcggtctctgttgcacagaatcgggaaccggttggtgagacgtaaccaaacgtgggtccagccggtgccgtttgatgacttggcctccaggctccaagtgaccgtaattatggcatgttaattcggtttagttagtaagcttattagccaataaattaacgaatttggtgtaaatatagtgccacatttctgacttgactcaatcattttttaaatatgtgattgctagtgtttctctctcaatcttatcttccaagttggtaattatttacttttatcattattctcttatataacttacagtataaatgttgtacttccctcatttcatattataagactttctaatattgttcgtatttatatatatgttaacatccataagttatttacattgtaaatgtatgttatttacaatataaataacttacttagtataagttttgaagtgtaaatgtatgctatttacattgtaacaagattttaactttttttaatatgatatcataaatatagctagtcccataaataaatacataaataaattcaaaaagagaaaataacaaatagttagaaaagttatatctaataatactgatgtacaaggttaactttggcgaaatctacttttgtaagcgcatcacagaagtattctataccaccattagcaaagaacgggtcttgtcgggcatcagggaagaagagagcgtggagcggagcgcgccaccgcgccgcgcggccggcgacggcgatgggtgcatggcccatccgttgtcctggtgacctgatccctgcattgcaatcttgcattcgactactctacatatgttttttaaaaaaaatctaaaactgaacgtgatatatactagtagaagtatgtctataatttgttgcactagaatatatgatagtatctagttttaggtttgttttttttaacggatgaagtatactctctctgtctagaaaaagacccatcctacatacgaacttgatatatatgtgtgttcagattcgtagctagcagtatttttttttaggacggagtggtactgtagtaggtcatgtgcagtggtttgtttttcgccgcccgaatcattcgcgccatctgggctccgcctcggcgcgacacgatcattgcccgcgcacacacccggcccggtacgtccccgtccttgccatcgccgttaaatcttaatccggcagcactagtagtagctttcaccaaacccttaactaactcggtgctaatcactcgccattaagatctaagcaagcacgaatgatgagtgatcagtggtactgtctcagccagccaatcatagctgctcatacgctgaaacagccgagtagttctgaaaatcatacaggctggaacagcagataattaagccaaaaaaaaaacaggctgaatatttcccgatgtaggtgacggctacgagcttgttacaggtgcatccaggttgtggtacatgatgagagctttagctcgctcttgtgcaatcaaatcattcatccatttccccttttctctccaaatcatcatccatgcatgcaggttggtgactgatgaaaggaagaaaagggaaggcaaacctggacagcacagacagagtatctgcatctctccctttctttcttctcgaggttttctctgattctttcggcagcatccaaatgcacgacaacgatgccacccatgatgcgtcgatggcgaccgaaagctcatctcagctcagcctcagctcgccacggtcgagaggctgcatttctgcagagattttcctcttcatggcgagcagaaaggagaatatgttcgcactatgcgtactggaggcgtgtgaatcccgtatgcgcgtgtggtgcctgctctgcctgccctgtgtgcgtgtttttgctcggatcaatgggttgatccccactgctatcatgctgctcccaatgatggctcgctagcttccccgacaggttgtgcccatcaggtgcagcctgaactcacacctcgcagggccaacactagttcacgagattgctaactacagctgctagctactccctccgtttcgcaatgtaagttattctagcattttccacattcatattgatattaatgaatctagatattcaatatgaatatgagaaatgttagaatgacttacattgtgaaatggagaaagtaatagctagccagctatacggacatgtcaaccatttttttttacacggaaatgctaaactactgttggtagaaaattgaggctaaaatattgtaaatttctaccattagatttgctttgcggttcctgctccggcgacctcacctctttctcctcaagctccaattaccccttcttcaccagccatgacgaccggcgtcttgccgacaagcggtggcccgacgatgcatggtggaactagtggacggcacggcgacatcggagtcacggggatggaggaagacggtggactggtgttggtggtggaggcaaagcaagtgtacagttaggagatggtggtggatccgacaatagtgagtcgctggagatgggggagacggtggggcgggggcacctcgccgccgccaccttgaggagaaatagagggggaagggtagtagggaggggaggcggctggtcgagggagcctctctggtgccattagcgtatttcgatcagctgacaaggccagggcgttggtggcaacaagaagcggaagtgttgagcacttcatgtggtgatggggaggaaaaaggaaaaaaagaaaaggttagagttttgagggctttgcatgaatctcaaaacataatttactacatgatattctatcattaatatagaccagggtttaagttttcaataaaaactggttgagaactgtagttttttttttgttttcacggaggacggaagcggattataagtaaaatttcaaatggtttttaagaattcaaaattgagacgatagatttaactgaaatttgaaaaaaaaactgtcataccgtcaagatcgggattcgtcgctcaatcggaaatgggaacactggtaattggtaaaagaccaaagcattaactttgttcagtagttttctgaaccgggaaacaaggagtatactgtttcggtgcttttgtttcgtctcctaattaatactgtacctcgttggctagcttgagctggatgcaaaatttatctcccggtcatcgcggtacaccgagatgtcagaatgatatacgagggcgcacatgccttgtaccaaccggaagcatccaaaaacccagatgcacagctaatgcattcactctatggggcattggaccaagagaagagaacacaggacatttttgtttcttgttcgtttgtgcttttgcaattctgcaaagcattaggggcgtttcaccgcgtatgtatgtacagcgtgttcgtgccacgatggttgcgtcagtgaggaaaggcagcccacgttaagttcagacttcagaggagaaagaaacaaggctttctctacactgtggctgcaacaagggccccacatgacagcagaagacactgctgctccacggtcggactggcattctcgccgtcaatgtcgtcgtcttccttcagtttacaactaaaaatatatacttggagtactaggaaaacaagcccaaatagtaggcatacatgtgaccaaaaccgaaccggtaaaaccgctcaggttttgcatcactctcaagtttcaacaaaactaaaacacattctaccatgtgggaaggaaagaacgctatgcgtgaaattaccgcctaaattaaactgttttgggggtcaccggtcacgggcaaattagcaccatcatctcgttcccgtccactccaccatcttgccctctagttgtacttaagtttgcaagtagtaggtgtgatcgtaggatagcctaccatgcaatggttctcatcctcaccattgtcttcctcgtgttacattcctttcgttcattctctcagtgaaatgtacattttcatcaccccacctcaaataacggtggtagaaatatggagggacattattatatataaaaaaaagtacggagaaatataattgaaatttagtagtggctaaatctcttttttttttcttttttggcatatttcgattgaatatgagtgatgccaacgtggatggccacatatcgattagtcaaaaaatgataaataataaagttacccctaatcaatctatcagtaaattactagtttatctttatctctaataactaatggatcaaatcatttctactagagagtaacgaaccatcgtccaaactacgaacataattacaaattcacaatagtctctagtctacaagtaaaattagggtgtgttaaaaaaactcaatttgtgtcattaagaaagaaggaaacaggcaacaaattacatttttttagaaaggtcaaattacatataattcgtgcaaagccaaactggctcaagctccgccacattggcattagcattttgagggcgcccgacattctcatcctcatcgtcgtcttacttaagtttttttttttatttttacgcaagtcttacttaagtttcatccatttgttccatgcttttacgttcaaacggctcccttatggcccggtcatatgctcctaccatacacaacacgctgttccaatgtcagtacaaatgttactaaggtaccactgattgcccacattctctaataaacagtaagaaagtgtttggcaaatgggaaacggaaatgatttcccaccatctttagattctaaccattcattctcccttttccatttaatcctaacccttcattcatttcctaatcccaatcccaccctccatttcccattatccaaacacaccgtaagggcttattaagaaataaaaattattttacaggtaaatttttatatatgtgttcttagtgatttaaaaccaatgctgaaaaaaaaacgttcaaaatatcttaaaatcaacttcaaaattatttttgaaaaatttaaattttggtttttgccgacggagctcaaactttgtatgaactgcgtttttttttaaaaaagaatcggaacaactttaagatgtagggctagcttggtttgaagtctaaattaggcttaccaatatttggtaatttcaatagtgtttagtgtctatttggtttgaagccaaattttagcatgcctaacaaaataggccattttaatagtgaacttaggctattttggcttcaatccaaacacaactttgccttaccaaaattagtagtgccaaaatttggtaaggcctatttaggccacaaaccaaaccaacccttaaactaaaattagggttaatgaacaacctttagaacacaaccaaaatcgcacactaaggtaaaggaacaaaacaacaaatcacgttacacccgcgaccaaagccaaaacggaaaacgcacacccagctaagggttgggcatcattgcagcataactaaacacaccgtagaatagaggagcgctttacgcggaactaattaactaaaattaaaccccgctttctcggtcacgggcaggtcggtcccaccaccccaagtccccatccactccaccaccccggccattccattccattccatttcttttcttttctttctccccctcaattattgccgcttctgtccatcccctccccctccaattccattccatcttcatctccatatcttctcctcctcgcgtcggcagttatctcctcgttgataatggcgtcgtcgtcgtcgtggtgggtggtgatgttgttgatggtggtggcggcggcggggtggggcggggtggcggcggcgacggcggcggaggcggcgcacgaggtgctgcgggcgcacgggctgccgcgggggctcctgccggcggggatcgcggatttcaggcacgacgaagggagcgggaggttcgaggcggcgctcggggagtcgtgcacggcgcagttcgaggtcgggctgcggtacaacgcgacggtggccggggtcatcagctacggccggatcgcgtcgctgtcgggcgtctccgcgcaggacctcttcctctggttccccgtccgcggcatccgcgtcgacgtcccttcctccggcgtcatctacttcgacgtcggcgtcgtgttcaagcacttccccctcgccgtcttcgaggccccgccgccctgcacccccgaccccctcctcctcctcacgcaggtaatctaatccttcttcctcgaaccaatcacgaagtgaaatctccacccacctagttcatctctgaattgggcgctcacgcggggcaggtgtgtgaggacggatcggtcgccggcggcggcgcggcgtcgcaatgaaggggacggactcgatggttgaaatcggcgaggcggaaaccaaaagaatgcgcagttttgaggcatgggagtggtcggccggtccgtcgccggcgggccggcatctgtgcagatagatagaatgaacattcctttcgttttctactactagttagtaacctttcattcctcatcactctgttcttcttgccgttcttgttgtccagtgcgatcaaagccggccgacggtggccggtagaggaggctgccggcctccggtcgccgccacggcgataatttttcgtggttatgatggttcggggattacaacgtgttgaatctgtttcttgccgtgggcgatgaacttggatcgttcccggatccaatccagcgtggcgatcggcaaaacacgcgtgttccgttccgttggatgatgcggttttgggtagcacagcaagcgtcgctgtctgtctctctcggcgctgctgatgatgcgtctcctccggtggctttcagtgtcctgttgctgctgctagatgctccggtggcgcgtatctgaggcgaagccgtccatgttggcatccaatgggatcgcgcatcctgcggtactgctactagtctcctcctgatgcgtcagattcggcggcattcgccttctcgatcagctagcgccagtctcgcgagagaatgggcgagcattgtgatctgtgcccatccatgaccaaattgaccatatgccttccctagcttgcagtacctctctccctccctctcgccattggctcttctctgacatgtctcgccaaaagtgagctcgctttgtgcgcgcgggggcgggggggcggcgattggataagattggaccattcaccgcgccacggcgccagtgaggcatgtgtttgactgctgggtggtgtgtgacccgttcttgtctgtgaaatgtgaatactggcatactgcacgcacggtgagcgccatgtaaatgctctctgctcgcgtacacggttttcttctcgcgcacacggaattcttctcgaggtgtaaaccccgtttggtaactttggggtatcaatcaaagcggcgaaaccgtgcaccgctatgtgccacatgggcgcagcattcttcccgagctccgaattgataagttggatctggtacggcgtagcgtacgcattgcatgttgcgatcgatcgatcgatcgaagtcccggcctgggcaataattcgctgctgcacatccacacacaccgcaagctgacagcggctggctgacgtggtggaaccaccaatcggcattacgaacagctcggcaacgcccaggatgactcgtcactgacacgtggatcccatagggcacatcacgatcttttcttagagaagggtattttttatcggcctctacatccgaccggatatatgcaatatttttaaattataaatttagcctaacccaatctaaaatttgctatcatgaatatgctacttaagtcaatgcaaccgctaaactacatgtggcacgtcacaatcctgcctgcgttgcatagtgttctttgtgacaccaatgccacagttggtaacgaacgaactagtcgggggcaaggggcaagacagcatgtttcgcatagcgcttgggagtgaactggtgaagttacacaggaacagcgagcgacagagagggggagaggatcaggcgagcgattgcgtattttgcattacgggagagggagaaatgggtggattggaggagcagcggcatgtgctatgggggaaagctaatgatgggaaagagacaagcgtatcaactgcagcgccttcctgcagctgccgggttggtggagtaggtgacgaccacccgcgcctgggtgggagtgggatgccggcgcggggcaagtgatcgatcgattgaccatggtaggagccacacaggccacagccacctgggtaactagtgtcatcagctgcattttgctcagttgctgcttgccatcgtcgtcgacttgttgccctcctcttttttcactgtccgttgctgcttcttgggttcacttttggtgcgtttggaactttggatagagtattaggtgatctggataggcacgaggaggaagccatgcgatgcaatgggataatatgcaatgggtgatgaggtgtttgggtgtccacctgttgaaactgtgtcattgttggacgggtgacatgtcacatgctgatggggtggcgtcagtcaatcatgtttttgtagattaaccggagtgaagaatggggtctgatgttctatctgatctgatctgatcatctcttgtggatcatcatggttaggcttggcatgatatatgaatcttggtccagtcagcaagtgggggtttttattggtaaattgctttggtaagttaagaggtcacatcactaaacatttgctatgcaaatgtgaatgcgtatgatccctacttggcaaaaacttggaacgtgctgtttgcgtgtcttcgcattcatgcatttctatccgtcgttagacaaccaatcgccaggtcaattgtagtgccggatggctagctggttggatgacactgatcatagcttgaactttacgtatttatttttggagcagatgttcgtatggtaaaatgccttaatggtatacgatctatttgacatcagatacaactttctgatattgattccaattccattcagggaaagagccagagtgccgtacaatttgcacacagaggtgtgtccaaaagaacttttttgcagtaaaaatgtgaaatatagggagacatgaaccattaggcatttgtcacccgtgtgcctgtgtgtgtcactcttctcatgatctcatcacaccagtaaactgcatattaacgcctgaattcattggtagtgccaaattctaggtaaactccggcactatcaaaatattgtagggtaaagttatttagctaatatttggattgctaccaatataaaaccaaactcttatagtatagaggagaaacttctagaatatgaccaaataaggtaggcactaccaaatatttggtgttagtccaaactaacacacatattattcagtttgccaacaaagtggaaaggcatgttttggtatcaaaccaaaacggccctaattaaaaacaaggagggacaggtaaattaattgggccgtcaaactcaggaaaagcccagtctggttcaaaaggcccaagatacaaaaaaaaaccgcaaccccaactacacgtctccggcacagtggaagtctactttgcctcccttatttcttgctcctgactcaatcgcctccaccgaccacagctgggccacctcccatggcgtcccagcacggcggcgacccgcgcctcgaccgcctctcgcgtgccctcgcctccgaccacccgccgccggcggccgccgcggtccacgcgcatctcgtccgcgcgcacgccggcacgccgccccccgtcatccggtccctcctcaaccgcgccattcgccgcctctccaagccgcacccgcgcgccgcgctccgcctgctcctcctcatgccgcgcctccccgtctcccccgaccacttctccctccccttcgcgctcaacgccgccgcgtcgctccggttgctcccgctcggcgcctccctgcacgcgctcgccctccgcctcgcgctcctcccctgccgcctccccgtcgccaacgcgctcgttgatctctacgccaagtgcgacgatctccccgccgcacacaccgcgctcgccgacatcgcggcccccgacgccgtctcgttcaactcgctcctctgcgcgcacgcccgcctcgcctccgtgcccgacgccgagtccctctttgttgccatgccatccagaacccaggtatcgtggaacgccatggtggtcgtctacgtcaatgcaggggacgtctcttctgctcgccgcgtgttcgatcaaatgcctaccagggactccacctcgtggtcggtgctgattgttgggtactgcaagtgtggttcaatgcggagtgcacgagaggtgttcgatagaatgccggcaaagaatcttgtggcatggacagcgatgatcaatgggtatgcgcagagtggggtgccaaaggaatcacttgcgctgtttagagaaatggaggctgctgggattgagcctgatgcagcaactatggtcggcgttatatctgctgcctcgcagattggcagcacggagttggctgggtgggttggaagttatgttgacaagaagaggattgaaaggaacgataaagttcttacagcacttgtagatatgcatgctaagtgtgggaatgttgacgaggctctcagtgcttttagggagattgcacagccagatgcatacccttatactgcacttattagtgggctggcagctcatggtcatgcaaaattagcgcttcaagtgtttgaaaggatgcaagctcagtcagtttggcctgatccaatcactttcgtcggtgtgcttaccgcatgcagccatgcaggacttgtcgataaaggtttggattactgggaggcaatggtgaagtactatgggatggagcgtcgagctgatcactatgcttgtgtagttgacatgcttggccgagcggggaggcttgaggaggcttttgaaatggtgcaaacgatgccaatgggcccccacccaggggctcttggtgcattgcttagtgcctgcaagacgcatggcaatgttgagattgctgaaattgttgcaaacaaactttttgagttggaacctcacaacactgggaactatataatgttgtcaaatatatatgctgagaaagaacaatgggaggaggcagaaagaattagatcagttatgagaacaagactgcccttcaaacagccaggctctagttgggtggaggatcgacagagggagcgtggcaggtttcctttgaggagctgaaaacccgaacacatatctctctttgtttcaaatgtaaattttcagatgatgccaaacagatcttattgaactgccagaaatgcaggagctactgatgccattaaggtactttcacttctttacagttcatgttatatctgaaagatcccaatgcaaattattttgtggaagtattcagataactttattgctttagtaagtttggcatctcaatgaattgatgcggtacagcataataccaacacttgtattttaacctctatatcttagataattgtttggcaagatattttaataaatggtgtggggtaagcaaataaggcaatttgcaatccatatcttaatgcttgtaactgcaagagtttagaaagaaaattttctgtaatctagtatgcagaaaatgctcaggcaagagcatgtcgatcgcttccaaatcaataatttcagaaagtaacagtctcctcacgaagacatgaagtatggaacgattatttgcatcaccatcatgcatgattgtattttgttctgaatgtttggtaaatcatgtgcagaagaactagaacaatagttttttctccatgttcattatccactttcacgaaaggatgctaattggtgcaattattctgggtattattgatcagcctgatttcactcttgacagcgggagcatagtagtctgactacaaggaattgatagacaattctcgttgctgcaagattgttaacttttctgagatgctgcaagctaagctggttttaaacaagctaattatcaggggcggatgatctatggatcagtttgtcgttaaggtaacttcaattcttcatggttcatgtcatgtctgaaatttgccatgataaattactttgatccttttatgtgttcattgagccatgtttttttttaaaaaaatatgcttgtttatctctagaagaattgagtatagtttcatgacacttgcaatttaagctcgtcatcttaggtaggtatctgtgttatcaagaatttaagatgtgtcataaaaaaaaaccggcatccgaatgtttaaactatgatggttcagctggaaatttgttgatatattttgaaattttgctaaccatgaatacaatgttcacttgcaaatcagtaagattagaaaacagatcatcatgacgttggaaatagttatttacatggtgcattccatataaatggccgtatattgttctggatgcttgataaatcatcataggcagaagaactagattaactgtttgtctccatgtcgaatacccacttcaataactggtggttcacccataacgtacactagtgacaacaagctaactgatgcaaattttcagggcattcctcagcttgacttcaccgtctcgatcgcttggattaattcatctagtttggcacctgtgacctccttgacgaccttcccgtccttgagaatcttgaatgttggcacaacctttatgcccagctcctttgcaagagactgcgaatcgcacgcaccaaggaggcttagcacgatttattcaggaaaacagcagatacattccaatcgaataatggtgggtggagcgtagacaagagaaagaaaatcagttctaactgaccttgttgtcttgattgcagtcgagtttgaggaacacaacgtcctggtccttctcggacatctcctggaatttcggtgccatcaccttgcaagggccgcacctgcaaatcaaccagtcagttttacagttattacactgagcagtgggatgagatctgttccctttcttattcacgccgctcatttcaaaataaatccagctcgtgataagactgaagaattcatgcgaggcaacagttcatcaatggagattgacgcgaagagatcagtggagttttgtggcttttgtgaagtaccattgggtgtacatgtcgaggacgacgaccttgggccctgccgacttgacaattggccagaaggtatccttgttcacctccgtcacctgcccggtcacggccaccgcctccgcctcggccccaacagtggcggtgtccgagccgctcgacctcacggggatcaccgcccttgtctcagggccagacaccaccgtcaggctcctcctctgagaagccacaccgccgccgagcaaggcggggaagcgcccgcaggcggcggggcggcatgtggagatggccggcgaggaagccggcccgtgcgaggaggagacggagaggcgtagcgccattggatgggagaattttggaaggtaatggcctaattgggtggcgagttggtgctaggaaggaaggatgtgcgtttttcttcagcagcggcagcggcagatgagtggtgagcttgaaaggatatcttgcattgcttggcggtattcatagcctttctagtggagatagtttcttggcggggaaatgacatggctgccccaggtaattcctgcacttttgtggtggcactccacctatagctttctgtgggatggggcatttccggtatctgaaagatcgggttgtgtggtgcctgcgcatctctgaggtttcatggaggagagagcttgtctaacatttgtagatggctctttgtgtctggaactgatggcctcacgattgacggtaacatggaatcagtatcatagatgtcatagatccttttacatttacacatatgctatgttagattgctagagaccctaatgaagtaaagattagaaactgcacacaaaaggttgtgttgtatagtggttgaattggagttaggcgctatagcgttgtgaacttaccaacatgatgctgggccagtattacttggaaaccatagtaattgaattatgttgacagtgtagacttttaactagccgaattatgttaacagtgaaaccatagtattactccttttctggttgttgaaaacgggatatgtttcttatacaattttacagctccagcacatgcttgatacaatttaacagctcgagtagatgctataacagatatttatctcgttttttttgggttatttccagtctatgacaaacacatcagcaattcagcatcgttttctactatttgtatgtcttccctttgagcagtgaacaaacaagtgttccaaatgcactgtaccatcaaagaatcagtaccacgtgaaaagaaaaaaaaaatcaccagcgtctctagcgaaaagccaatccagctgcacaaacacatcagcatcatcgccacgttttgcgaattctaccctactcgacacaatctcgttagtcaaactccagccgccagatattgaacaataattgtggactgctcgtttctggcttggaaaaaaaacagaggaatattcctgagatattgtaggtaaatgccagatgtcacaatgagtagtatcatgtattacatggatattttctctttgctcattgtcggaaatgcacaggtagaaggtttagtgaaccaatgcaatcaggttcattttctttttgcactaactatcttgcttcgagagtttgagtttgagaacaaatttcacaggctcgtgaatggtagtatcaagtttctgaataacctcatctcaaaataataataataataataataataataataataataataataataataataataataataataataataataaagattctaaataacctactagtcaaattcccaaaccgacacaaaatgacaacatgccaagaaggcgaagatgaggcccaaaaacatgcatccggcccaaacatagccccaaatgtagctgctaggcaaggcccaacatatacggtggaagagacggcccatgtgcagaggcggcttagagcacgcatctggcaaagcgaatgcccctgttactcgatcaggcaactaaggacctgttgaagcttattttgtcatgacacatccggtatatttatagcagctagcgctatggtttgggaggggataccgggatatctaatccaactcaattgagatcctttaggttactgcatatcgctcactgacatgtgagccggagagtgacctacatccgatccaactacattagaagctcttgcttgcaatgaaggacctgccatcgccatggactgcaacgtcctgaaggtctgtatagattcagattgtcatgaaagttatttcgagtattgctacaagatcaaaatgcagatacttggcagtccttaatgacaccaatataagaagacgtcaatttgttaaagcagaattttgtcatgaaagttgggatctaaatgtagatgcacataatttggctaagtttgcatgtactttaaattatgaggggcgttacatgtggctgttaaaatactttccctcccattaatgccttattcgattaatacaggaggatggattgaaggggattgatgggattaattccatgcaccttagtggatgtagaacaaatctccctcggaatcaaggtgtggaatgaatcaccctcgaagatcgatcaccttgagattaaccgaaaaaaaccttaagaaataacgtgttttttttcgtaaatttcttaacccattcatgatttcaaatgtttagtaaaccctagtaattctatgtggcatgctgtgagatggatctatctcctaccatgcatgaaaccagttagtttcatagaactacctcataggagaaaaaaagcatctcctttactggaaaacctcacctgttttgtcaactgtgtggggaaattgaatcaattaaccatattatctttgattgccccattgtttttttttttgtttggtgtgcctggagagatgccatgagttgggggcagactgccaggagttttgatgacatttttttactggtagagatgaactcaattgctaagagcaaatctgttaagatgtgttgaattggtgcaacggagtggtcactttggttgacaagaaatgcaatgatttttagagaaaaaatcgtttactatcctctaaacattccttttcaaatcatttcccttatgctgcagttgaaacctctgcttcaccctgatcagaaacaaagtctggagatgctgatgacccaccttagggagacgagatcaggcctacgctcaagaactgggattggttaacactgtgtccttctgaacctgattttctatttagctgtcctcgttaggtgatgtttagagctagtttcatgagagtttttggttggagttagcctggagttgtttctgtttggttcattgatacttgcaatccctatcaagccggggtgtggcccattaatgttttttttttttctgcttttgtgctgaacctctgtcaagctggcatccccagcagactcgtggcccgtgatggttttcaatagaagccgggtccttggacctttttctaaaaaaaaaaactcacatgctggatatatatatggtaatgtggaactgaaattgggcatatatggctaacaaagtttctgtacaaaaaatacacatatatgaaactgaaattgaaattgggcaaatgtatagtcaacaattttctctttttacaaaccagaacacataagtacgtacatgttttgaggtcgccgtattttgatcttaacgacttaaccaattgctagatcagtggtgatcgaattcttgtacaacacatgcgtccttgttcctacaaggttaaaaagaaattagaaataccgacggggttaccggtgatgacagcaccaacggtgcagatggtccacagcaacgctttcacgaccgggctgtccatcgtccacggcgacggcgacgactcctccggcacgccggtcggcagctgagggaggatcatgacgccgccgccgccgccggtcgccgctcctctcagcatattcaccagacgcgccttgagcctttccacccttgtgcgctgctgctgctgcaggcgcgcgccctcgtactcctcgcggaagaggtcgttggcgcaggcgacatggatctggacgacaccggcgccgccgccgccgtcggagacgtacccccaggtgtgcctcctgtcgccgagcttgacgtgcctgcacttgcagcacggcgacctgagcttccgcgtgagccgcagcttcgtcacgctgccctcggcttcgatcaccttcggcagcgccgcgcagcaggggtgcaggaccctgccgcgtttgagcagggtgcgcaaccttccgatgtcccgcacgtacgcataaccattcacctgcaagcgtgcacaactgattacacgtacgtatactagcttagagttttctgcgatgtagccaaaatcttttatatttggggacggaagatcttccgaatcatacatatataaaacaacatgcccctctcaaaaaaaaaaacatgccaagtatcgtatatttcgagaattgcatgtaggtattgagaaaaaagaaacacctaaaaccaactaagacacgatcgacaacatccgtgtttcaaaagtttttatttggacgaagctaattaaggtagtagatgaaaaataagaaaacatcgatcgatgacaagaaacatgatcaagagaaggagagatataatgggaaactattttaatttcttaaggggatatcctctcgttttgtgcatgtcactcaaatgtttatgaaaaatgtgaaaaaaaaaatctgagaatatgtattaacacgtggtctatcactccacaaacatgcaagtttaaattcaacttctacatctcgcaacggaaaaccaaattaaactataactagttaacgtatattcacagttaaatttgtttttttcgttgcgagatatagaaattgaatttgaacttgcatatttgtggagtgatgtaccacatgttaatatatcttttcagattattttttcataattatttgagtgacatgcaattaacgaggggatatcgcacgagatataatctagaaagaggtgacttacgttgcctccgcatccatcgcagcgaacgtcgtcctgcactgtacctgggaagagatttatggaacacgaggctgtaacgcttgaagggatcctggtaagaatccccgaacctgtgctgcgcgcacgcctcgtggagatggaaccccgcgcgacaccctcccagcttgcacacgtatctcatgtggtacccgtgctccttgcagccatcgcaccggaatgactccttcccggccgtcagtgtgagctcatggtcgtggtgctcgggagctcgaagcttactgtgccccgtcatctcgcaaaaacaatgaaatcaagtgaagcggccggctagctatgatatctacgtgcaggtgcatatgcatcacatatatgcaacaatataatcggattgggaactctaaaagcaagcgttatacttggagagcaagaacgtagagcatgctgctatcatgctactccgtgatcccctctttatatactatataagacctggccttttggtttgttttaagtcgcactttttaaagttgatcaacttaatttatagaatgaatgtagcaacgacatttcttaaaaaaaacaaataggctgtaaaaaattcaatggtggtgatgaaactaattttatgttgtagatttcgatttttttttataaaccttatgtacttaaagaagtttaactcagaataaactcaaaatatcttatacttcctccatttcacaatgtaagtctaacattttccacatttatattagtggtaatgaatctagataaatatatatgtctagattcattaacatcaactagctgggtggcccgcgcaattgcgcggctagtacccaaacaaaatcatatatttttttagtatgattttacttaaaatttattaaatagctatctcattgtcttaagattttgaaagatcaaaccttatcatcctcgtgtttctaattatatagtttttaaaagtcacaccagttgctaccccttatgtcatctacttctttatttgcttgctcgatctaccaatatttctattcattcttcttggaacctttaaaaattggattttatagtttttagagtttattgtcacattgggtttcatttttataatttctagatgttccgtcaaacgttaccattatactcctgtgtgacatgtccactgtctcttctctttattgtcattgagattttaaaaattgaacataattatcgtttgggttcattttttactttctagtagtcccgccaaaccgtcagcggctttgctattgtactcctctacggcttgcccgttgccttccttctttattgtcattgagattttaaaatcgaacatgataataattgttttttttttactttttagaagttctgaaccttaaaaaattgaacttgtagttttattttttataatttttagaagtcccatcaaacgatgccactatgctcctgtacagtccgtccgccacctactctttattgtcattgtgattctaaaaatcgaatataactatcgttggaattcattttttattttctagaagtcccgtcaaccgtcgacagctctgcaactatactcttatgcaccccgcccgctgcttctcctttttattgtcattgagattttaaaaatcaaatatgattatcaatgggttttttttactttctagaagtcccggcaaccgccttacttgtttacttcacggtctgcctgatatcccttcttttaatcattattaggattcaatttggtgttttattaacaatttttatatgtcgtaccaaccgccaccactctactcctttataggcctgttaattaatttatctcgtcatgtgttttagatggtcttttcttaacaaccgacaccttgtaagcttcgatgcctcgtgagcatggactcgtttcaatgatattttttccgtattgaaaatccaatttgaaatttatttcatattttattataaatataattaatctcattttgaattttagatggtctgtgtaaaacttataacctataagccttatattttaggcttaactacattaattaacactaaattatgctccgaggtgaatacagctccgagctgaatacgtttaaaataaatttacacgattatgattataatttgttgtcagttgccaatgtggccggacgcttctgggtgggttgcatgcattgctggtctggaatgctggttgcagctttgctttgtttgctttacctattgggggcgatggtaatcaactttgcttgtcacttgttctgccgcagcagcccaagtatatctacttcatatatctgcgttttatatgtgcggtaacaatgcatatatacttgcgttttggaatcataacaaattctgtaccgtattgtatcccgcttgaatttttgataccgtatagtaatccaattggatttttctaaacggacaggactttttaatctatatcaaagctctataattctttattttttctatagcaaatctaaaccgttgtaatctaaatctattataatccaacggtgtataattttctctttttctccgattaatgtgagaatttctagcccccacagtgaacgtggtgccttcttttcgagctgtcttaataatataatagaagatatgaatgtgggaaatgctagaatgactaatattgtgaaatagagggagtaatatggaacgaaggggattgtgtgatgttgccttaagacaagttggaccactaccttgagttatgtgagaaaaatcacacctctctacgcgtggtattaactaagtacgcgtaatcaaaaaataatataaatttcttagggatatatatctatcgtgagaaagtactatttgtgtccctactaaagatatcatcatcgcaaatgggtgataatataatcctcatttgtaatgggtatccactagagtataagtttggatgtccatgaaaatgaccttgactcgagactttaagctattttcacagcttatgcgagaaaaatcaagctcttctccgtgtggcatcaactacatacgcgcaatcgaaaaatcaatggaattaaatttctgggtgatgtgtctatcgtgagacgagttataattaatattggtgtgtagtgtggtcttgaaatttgagtgcatcatttgatccagtagagtttaagtatgtgtgaatatgacttagcttcaagacaagttgggctattttctcagcttgtgtgagaaaaatcacacctttctccatatagcactaaccatatggatgcacaatcgaaaaaaaaaatattgatactattcggtcaacgtatatggtgagaagaagtatcataggtgttgagttaagtttaagtatgtacatcacttcatccattagagtttaaataataaatatataagaatatgcgttggctcatatgacataagtaatacttctagaataaaatacgtcatgtaataatatttaattttaagtgtgatttctcaattacatggaattcaactagtttaaataaaatataacagggaaacttttaagtttctgctaacaaatgagttactgaatttctaccttgcgagtttgcgaggacaatgtatagaagaattatatggatagcgccacacaagaaaactcatctaatttccttagtgtacgtactagcacctgtttatatataacgtacgaatccgggactagagagtcccaggactgccgtaagatagggagcggcagtcccggttggtccatttttctttttttttttcccttccaaattgagtgagatgtatatacctaaatcaaacaccagatccccaaatcgtgtgctatgcatatacctaaatcaaaccccaaatcaacgtaacatcccaaatcattcacatcacaaatacaaatcctaagttacttacacacaaatcaactacatcacaaatcttaaaaaaaattacacacaaatcaaatgcatcatagatcgattatacatatcagatccatgcaataaatcacaaattgtaataaaagaaattatacatctcttaatcacaaattattaaaaaaacggagaggagaaccggcgcgttgcctcccgcctgctgccgctcaccacggccggcacgctgtcgccccgtgcgcggccccgctggccgccgccgcgtgctgccccaccacccgctagccgcttgctcgccgacgctgcccgccagatgtgaggaggagaggggaagaggaggaaggggggaggagaggggaggggaggaaggaaatacgagggatagaaggaggatatgatcttatctaaatattttggtgaggaggaaatatcatctgggacttaaccgatcagatatggagagaaatatttacttccggttggtagtatcaaccgggactactttagtgccgattgatacctcagcctcctgacatgcctctgacaggggtttgtgttactaaccgggactaaagatcaaaatttttataaccgggactaccggttcttattggaaccggtattattgtggaaaacagccgatccagcaaagatcatttttctagtagtgtagttttatctcatgtcaaatttatattcgactttattcagttaacgcgttgttaattcgtggtcgatcgatctagtttgtaggtgtagctgccgcaagataatatgcacaagcacatggatcagattaatagctgtcgttttaggcactacgccatttatgtggatcaggacacatgttgcaacttgcaagtgacatgaccgcaagtatatgcattgaactagtctaaaaataataataataaaaatagtctaaaaaagtagtatatgcattgaaccagtcaagtaaacgcaagtaaactaggtactttgatagtctgattgacacagacatatgtagcaactaaccggagtgtgtatggggcacaacgtacgcattcaaaacgttgggcattcaggcatttcagggttatgggtcgtaagtgaaaaaaaaatgtgaccactaatggaaaaacgcagttaatttacagcaagacttttatacccttacctttagttagtggaccaaaagatatagctaagtgataaaacgatgaaaaattcccaataaatcctaagagtacgctttaaaactcaacattattaattgtctttgaaacaagcaagcctaatcaacaattctgattttttttttggtggatggcacatggagcagtgttgatatgcttagatcgaggtcgtgcgtttggcggcgaccttcgtgagcgtggttagcggacgggaaccgcggcaggatgtggtgtgtactttgtggcagtatccttgcctagtcggctttgatgactttggaggtggtaatatctaggtcaacgactgatattctccgatgttactccagttctatttaggttcgatgtcagatgtgagcaaaattcgattagcacaataatcagccgctgatttcacagaagataaggacttcatacaacacaaaattcgattagcacaataatcaaccactgatttcatagaagataaagacttcatgcaacttataagccattgagcagaaacaacgaatggctatgtagattctcgccaaacatagattaaagtttagcaatacctattatctttatcttaaggttggtatttttaattcgtagccattcgatccagccacaacctacgtaataattggttatagcttctttgtagcatatgttgggatgaatttcattttaaaaaatgtgtattgctagattccaagagcataaaaatttgcgaaaattaggtcacctaaaaattacacattcataagcctaaaactgcatcggtatgcaatatacaattttacttatttttaactataatattattcttatatatagttttgatttattaatttgtatctgagcttgagtacttctaaaaaaaaattaaatctttatctttcatgtagtttggtaatatttattttttaggttagaatagtttacaaagtagcgtgcctcgctataagacatgtcacgtgtgtttgtcatctttatatatgatatccttataacatgctttaaggcatgttatacttgagtatgaagtatgaatcttttcactcccccccccctctcttcttattcccctttcccttttaaaagttgccaactatgcaaggtcaattagcagcacttctctcacgcatatgcaagtagctagtagtgcatgtgcatgggcgactgacaaggagcattctcgtaagaataatcaacaccttatccctatcgatgcctatcgatgtactcgtttacttggaagtttggaagttcacttgccggttcttacattctaaaccccgcgtggtacgcgacgttattagatactacatatactgtgtacctatatgtttctcccactagctagctaattaattaatctctcgtacgtttctatatatataagtgaccgcgagatcgatccaagccacggtatgctatgagctactgaaacctacctagctactcaaaagatcgatctagcttggcgagcgtgaggtggtgaggtacgtttacgtacgtacgtatactcagcatggccgggtacaccgaaattttggacaccaaccatcacgagcacaaggtgtgcttggttcgcaaggacgaacctttcatttgctctggctgcaaagagctcggcttcgagctccggtacgcttgccacactgcgggctgcaaccatcagtaccacaggtcctgtacactgcagcctctcaacactcgcgtgccagctcccttctacaagcacgacttcttcttcttcaagtcggtcagtacagctggtgcccgttgcgaggcatgcgctgctgaggtctccgctctcttattcttaattactaattcctcctggcaaggtttatgattagatatacttaagtctggcttgtatatatttatatttgcacgtatttcgaataacataaatacatatttaaaaaccaaagtaattttgaataagataaatgcatatttaaaaaaaatcaaaggagtcatccatcataaaattaagccggtgataatacctccgaaacatgagaaactatttttatcccttgagggatgttccctcattgtttatatgttacttatgttacttaaatagttatgaaaaaaattgagaagatatattaacatgtgatataccactctacaaacatgtaagtttaaattcaacttatgcatctcgcaaaaaaattaaattatagctagttaacatatattcacagtcaattttattttttttctttgctagatatagaaattgaatttgaacttgcatgttcgtggagtgatatatcacatgttaatatatcttctctttttttttaaatttttttcataattatttaagtgacatacaaacaacgatgagacatctcctcgagttatcagaatccactcccccgaaacatatgttgatgtttctttccttggatggcgaggcatgcgctactgaggtcctcgctctctccattcttaatacttccttccggcaaggttgaccttgactgcaaattaatactctctatgactttttagtaaagaacgtcgttttgattttttacatagatttcatcatttgacttattaaaattttatataattatgatttctttattatggtttggtttatgattacagttacttaagtatgacttgtatttttacatatttgtacatattttgaataaggtaaatgcatattaaaaaaagagacgtcatccgatccattgtaaaagccggcgataatacctccaaaacatatggagttgtttcttttctttggatgtccctcgtttcttacatatcatccaaacaatataaattatttttgacaacattaatcaatatgtaatatatatatatatatcattatgtaaacatgtaagtttaaatttgactcatacaagttgaaaaaaagataatgaaactaactagcaagctagtgtattgttcacatattcacagtcatatttattatttctattccaacttaatttgtatataggttgaatttaactttaatgtttctgaaataacataccacctttgatctatattattagatatatttttttatttaagatggcatcgaagaaacgatgccttaaggagaaaaatgactttccatgaaatatatatgtattcacgaaaatagtattagtagattttttttcctcaaaactactccttcaatttaatcttttagaagaataaagattaaaaggtgctagccatatacattgagaataaaaaagttgagaagatatattaatatgtgatatatcactccacaaacatgcaagttcaaattcaatatagaagttgaatttgaacttacatggtttaatttgtttttttcgttgcgaggtgtagaagttgaatttgaacttacatatttgtagagtgatatatatatcacatgttaatacatcttctcaaattttttcaattttttatagctatttgggtaatatataaataacgagaggatatcctctcgatgaaaatagtttcccagtagaaaaccctttcccgccgttaatttacaccatgctttaggaagctcgcaggtgcgaggttacgtgtactactgcccggacaagaaggtcagcctgcacccttgctgcgcagatctcccccgcgtgataaccaccgagacggtgcagctgaaactggagaggaagatcaccaagaaatgcggcatgtgccacgagcggaatcaggggagcttcagcaacccatgggcctacgcctccagcgagaagatgatccagctgcacgtcgcctgcgtccggaaagctctcgtttcgcagttcgagtcgaggctttacggcgtgcaaaagccgaagatgctgctgccgccgccgcctgctgctggagcaagcgctgcttcttcaactagtagttcgactgccattgtggaatgcaacagcttccccgtgctcgaggtggataagtaccggaggaaatcggccgggttcctcgatacgttcaggcggatcgtcagggcagtcatggccatggtctcggcggtgatcaccgggaaccatttggagatatacatggctttcatagaattcttcaaaccgaactgagctgacaacatttgcatctttgcggtttggagctcgtgtgtttgtgcgcagcaccagtttctccctttaaattatagatttgctttcagaacttgaaaatgggtttgggtggtgtgtggtggttcttgcaagttgtaataagggggaaaaaaaggaacacatttgttcgtacaattttcaacatatatgtataagacgatcagtttaactggataaggtggttgtttaagctgcagagatgtttttggattttgagttatgacaacatgcaaatgattttccgaatgtaaattataattaaattttctttcagaacttgaaaatgggtggtgtaaaaaaaaacatattcttcatgcaagggaaccgtgaatagttcaaagtatagctcaggtgacatggtgcgagggtgttcgcccagtcaacctgggtcctggttttgaatcctaaatcagacttgtcgggcctgttcactttaatgtcattttcaaccttaccaagttttaataaagttgccaaaaaaatggctacatttagtttgtagctaaattttggtaactatataaaaaatcctgccaaaattttggcaagttaccaaaattttcgcaatgccaaaatttggtaaggttttttttttatcaaagtgaataggcccgtcatctcatggtgtttcttgtaccccttattcttaatacaaagatagccagctccgttattcctcttttttttttttgaccaaacgttattcctcttttgtttccaaaaaaaaaaggaagcgcaatctggcatacatgcatgcaaacacgaaccacttaacagttggaacatctgaaaaccccggccagccagatgctgaatcaactgtcgatcatgccgctgataggatttcgttagaaatagatacacacacatatatgcatacactgatacacaaaagcttgacctggagaatcaggccagagtatcaggttgagttgggactgtgggagctagtacaatcacagagtcgttctcaaaaactgtacaatgaagtagagaacggccaggaaaagcgcaatctggtacacatcttggttcaatccatcatccggcctttggaagaactgcaatattgaacacaaaagctcaaaaagttgaaaacactatcactggatagctacagataagtgggtgggtttatataaagtgacatcaatttttgcaatgtatgattcatgtaccttagtaggatcccctgagggatctggataaacctccaagttctcatctttctttgatgatagccgagatgctgtaccctttgcagcttcgattgtgtcctttccggcttcaacagtggagaaggccctcctggacaaccaaaagtaggcctgggcaggaggagacgaggcagagaggtcccatgagtcgacctgttcgagcacttggccgctaatctggttcaatacgaactgtgaggtaacagagacgatcaggtctcctccgatggttgcgaagattggattcttaggtttgcctctgaatgtccatttgatggtcaggttgcttgtcgattgcattgacatttcctggactgtctgacgcaataacacgaatgctgattagatagtcagactggaatcaatccaaactcatgagcatgccaatgtgaaataaggagagaggcattctttgtttgaatttgaactgacaaagtcctttttcttttggacagtatgttatgcaacttgtttgggttagatatcttacaacagagttctaacttcatggatatggtatagaattgcagcaatccttaccactgtagggttttcgagtgccttggtgatccacaatggcctcttgtacttctcccgtccaacaaatgttctgaccgggtcctgaaaaaaaaagaaaggcacgaaaccacaaggtgatgtcaagtagctcatcagttattgtatctgcatctggacatcctaatctgtcactagttcagtagtttgtttcttgctgttgtttgagtggtactttcgttgctattcttcttaatataaaatcagcatcagcctggctaaaacttctgaaaatggaggcatgttacctacttaaacattcatcagatttcctcggggaaaaaaaacattcatcagctaacagcagtattttgtgttggttcatagagcttttgcaagagcttctcggggtctactctgtgcctgaaactattcttgttggtgttgctaaaccttcggagcgaatacgcaaaagcgttactcgctgattgaaatggcatagctctatttttcccttccaagaaaaaaaaaacagatagtactgttaaaaaaaaaactacagatagtgtttgccacagttcatggaatcccatgatcatatcagactcgtagcttacatgtttgctagattaacttgaaaggagatgcaaagcattggtgcgagattggtaccaaattaatgtctgaattactgataacacatagtacggagtagcagtaaagtggtaattggtggtacaagggtgatgcgcacaccttgtatttgacggagacggcgtagcaggtgaaggcgcggttgtcgtcgcggaggtcgaggatgtcgcgggcgagctgcctcgcggtggcctccacgtaggggctgcttatgcactcgaagtcgttgcagagctccccgaagtccatcccgtccaccagcttgtccgtctgcgacctctcctccgcaccatctccggcagccgtctctacctccttggaatcatccacaactgcaatcacgcacagagccgggagttaattagatcacgtacgtgcgagctggaccgcacggcgagatcgcattggtgagatgagatcttcaccgtgcaggggggcgaggcggcgttggagcgcgggagcatggcggcgggagaggaagccggtgacggcggcggggatgcctcgccgtcgccgtcgccggggggaggaggagggggaaagggtgcgggaggagaagagagcggcggcggtggcggtggcggtggccattggtggcccatggcgcggtcggcgtggcgggacgtgaaaaggcgggaggataaggcgcggcgctccacggcctctcgttgccacatgtggcctccgctccattagccctggcccaacaactgctagtccattccatttctcatttctcttctatttttcctcaatttttttaagggaaaacaaaattggcccgtgccaactactataggtctagtattttctagtggactgccttcttctaggcccaacgaggaagatgtatcccaggatgggcatgactttcctgagctttcacgtgcctctagcttcgtgttttgttgaagaacacaatgttttcttatagaaactgttctagaaaatcatgcgtcacttatgtaattcttgtattctgccctctctgtttcatattcattttacgagttactttgattaagtatataaaaaatatcatagtattttcaacacaaaacaaacgtattattgtaacatattgaatattagatttgataaaactaatttaatgtattagatattgctgaatttatttataaatttgatcaaacttaaaaagtcaaaggtacatgtaatatgaaacagagaaagcagatgggactgcaaatgggagatgattttgtggatgaagtataggtcctgtttgggggagcttttagcagctgcagcttctcctagaatcttcagttgccagaagctcccccaaacagttcatcttttaatctagattttgagaatctgtagttgtagaatctgaaaaatgaactagaagctagaagctgggacccagcttctccagattctcactagctagcttctcagcagctcattctcagaatcttaagctccccaaacaggcccatagacacgaagaatacctctgttgctccaaaactgcccagtttacggacaacaaatcgaaagatgcacctgtgatccgggctacatgcaacagataaaatatacttgcatcgaagagtactttactcctggaggtaatcatatacagtatggtgataaagtagtgagttgtcctctttgtagtggaggaggtagtagcatttgtcgcagaaataacagggattgttcagagtccacttgtcgtccaccgtcatcttcgtggcatggaagatctggcacaccgaacacttctgtagccgcctctgcatctggaatgtcatgagagggtattccgcttggttctgtgtgtcctccgggtggatcaacctcatgtccctgatcacaatcatgtgtttgcagtttccctgaaaacgtatgtgcagggtattgtcagaaacatgggggaaagggttgtagatctctacctcaaccatcatacattactacagcttcaagttaatcgattttagatttcatcacaaaacatagataacaaacaacacaaggtttgattgtgactaaatgacgatttgatttccacaaaaaaagtgatgcagaaacatcacaacaataaaggcataaggagaatagataagaacctgatgacagtagaggtacccagcaccgagacggaagttcagatcagaaaagcgagtcttttccatttttgcagatttaaaatcaggaacatttgaaacattcaaacccatcagtaaatccttttgtcgtttcttcagcacaccagaagtaatggcatcccacttctcttccgcctcatttctggaatttttaatccagtcaagtataggtttactataatcaacagtagaacgccttgtgtcattatagaatgtgtcctgacaatagagagcgttgattaatacagttgcaattctttaagaacacacagcaaatttctgttcacagatgcatacctcaataagaaaataaccagaatgaacgtgttgctttgccacattcatcagcttgtctttgaaacagtaaatattgtctctaagatctgtaaggagctggcttcccaacactagaaattcctggctctgcaaggaaaggagatcaccaaaaaatttattccccacatatttcaccctacaaataagtataccaaaaaatatatgtatataagtcattactttcacagagccatatctcttctcataaacttccacacacagaagtacttctggatagactacaggtctgtgctccccaggtttgaaagttttgttctgggataacaaaaatggttagtgtgaaatttgagacaaatgagccacttgtgtaaaagagcaaatgaaataggctatagtttttaatgcaaaccttccaagttgtgctgatgtacctaagagattttgcaacatcaactttctcagctgatggcttagaaactttggccaacacagaatcaccactgcgttcaaaaaaatatgtttatagaaggctgtaatgaaaacaatataacagataaaatcaaatcatctagttatggccataagtgcatagcctggacagctgtattttatacttatcttattctctagtggctcagttataaaaaggaagcaaactattcctaccgggcataccatatatgatttacataaatgggctaataaataggatacatgagtaaatgtatgggctaatcaaaatccagtattaaggggaggtaaatttctatacctagttagttcagccagcacagaagtaccaattttttactgaaacatgaatctagccaaactgggctgcatcctgctatcatctgaaccacaaagaacgatttacattacttttacactgttatttgccacagcccatcagtaaaagttcaaattacttatcaacagaaattccacagctcttcagcaaagctgtgataacaccatcccattcggtagaaaattaaataatatatatctatgagcttatggcacaatcagaaaatggaattactaacaatacatacccacaaatcaaggtcaaataaatacatgcccacaaagttaactgttttacctgaatgagtgcaagctggctgcatgtttgtcttcctcttgtttggccttaatttctgccatcttcactgctttagtaagatagctcccctagttatagccatgccacaacatatgatgacgcaaaaccatggtcagattttccagagattaacaatagatgcaagaagaagagggaaatatgtatatatatttttttagagaaaactactatacaagataaattcatcagaaaatgcatgcaattaagcagagatgcaacattagggtaaggcatacttgtaaaatatgtgctcgaacttctctatcaaaatgcctgcctctctttttgccctttccgcattttgtatctccatctgcgcctgcagcatcatgtgaaacaacttccagatcctcgacaggtggtacagactcatgtgaaacaacttccagattctcgcctaatgaatttgaagtggtatttccaccttttttcattcttcctctggatttccccttcatgccacctgttttcccttcgatgccttgttgtggtacgtatggtacaactgccgtgtcaacagatggtccaggtatctccgtttcaactgacgaatttaaggtcggagtgacattttttcgcttcctgcctctagtttccccttttacccctcttgttttaccgttgtttccatgcacatgtggtatgcttgccgtatcctcagtaggtgatctggaagtctctctctcacctgatgagcttgatgtgatagcaccatttccaaaggtggaactagctgacattctgcatgtgatagttcgaaagaacatcagaccctatcattttgtgagccacataagacatgaatattaaatataataatatgaaaagaaaatttagatgccaggaattcagctacaagccataaaaattgaaaagagatgatttggtgcataaagtgcaaaccgctgttccatgctaccaattcacaatagaactttctttatgagttggcatggaatgacgctatccaacaattaaccgtccgtgttgcatctaattccaactcgcataaaagaagcaccaatcaagcaaaaatagcttaccctccatcaatcctctgatcctccagctgtgacaaagcagtggaatcccagccctcctaaaaacaccaaataacagagacatcacatcaaaatattgttcacaaaactagaactacaattaagcacattagcataagctcgataggaacggtcacctccatagcctcccggagagcgcgctccaccagctcctcctctgagaggaccctcaactcatctacgctgcagaatccacaaaatgtacaaaccagaacacgaataagcatatgaacaacatgacagacactgggggatttctccacctgatacggcggaatttggggggcttaccagagctcttcgtcgaattcatcaccaggatcgcccaattcatctttcagcgactgctcgcaaagtaacacagaacgcgattacaccaaagcaagggcacggattgaagagctagggtttggcggtgtgctcaaggggattcgaacctgcagctcgtggagcgcggaggacatgaactcggggaccgtggagacgggtccgaccatgaaggggacgaacacgggcccgccacgagcgaagggcatgcgccgctgctcgccggcggcagagctctccgcctcctcccccgccgccgccgccgccatcgccgtgtgtccgcctctttcgctggttgggggggttttcggcgccaatgcggtgggaagaaggctaaaagctactgggcccagtataaagcccaatatgaagaatcactactgggccgtcgtcgtctccgtcgagtatcgtctcgctccagagcactcggctggcgggcgaattttttttttaatatttacagaaataatctatcgaccaaaaaaattgcagaaatagcccctgccgccccaatggtgggcggcaagctgacgtggcagacggtgggtcgaccacgccgtctgccgccgtcggccaaaattgcgattagaccctagggcggcaaggggctaattgcaattttggccgcccataaagagcttgcggccgtaattttttcatctgggtcccttgccgccccaatagagagcgacaagggacccaaatgaaaaaagtacggccaaaagatatttctatgttatgttaataataaataaagaagtatttattggtaaaacttgttaatattgttataaaaatgtattgaagttggttgttgcgcaatttcatatgttaagtgaggtattattttgtaccttattcgatgtattagtactcagataatttatataggcctatcgcagtctgggtcatagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatatagtaatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaacccttctggtatctatccattctctgtattgacatctccttggtggttcctgggaggaaagattaaatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacaaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcaaccttcttgtaaacaagtggttaggtcgagaacgggattttctgtatcgacccactcgatgtatgcacaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattaattggcatcgatcaccgcataggcagagaggacgctggcaccaaggtggtagtaggtatacacaaggatcgctacgccagtttggatcctcaacaccccggcgtctagccattgacgaaagccggttggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagttacatgcatgatcggcgccgaaagttacattggtcgtatgcgccaaatggcgggcaaatatcgtatcgcacgcgaataaaggaggctgcatcggtgcggcagaaagtagtcatgcatgcgccgaaaggtatcgtgcatgcgccgaaaggtatcgtgcacatataacaacaacgtagtcattacacaagcatacagtactgaaaagtgaagcaaataaacaaagagaagattgctctactggccctgccccgcgccgcgaccacgcttggtcctccgggcctgtgctcgcacgtagtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacatcctctgtcgagcctgaagcgaagtcgaagtcaaagtcagtgatgtcgaagagcaaggtggaaggcagcaagcggtccgacgaggtcccagcatggtccagtggtggaccctgactcgacgtgccggctgcctgtgatgaagtcccggtgtactgccagaactgcgctaagtgcgaggtcgacgcagctgcctgagacgctgaccttgcagcctgggagaagtgggcggcctgcgtcatagcgaactgggcgaaacctacacatcgacaacgggacccttgtaagctaagacataatgcatgtaaattgattgtcgaagtaatgttgtttttttaagtacctgtggggggcacaacagaaggcctaaccgaggaaggcggggtgctgaacggtgcacgaaaccctgaagcaatcggcaggtgaaacggctcacttatatgtgcgaggcatgtacagaaatagtaataaaaatacttacctccgtgcggagggggagtcggcctaggaacgtgcgcagctggacggggaccagtcagtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaatgttggatcgtcgttgaaccatcaacgacgacccggttgatgtcgtcgacctgcatggttaatttgttcgtaaatattcgtaaaatttgatgaagagaaagacatgaaaacataaaggaatggtgcgatgcagggtactcacagcacgagcgaagtcctggtcgtggtgcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcgtggtccacgacctcctcggttgcgaggaaccagtcctcaacaaaagtcgccaacgttactagtgcgaaacgtgccgtcagatcgtcctaccagtccacagccgtggtcactggcccaacagcgtctcccgcgagcggtagccccaacaagtacgatacgtcctgcagggtaggggctacctcaccgcacggcaagtgaaaagtgtgtgactctggcctccatcggtcgaccaaagctgctaggagggacctgtccacagtctattgtctggccgggtccgcgtcgccggcggcagcctccaccagccgacacatcggtaggaggccggcctcacgcagcctgcaataacaaattaatatgtcattataaaaaatattacagcgcaactaacttatagtaatacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatactgacgtgccatctctgaaaaatatagtgtttcgtgttagaacaattcagaaagtagtaatgtaaaacaaaagataatttgcaaaattatgaaatagtaataaaatcatgagaataattatgtacaacaagagtacaggctatttaaatatagcaaacgttactaatggtacactccgatgacgtgcaatttaacatatatgtagagctcgataatataacataacattacgtgtcgaagtccgacatacatcagcatacctaaagacgttaggcgccttagtccgacgttacatcacgagaccaaaagacatgacatgccgaagtctgacattacacgacgaaacatagaacataagaactacaccacggagccagacgtggcacgacgacgcctaggacgtggtcgagtggaggtagtgccttcacccgtagggcgagctccatctgctgttgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactatgacacatatattgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatactcatgcctgccttatcttgacatagtatctcaaacctgtgctgttgggtaccttgcactagagctcgatgtttcatggcctttttatgcaactcctctagctttttctgcatgaaagctccaaacaaaatgctgttattcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagctgctgcacgctgatcactgcatttggctgtcaactcatctaatctcttccaaagctcattgaattttttctcctggttatgattgcacagcctcttgaacatgttcatgagctccttgttcttgaattgcttgaagaaatcagcccccatatgacgcatgccccacctactctatacatcttcccaaacaccggggtatcctcgttccatactcccaaactgcaactcttctatcgctcgcagaatgccaacgtgcctatcatgtatcatgctcacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgctatcttgcatgcatgtagagctaagaacgccctttgcagcacactcttgccaggatgttcaattgaggggaatttcttcacttcgtaagagctctcagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatatgcgtgcactctccagggacaaccatcttttttcttaacacaccgaacttcatattgcgaccggttcgacttggcaacccaaaactctctatgaagtgacactgcaaaatgttttactgcttccttcatatcttcttctctactataaatcgctccctgaataacctcattttctttgtgctcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccacttcacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaactatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaatgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatctggcagggcttcgccccttcttctcttctcctcccctctcttcttttttttttcactggaattgaggagggaagaatgagggctgggggctaggcggcaggccttttataggcagcgaggcctgccgcccggctagagggcggcaaggggccacctgcaaaatggccggccccgactggcttttttgcattcgggccccttgccgccccaccagagggcggcaagggttttcctgcaaaaaaaccctccctccgtcaccgcccgttcctcccccgtttgccacgtcaacttgccgccctagaggtgggcggtatggtctatttttgtaatttttttggccgatagattatttctgtaaatattttaaaaaaaatctaaaaccgaaaaaaattcgctggcgggctgggtgctctccaccgccgacccgtgactcggcccggtcgcaacgccgccaagctactccactatatccagtattatggttcattgataccgattagatttagctactagatgttaagagagttacagtaaacttattcctatttttattgaaattgaattattcttttatgaaattgaataaagactgttaaattcgcatacccaagggtactaaggccctgtttgttttagtttaaaattattgtaatctagattattgagtcagattattataagttggattataaaaagcctacatagaataagctgttagctgtttgtttctctgaatcattagctctacatagaataagttgttagctgtttgtttctctgaattattagctagttgttaggtgttagccacccagtatagctgtttgtttctcggaattattagctagttgttaggtgttagccacccagtaatctaaaaaaacacctttagagtggataactagattatagtaatctagcttatagattataataatctatcaaaataagctatctgtttgtttcatcttacttctattaatctatattataatagaagtaagatgaaacaaacatatagcttattatgatagattattacaatctataaatccactctaaatgtgtttttcttagattattgagtgactaacagctaacaaacagttaataatcaagagaaagagaaacaaacaatcaggtttggaaattccagtcatttcggacctcctttgatacgatattatttcggccaaaattttattttttttaacttttcatgaatttcagtaatatttgttcaaaatttcggactaaaatttcagaaaatttggtctatcggtgacctccgatacagtcggtcaatccaataaattaaaccctgcaaacagtttattctatatcagcttgttataatacagcttatagtaatctagatcaataatctagattacaattaagttaaaacaaatagagcctgaatcaataagcatgtaaaatggatctcaaccataatagatttacaaagtcatgtttatgcgtcacttacaaagttatgcttatgcgtcatgtccaaatacgtgctcattcaaataattggtttcgataagcaggtttccgttgctacaaagagaaaagaagatctatcaggtttccgttgcacaaagagaaaagaagttcccatgagtcatcgcttgtcaaacgttgtttgacgatatccttctcccaattattatccatgagcgccaattatcatccataagtcatcgcttgttgtttgacgatatcttctcctaattattatctcgttttcaatctaagataattttccgtgaaaactcgataaaaaagaggaaactcggtaaaaaaaaaaagagtactgggattgctggttctcgttctagttcgttgaacatcaatttcacaaataagataatccaattcatgaacatcaatttcacaaaaaagataatccttacactgctatctaatcaaagtataaccctccagtctctccaggattgctatctaatcagtctctccaggtttgctatctaatcaaagtatcgatcgaaaatccatcagtttatccaggatttcatcaacacagaagtccagcgagctctgatcgtcccctcctcgcagcggctttttccatctctgcataaatcaaactactatatacacaaaacattctcaaaaacaaaatctttagtcaaaaaaacactcacggttcaaatgactaccgtttcgccgtcgtcgaacgaccacagccgcagcggttcgccgccgtcgtcgtccggcaagactaccgtttcgccgtcgtcgaacgaccacagccgcagcggttcgccgccgtcgtcgtccggcaggaggctttgtggaggagggatcgcgtgttcgcgccagattgcttcgaatcggttgtgctcgatcatgtacccgcccaagttgatgtgctcgccgtcgtacgcgacgccgttcccgctcgccgccggcggcggcgcggcatcctcctgggagtccaccatgagcgcgcccgcgtgagcgtgcgcgtgcgcgcgctcgagcgagacactttgttcagcctcgtcggcggccttctggatcgtgtcgctcgcggcggccagggagacgtcgatggatcggagaagctccagtagctccacgtcgggcatggcggcgatgccgtccacctgcgccgccgccatggccaactcgccgccgccgccgccgggtccttgctttgcggcggcttggttctcgcagtaggaggcgttgtccacggagtgcttccgccgatccttctccggcagcgatttgtaccgagtggcgatcgcccagacctcctccttcgacggccaccacgtcggctcgcccccggcgccgacgcccgggcagatcacggcgacggggacgtcgcaccgcgtcgcgagcgagctcgccttcctcaccagcctctccttcctcatctccaacgccgcgcgccgctgctcgccggcgacggcgggggtgacacgagcctctccgccgccgccgccgccgcgcggcatcggtgctcccatcatctcaaacgtgtgcgtgtgctagcagatgaatcttgtgctagcagatgaatctcctctcgcgcgagttttgtaggctgctccccttccgggcccaagaagcgcacggggttgggcctgaacacgacccggagttcccttcttttttttttttttggaaaaagtccacttagactcccttaattgtttaccaaatctaattggtgaccattaactgaaacaccggataggatgactccccgaattattgaaactagtgcaatttgactcctccaacggttttacaggacggttttgctgacgtggcggtgctaacccgattttcattctacgtggcgctttcgtgtcattagaattaaaaaattgtttgtgggacccatttgtcacacacaagaatattatgggacccaccgacatgtggggcccacatgtcatcctttctccttcccttcttcctcctccctctgactcccttctctctcttttctctcccccttctctgatctgatctcccgggggcgcctcttcggcctcactcgacagcaactcggcgagatcggcgagcgtggtgaccgacgggcggcggcatccatgagagcaggctcccgggggcgcctcttcggcctccctcgacagcaactcggcgagaccggcgtgcgtggtgaccgacgggcggcggcatccatgagagcaggccgggcggcgcagatggagtcggcggcgacgcggcgtggatctctggtggtggtggaagcggggcggagcccgaaccgtcctggctcgcggaggatggccggcggccggtcggcaacgggcgcaaacacccggctctggcggcgaggccctccagggcgggcgccggtcggcgacgggcgctcatccccctggtctccggcgaatggcgtctttctctcagatcaatcagcaccatcttttcacaagatggccggatcgagtcaaactagaaagcaacattgtatcaccggggagattccacgccatttgcagctcgacgacatagacacgggcacacggccgatattacgcgtacagcaatctgacaaacgcgttgttattcccctctccaaccttcctcgatcgtatatatggcagcagcgcagcacgtcgtcatccggccatggacgtcacgggagctggtcgcctggtcaggccatggcggagcagggagcggaggggtcgatggcggcgttgagacgaggcgatgcgctcggagccgaggacgccgtgggagcaacgcggcggagggggcccgacgacgccggccgtggacctcggcgcagagggcggaggagatccggcggagaccgaataagggaaggagatcagatcagagaaaagggggagagaaaagagagaggagggagagagagggaggaggaagaaggggaggagaaaggatgatacgtgggtcccacatgtcggtgggtcccataatatattcttgtgtatgaatgacagatgggtcccacaaataattttttaattttaatgccacataagcgccacgtggaatgaaaaccgggttagcaccgccacgtcagcgccacataagccaaaccacactctaaaaccgctggaggagtcaaattgtactggttttaataattcagggagtcatcctacccggttttctagttaagggtcacaaattagattcaatgaactattaagggagtctaaggggactttttcctttttttttttggcaattgcttatttgaccctgttttgccgatttgaccctaccttttgaactttgcttatttgaccctccttttcgagtacgaaggttccgtctgaccctctttcgctgactccgttagggttcaatttttttttaaaaaagaaaatgtttccagagttcctaatggcaaaaataccctccaaagccaaaccctattctgactctctctctctcactcgtgcgtacctctctctcacttgtgtgtgcggcggcggctagctaagggggcggcggcgacggcgagctgagggggcggcggcggcgtcaagcacagccccgccggcgcccgctcgttgtggtggagggcagcggcggcggcgagctgaggcggtggcgacgacgtgatgtacagccacgccggcgccctgtcacgccccgaactagtcccgactggaactagcccgtgacgctccaaattaacctgttaatcgataccagtcccagaaaacagtgctggtatcacaggaagacagaatatcacagcaacagaggtctctttattatagagtagtagtacagttatgttgggctgcggacagaccccgagctcacaactgcattacaaaaggaaaacggaagcaggacttggaccaaacaatacaggcacgacttgggaactaggccgaaaccctaaaactcatcgtagccggcttgctcctggaagaactcctcatcagcaggatccgcttcatcttcttcagcaactaggggggaattatttatatagggcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcaatctttagaaatgaaaacaaggttggcacccggccaacagcttttcaacggtcacccgggcctacaacttttcaaacggccacccgggcctagctgatcccatcagctacagattttcaaacgtcgaaccccttttcacaacagcaatttcacaagcagtagtcaaacaaaactacgctatgaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggtatttccaaagctgacacaggtttaccatatgccgacgagaggggtcccagaccaacaacaggttaggtcccagaccatactgtgccaggaagcccaggggtcctccccgacaccaccccggcgaatccacatgtctctcggcatcaaggcacccctgataagctagttactcagccaggggtgtcccattccacccatatggtcgtacttgtcttatgtttggatgaaattccaaggaaacggtccttaagtgcaagaacgggaaaccgtacacccggtatgttccccggtccgcggttttggaaattcatttagttcgcaagcaccgacccaggtgtcgggttttccaagtcttttgcaaaacccaagtttttacccaagttgttactcagattttaagtttgaaggcgtccgtcgatactcgcgcagggtgcacgaatatcgagacgcaactagatggttacaaggggacatggtatcgcaattaacaaagggaggatcaaatgcaacaaaattaggtaggtccgccaatctgccttgcagacgggacaagcagatcaagtgcgatcctatcaatgcataatattttgcaagcaatataattaaatttcaaatataggctcaagatggtcaaaggtggcttgccttgctcgagagctgaagcttgatcctcgaaatcctcgcactgcgggtcttagggctccgaaactacacgcgaaacgggacaactcaacaaacggcgaaaataaagccctattaatgacctctaagcgtgctattagatagatctcgagatttgaggaattttggaagttgaacggagtcaaacggatctacggttgggaggatattgaatttctaagattcttggatttttcgtctaaaggaaaaggatttaattaaatccttattggaaaagaaaagaaaagaaaagaaaagagggatggaaattagacttccctcgggcggctagggcgcggcccgagagaaaaggggcggctcggccgagcttaacgggccggccggcccaagaaggcggctcagaacggcccaagacgcgcgcgcgcgggagggaggagagagagagccggtggaccgggctcaccacgcgcggtctcgggtgggacccgcttgtcagcggcttggctcaccgtgcggagggagcacgcgacgcggcgctagggtggggggaaggacgcggtgcacgcgcgcggttcgcggtggacgcgggtgcggcgggcccacgcgtagcctcacggctcgtggtggagcgcgcgcacgggaagggactgaccggggtcggctcgacccggtctaggctgagctggcgccgacgtggcgcctacgtggctgccacgcgggccggcgggaggtagacgacgacgccgaccggaacggacggcggtcgacagcggcgagcggcggagcgaaccacggcgataccggcgaaagcgagcacaccgggtggttgcacgagacgaggggagacgagccaacggctcggattcgccggaggaagcttgacggcggcgaatcgcggcggcggcaaccggcggggagggaagaggggaaacggcgacgaggtcacgaggggccaattcccggcggcgagagcatctatgcggctacgggaatccgatgctagcgtcggattgggcggagctacgccgagcgaggctggcgacgagcgggtgctacggagctcgggcggcgacggcggcgggcacacggcgagtgacggcaacggtcggggcggcgccggctagctacggggaggctactcgtgctaccaccgaaaactaagggggggagatggagcgaggaggaagaacggagggaggcactaccatgaagaggaggggcgctgagacgagaggccgacggcgcgggagtaatctctccggcctcgggccggggaagaggaaggagagggcgcggccaaagtccccttccgcgtcctagtgcgcaccggctcctccggcacacacgtgacggctgcggtcggcgagagggacgacaatggcgcgggcgagaaacagagaagattgggaggggaaaaaggggaagggcgggcgcctgggtttatagggggcggcaatgtcggtttggaaaccgactttggcggtcaaggcgcgggctggcgctccggctagcggccaaaacggcgacaggagggagggaggatgacgccggcgggaggaaaacgggaaaaaggagggggagaaagggggcttgcccccttgccgatttaggaaaaaggaggagggagccggaggcgtcgcggcagagggaggagggctcggcctccgtcccttggcggcttgcgcgcggagtggcggggccgaggcgatgacggcggcgatgacggcggggcggtttggagcggcgcgacgacacgggcgacaggcgcgggctggcgcggcagagggtgacggcggcggcgaccagacggtcggccactcggcacgcgcgcgcggcttgcagcgggagggcgcggcggatggaaggcgcggctcgagcacgcgcgctggctgcggggccgagcgtctgctggcgcgccagggtagcggggccgggcggcgcagacgcgacgcgggcgaggaccacgcgggcgcgcgcgcgcgaacgacgcgcggggagcggaaaggagggacggaaaggaggactcggctcggcgcgggcggctcacgcacgcgcggacagagcggagggagcggaggaggggcgctcggcgcggcatgcgcgctcgcgcacgcagcggcgcggcgcacgggcggggtggagcggagggagacacagagagagagagggcgccggccagggcgggggagatgggccgagagggattcggcccatcgaacccgggggaggcaaactagacttttgcggaggaatttgatttggagggatttggattcggaattgaactcgatgatagatcggggattgagatcttgagatggcacggacactagacgacaagcgaagaaacaaatttcacaattagggtttttaagagataattttcccgctaggcgccacgacggaacgggcgatacagaccaaccccctaacaagaatctcgaccccgagattcagcacctaagggagcagctccgggaactcggcgtggagaagatcttctcgctcccaggtcgcctcatcttcagaatggttgctccattggactttgtagaacttgatggtcttccttcgagtttgacgttctgcctcttcaagaaccttgattggtctttccttgtaggtcagattcttttccagctcgatattacccagggggacttgctcttctggaactcgaagacatttctttaactgagatacgtggaacacgttgtgcacatctgcgagaccttcaggtaactcaagctgataagccacttcgcctcgtctggcagttatgaggtaggggccgatgtagcggggtgctaacttgccggacatcccaaacctcctcataccacggaggggtgatacccgcaggtacacatgatctcctttttcgaacttaaggtcacgcctccgattgtcagcgtaattcttctgacggttctgcgctgtctttaaatgttctcggattagcttaacttgttcttctgctgccttgagtatgtcaggaccgaataccagcgcttcgcccacctcattccagcacaagggggtgcggcactttcttccgaacattgcctcattcggcgacatctaaatactggcctggtaactgttgttgtataagaactcagcatacggcaaacaacgatcccaagtgccttcgaaatccagggcacacgcacgtagcatgtcttctaggatttggtttactctttctgtctgaccatcggtctgcggatggtaagctgtactaaagtttagatcggttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagccggtttcgtgagctggtccacgattacccaaatggagtcgtacccgctaggggttcttggcaaaccggtgatgaaatccattccgatttcttcccatttccactcgggaattggtaggggctgtagcagaccagcgggcctctgatgctctgccttgactctttggcaaatgtcacacaaggctacgtattctgcgacgtctcgcttcattccagcccaccagaaatatgccttgatatcttggtacatcttcgtacttcctggatgaatggagtaggcggactcatgagcttcttttaggatgagatctcttaattccttcttggccggtacacagatgcgtggaccgcaccaaactgtgccttggtcgtctatggagaaattggtgtctttcttctcctgtattctttttattaactcttttatcccttcgtcgtttttctgagcttcccggatttgcgactctagggtaggctgtactgtcaagctggcagggacacctgactgcaccacggtcagcctcaacttctccaattctctgcacaggcgatcttggtcaggccgtattcgagctacattgcaataggccttgcgacttagcgcatcagcgaccacgttggctttacaggggtggtaatgaattccaagatcgtaatccttgattagttccaaccatcttctctgcctcatatttaactccgtctgtgtgaagatgtacttaaggcttttgtgatcggtgtatacttcacatctgttcccgattaaatagtgcctccagatcttaagagcatgaaccacggctgccaattcgagatcatgggtgggataattgacttcatgaggtctgagctgcctggatgcataggccacaacctttcgttcttgcattaggacacattctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcatgggtctggctaacttagagaatccttcgatgaatcttcgataatatccggctaagccaaggaagctgcgaatctctgacacattcttgggcgggttccaagcaagtacagcttcaaccttgctgggatctacttcgacaccgttggaggagatcacgtgtccaaggaatgctactcggtctaaccagaattcgcatttcaaaaatttagcgaatagttgatgatccctgagcttttccattattagcctcaggtgttcagcatgttcttcctcattcttggagtatattaggatgtcatcgatgaacaccacgacaaactagtccaggtattccataaagattttgttcattaagttcatgaagaacactggagcattggtgagtccgaaggacatcactgtgaactcgtatagaccataacgcgttgagaaagcggtcttcgggatatcttcagatctgattttcaattggtggtaacctgatctcaagtcaattttagagaaaactcttgctcctttaagttgatcgagcaaatcgtcaatccgtggcaacgggtacttgttctttatagttacttcattcagggctctatagtcgattaccattctttcagagccatcctttttcttaaccagaagcactggggctccccaaggggatgagctaggtcgcacataacctttactctccaattcttcgatttgtcttttgacttctgctaactcattagctgccattcggtagggtctttttgcaattggtgcggtgcctggtgccagttctatggcgaactcaatctctcggtctggtggcatactcgttaattcttctggaaatacgtcgggatattcacagactatgggcaccgactccaaggaggtgacttgtaaacaggttaagatagaccgacttgcggtaggactgttagaggtaaagcggacttgctttcctccaggtccttgcaaagtgatggacttttcggcacaatctatctgtcctttgtgctttgccaaccaatccatccctaggatgatgtccaagctttgcgagtctaggactatcggtttggctaggaagtcaacttcctcaattctaaggttaacttccgggcatatttgagttgcccttatatccctcccaggggaatgtactatcatcggtacacgtaaattttgggttttccaaccatttcttttcacaaaagcttgtgatatgaaggagtgggaagctcctgaatcaaacagaactattgcgggtatggagttgacagagaacatacccatcacaacgtctggagcatcctgagcagtctcggcttgaatgtggttcactcggcctcgaccaaagttgttggacgcatgagaaccttgtccacttgcctgggagctaggacgagactgagctgccgctggagtaggagttctagcagtgctgccattagcatgccctgagctggtgttggtaggattctgagggcactgtctagcatagtgacccatctggttgcaccggaaacactgaactgctgacggtccctgcggtgacttgaaagaggtaacactgtttggcgcagtattgccactaggggcacgctgctgtggctggggtgccggacggttcatctgaggacgaggggcgtagcctggctggcggttagcttgagtgaccgactgatggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtagggaagtcatgagcaagcaactggagtctcattccaactgcgattcccttcaagaacttcctgatcttcttcttgtctgtgtccacttcctcaggggcataccgagccaacttgttgaactgacttaggtactcattgacattgctgttgccttgcttaagtctgttgaattcctctttcttcatgtcaatggtgctttcaggtacatgagctgcacggaaagctgtagcaaactcatcccaagcaatgttagtgggttcagggtgtgcattgcagtaattctcccaccaatctgcagcaggtcctcttagctggtgagaggcgtagagcgtcttctcaacaggggtacactgcactaagttgaattttctatcaacatctttcagccaatcgtcagcctcgacgggctcgacggtctgagagaactctggcggacgagacctcagaaaatctgtcagcttggatctattgttgctcatgtgagggtggccatttccatgcgcattatgctgaaaaccggctacggctgcggctaatccttgcaagatttgtgtctgaactgccattaagtgctgcatgttgttttccacatgaggtggggaagggaggcgttcttctccagaattgtgactggcagtgtggtgagagcggtgagactgttccatctctgcatcacaggaagccgtgcgatgcgagcggttgctgcggcggggttgctcaacttctgcgttgcgggaagcagtacggtgcgaacggttgctgtggggagactgctcatgatttacttctggctcggctctaccatcttcaaaaccaaagcgggctggcgcacgagctgcacggcgggggcggctagccatctaaactcccagaagagggcggggtaagaatcagataagcacttaggagggcaaggagcaaagtaaatagcaactcagatagcacacactaggcataaactggatttttcaaatcataaaaacacctgatacaacgggtgtggacaagtcacagagctacaccgagcttgactgtgcgcacaccacctaggagaaccagactaccaaacaacacccacaacaaacacacgcacgcactacctcgccacgactccaaaagagttggcggcggaacaaaagggcctagcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtaggggagctgggtagtggaaatggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtgacaggggcggcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcccccgagacggtggctgtagtcgtgggccaggcgacgaagcgcagtccaggagaggtcctggtacgcgatctggagagtgggcctggccaaagtgaagtggtgtgggcaaggccagctccgtgtatacctccacgggggtagaggtacacagagagctcacagtgagggggaacacggcccacggagtaccccgtgtactcgggacacgagaagccaaggaaacgggcgaggtcacgaagctgagcgacgtggtgaccctcaccaaaaccatgggaactgaagctggcgttcactgccatctacaattttgaaagagggagaaagatcagtaaccattttagaaacaaactattgaaaataaggaaaccaaaagaagccttagcttttcgcaagtagttttgaacttagtatccttagggtcgtcctaaacatcgggtttcgccctagggccaagcctgtgctctgataccatctcttgtcacaccccgaactagtcccgactggaactagcccgtgacgctccaaattaacctgttaatcgataccagtcccaggaaacagtgctggtatcacaggaagacagaatatcacagcaacagaggtctctttattatagagtagtagtacagtcatgttgggctgcggacagaccccgagctcacaactgcattacaaaaggaaaacggaagcaggacttggaccaaacaatacaggcgcgacttgggaactaggccgaaaccctaaaactcatcgtagccggcttgctcctgaaagaactcctcatcagcaggatccgcttcatcttcttcagcaactgggggggaattatttatatagagcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcaatctttagaaatgaaaacaaggttggcacccggccaacagcttttcaacggccacccgggcctacaacttttcaaacggccacccgggcctagctgatcccatcagctacagattttcaaacgtcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaagatatttccaaagccgacacaggtttaccatatgccgacgagaggggtcccagaccaacaacaggttaggtcccagaccatactgtgccaggaagcccaggggtcctcccagacaccaccccggtgaatccacatgtctcccattccacccatgtggtcgtacttgtcttatgtttggatgaaattccaaggaaacagtccttaagtgcaagagcgggaaaccgtacacccggtacgttccccggtccgcggttttggaaattcatttagttcgcaagcaccgacccaggtgtcgggttttccaagtcttttgcaaaacccaagttttacccaagttgttactcagattttaagtttgaaggcatccgttgatactcgcgcagggtgcacgaatatcgagacgcaactagatggttacaaggggacatggtatcgcaa

SEQ ID NO: 12616 - DNA, 490 bp, Oryza sativa
cgtgacctcgtcgccgtttccctcttccctccccgccggttgccgccgccgcgattcgccgccgtcaagcttcctccggcgaatccgagccgttggctcgtctcccctcgtctcgtgcaaccacccggtgtgctcgctttcgccggtatcgccgtggttcgctccgccgctcgccgctgtcaaccgccgtccgttccggccggcgtcgtcgtctacctcccgccggcccgcgtggcagccacgtaggcgccacgtcggcgccagctcagcctagaccgggtcaagccgaccccggtcagtcccttcccgtgcgcgcgctccaccacgagccgtgaggctacgcgtgggcccgccacacccgcgtccttccccccaccctagcgccacgtcacgtgctccctccgcacggtgagccaagccgctgacaagcgggtcccacccgggaccgcgcgtggtgagcccggtccaccggctctctctctcctccctc

SEQ ID NO: 12617 - DNA, 722 bp, Oryza sativa
  unsure (1)..(722): unsure at all n locations
aagtttaaaggatcatacctgaagcagcagcagcagcaactatagatattcaacagaatcaaagaataagcaaatctgtgccaaaaagaaggcatagaataggaaaaaagaaaatcagagtgaaaaatgcaaagaataaaaggcaaatatgagcagaaacaagcttattaattatgtaatcgccaaaggttggtgtatgcgagtatacaacctcgggtctccagatcggctcattgattttaccatagcttcatttttcattactcctaaccccagcagaagcatccttataatattaatccctggtgctactgcagccaggaaaggagcatagcttcctgagctgtataaagcatcaatatgtgagtaccaatatggtgatttatgttgaccagagaaaattagattttcttacctgaaaagaggccaaaagagcaagaataccataccgatagttatatgcacaagttttctattgagtttctgcaggcaaacaaatggaatttatcaatagaaagcatcatcgtattgaagcaaatctcaataagaaaaactactgttaatttgtcagctaattgcatggttcagtttatatgtctatgttatgttgagaacctagctgaatttcatctggtgtcaatgagataatgccagccatcagacatccatctgaaattnnnnnnnnnnnnnnnnnnnnnnnnnnnnnnnnnnnnnnnnnnnnn

SEQ ID NO: 12618 - DNA, 1059 bp, Oryza sativa
  unsure (1)..(1059): unsure at all n locations
agaaggcttcacggttgacccaggcccagtgcgcctgcatcatcccgtcccacctaccggccaccgcatcaccgccctacgtgtaacgtgtgcccgcgcgacgcgtgtattcctagttcgtggaactgcaagaagattgggggtggtgcatcctgaccttgggatgccgcgggtgaggtcgagctgggcgtcgtgggggccgaactcgtcgccgtcgggtgtggcggcgatgacctggccgaacggcgcgaacgactcgggcgttgcctccaccgcccgcagcgccaccaccctcgcctcctcgtccttcttcacggcctccatcgactgcgcggctgccttcgcgcacctcactgctcctccgcccccgttgctactgccgctgctacggtggagccgagcaaggcagcgggaggagacgccgtcgcggccgcaggaacggcccaggcggcacgaacggcccgggcgaatcgcctgcatcgatcgtcgcggtgtcccactcccaccagctcgcgcggcgcccaaagcccgagacggtttttgtgtggcacgggccgcgtgcgtgcatgtgtccggtacagaacgcatcttccatcgcgtccacacgtcgttcgaggcgcacgtacgcgccccctatccgcgagcgaacgtgggcacgcgagggagacgccagcgacgcggctgggaactgtggaacggatggattcctgaaacagcatgctcgtgctgttgtccgcatccaatcttcgtgtgcggaaggcccccgtaagagcaagttcaacagtatggccaactactagcttcaatttatctatagctaatctaatagcttattcatacaatatttacatactacactattaatatatggttccacctgtcatacagacactgcgtcttagagtccgtactgcagctggctataaatctgtagcccaccgcccttctttctcctcatttatctacttaaaatatgtttgcagctggcttatagccttattgnnnnnnnnnnnnnnnnnnnnnnnnnnnnnnnnnnnnnnnnnnnnnnnnnnnnnnnnn

SEQ ID NO: 12619 - DNA, 673 bp, Oryza sativa
caccggcccccgcggctggaagtagcagccaccgactaccgacggtggcgacaccggctgtacggtgaagaaccatcggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcaaaggaaaggaagaatacggaccgccccgggtagtgtggcgccgggcgtccctcacccagcgcgaccacctcccggccggtggcagattccggcatgaatcggcgcggcagcccggcctgcctctcgctcacgatgcgagaaggcggcagcatgctaccgtcgagcggtgcggagccccgtgccatgacgccagcggaggaggggcttgagagcgagtgagtgtggcgagggtagggcacaggaaacgagaagttagagcgcaagcggcgaaggcaggggaataatggcgagaggaaggaaacgagtctcttcctcggcgtctttatacccttgccaacgctatgcccggctcctcgcttcccgggcccactatctcgccccctcgtttctcacgcccactcctccactaatcccgctcgcccgtttgcg

SEQ ID NO: 12620 - DNA, 692 bp, Oryza sativa
  unsure (1)..(692): unsure at all n locations
nnnnnnnnnnnnnnnnnnnnnnnnnnnnnnnnnnnnnnnnnnnnnnnnnnnnnnnnnnnntcggggaggggctgcacggtgacccagtggccgtcacggcggcgtacctggaggccgcgaacgtggtcgtcggcgaggaggacggtgaggatgccgggatcggagtgggcggagaggcccagcgtgaggtccggctgcgggcaccgcgggtagtagttggcgcgcaggcccgcgccgcagtccgccccaccgaacgcctcctggaaccgcgtctcgtccagccccaggctcgctgacagcaacctcatcagccgctcgcacagcttgatcacctctctcccgtactcctcggacacctccctgcacgcagtaataattagttgattaataagctgcttaggttaatttcagttggcatacttataatgcgctaaacctaatatggcacgtactacgtactcagtagacacgactaccaatataatataatcttttagtttgtccataaatataaaagttttatcatcctaagacatatatagctacttagtttatttttcccctatgaacttttgcactagtttatttattcatatcacattttatactatagtttgttctttcgttactcgtttatgtgttttttctttaaaaaaatattatccattatatttatgaaggggaggtagtaa

SEQ ID NO: 12621 - DNA, 3209 bp, Oryza sativa
ctcatgtgcaaataattctcctacccatgtgagcgaacaggtacacacaactatgcatatatacccatggcgcagtaggggagtaggagtattaaaattttgggaaatgcgagatggccacaacaagcagaaacaataataggggcgcccgatagtaacctcatttgattggacatttgcagaccgggtcagttatgtgacgcacattcttgggcgcagaaagtgcgtgctaagtgagaactggaaagaagccacagcttagctaagaagatgccgctccaagtgatacatataaaagcgtagttttcaacagtggtgtggttgtgcaaactgctcaagtgtggtcaccattggggtttgcagataattttaagcttttcagcaacggagctgtgtgtcggttagccgtgctatggtgtactggcaggagtcatttgctggccggcatggcaaggcatcccgtgtgagcgtgttagatactcactctctctactttagtctacagatgatacgccactaactgaaatgtcaaaccctataagtaaattaatgggagttggtttgctacagttgtcgcggtagcatgttatagcaggaccgcggccacgttgaagtaattaagggacggtctcatggccaacgccaatgacgaataatccatgtgttgcgtccggtgctcacggtgtgctagtcgcctgacactaattaacacgaatcgtttgcacggtttaatctttataattaccaccacaagtcaagacacatatgtagggtctctgacatttccacgcgcgcgcacaactacaatctggctcgaggcggccgggtgactcgtctctttctattggcctgggcccgcttcgattcgtactgttcgtttcgcccacgggaaccgactcggtcgcgcgtagccggccgagacggggcgcccactccaccaccaatccgtgtaaaattctctgcaggacgcacacgcacgcaccatatgcggtgcatgccgtctcgttctttttctttggcagtgcgacgccaacagcaagcgtgcgtacctttactttgggtttttgcatgcaaaagttccaagattttggcgtttcccactctaccgtactaccgtcgagacttgagatatactgacacactagcttaattgattgctcaatcgtgcgttcgtacgtgccagctatactccaaatacttgagatcgatcgtacggtagaatacaaaaaatgcgaattgtaacaaggtaggtaggctggtttacgtacctgatgtgaagaggggagatgctcatgaagaagacggacgtgcgcgccgggtcgatgttgtcgttcacccagctcgcccacgtcgtcagcaccttccgatacgcctcgatcctcacgacctcgtcatgctcctcccagctctgcccgcccggtctcctgcaagatcacccctatcagtcactgtcatcccacgatcgatcgccgttggttgcacggcacggcgttgtgatcgatcgatatatcgtgcaacgtaaatttagcgtacatgatcttcatgttgagggtgttcatccaccagatgtaggtgttgaagacgaggtagtcgacgccgcgccagttctgtgcgtgcgccgcgatcgcgtccgccttgatgatccggtgctggatgctgtggatcttggggtcgtcggagttggactccaccaggaacggcgcccagtagaactccaccgtcgcgttgtactcctgcacgcacgtacacacgcgtcccgacaattcagaacacaacaggccacgacaacacactatcagaaaccgacccggcggctgatcgagcacaagttggttcaccggttctagataaccgccgccaccaccacacaccaaatgctccctggtctagtcacagcacccgtgcgcgcgcgcgtggacccggcccgccgttggctggcttggctagactagacagatggggatgggtatgtatgcacgttcatcatgcgagcagctcggtacgaatcttaaagacgggatggatggatggatggagacgggcggagtacgcaccacggcgtggaagacgacccgctggtcctcccaggtgacgtatttcttccccggcgacatcgccgactgcaccaggcacaccatggactcccactggttccggttcagcgagtcccccacgaacatgaaccgcttccctcggagcctctccatgaacagcttcgcgtcgaacctgaatcaattcgtacaaattcaaaacttgccgtttatacttgcgtgtccagctggctggagcgtttccatttcagaagaaacggcgcatgctttcccgcccggtgcaaattacagattgtgattggtggctcgtcgtggttgcgtacctgggcatggagcagtctttgggctgccaccgccacttctggtaggtgtcgtcgcggcggccgttcctcatgcacgtcacctgcgacgtgaggaactcgcactgctcctcccggtacagagggtagctggtgttgtcgaacacccactcgcccttggacaggtcgcacgtctccggcacgccgagcaggcccccggctgccgccgccaccgtcttcttcgccggccgcggcttcctcggcttcttcttcgtcgtcttgggtttcttcggcttcctgatcttctcgaccttcgggacctccttcgccgcctccgtcggcgtcggcgtcgccagcttcggcctctcgtcgacgtcgagcggcaacgcggcggccttctccgcggacgagacctcgcgccgaggagggttgacccgggcgacgtggcgctcctccgtcactacgggctccacgatccgcgccggcgttgtccccgcgcgcgcgatcgggtccagcgtgagcgaccggatgtcctcgccgtacatgatgatgacgaagatgacgaagaagacgccagccacgtacaccggcagccgcccgcccttccgcagcgacgacacggcctgtttcgtgccgaacgggtcgaacaccccgccgccgccgccgccccccgcttgcgagaacttgcgccggttggccatggcgacggcacccggagctagccccctctcctcttcgctctgcacggtgcgcgtgcgtgagagacagagacgcgagcgagaggggcaagctaagctttatggagatggcgaggaagtagtcagcatagcaaagctatagagggaggctggggatttgg

SEQ ID NO: 12622 - DNA, 899 bp, Oryza sativa
  unsure (1)..(899): unsure at all n locations
nnnnnnnnnnnnnnnnnnnnnnnnnnnnnnnnnnnnnnnnnnnnnnnnnnnnnnnnnnttgttattcagtatattcacgcgcttctaattttactcctctaagcgaactgaaagttggttgattgataacccaagatgaactacaggcctatagaattcagccgtcatgattatgcttgctcatccgcttcttgctttaccacccagcaatggctaatgtcatcattagacgagagctctattagaattatgatcactcgtctgcacggtagagctcacccacgcttgcttgcttgcactgtatatgtggtcacgccccatgtaataatcctagtcacagagtgatatcgtaccatcacgcagacaagaacgtaacagttggcatatgctgctacaaaccaaaaattgcatcggcatctcttgggaagaaaacaagtaccagcactatataatcatcatcatgccagtaccgcatatttaggagcaacttgtatataaaaccagcaggaagcatacatgcagcgcagtagtgcacggtacggagtgctcgtttactcctaccaaccaggcaaccggagccggcagtcacggccttgaagacaaaggggacggggacatccccacggcctgggctaggtgcgcgcggtggcagcagaaaccaatgctgcacccggctcacctacctaccgagtaccgacctggcgattccccgtcccactcgccatcggccgcgtcacagtccaaagtccaaacccgtcgcgcggggcgctcacgccatgcatgcatcagcccaccccgcggctccgcgcgcgcgcggggtggcacgcgatttctcgatggccaccgcgagcaaatcgcggaaaaggtggggagggcgacgcccccccggttgggttggg

SEQ ID NO: 12623 - DNA, 2616 bp, Oryza sativa
  unsure (1)..(2616): unsure at all n locations
nnnnnnnnnnnnnnnnnnnnnnnnnnnnnnnnnnnnnnnnnnnnnnnnnnnnnnnnnnnnnnnnagtcatcttcttatcctgtataaagatcatttgctgcttgcttcattaggtttactgtaaatgtttgttgtctttaggtcctggacttgtacacgatatcacagacaatgccaaactggatgatagcattgaaaagaatatgaaaaacagtagcgacaaatatctgaaggaaggttatagcatagagcctttccctgagagttctgttgatgatacctttgagtttggagatattggaccattgaatactgatgcgcaaaactcaactgctgctaaagctgaggaagaaaatccagagacaaatgttgatctcgctctcgctaatttccatcgagaatatgaggtatttgaactgagaattgtccaccgcaagaacaggttcacaatcacttcttgtttctcccttctcttcttccatttttggttgctaaatgatacttccaagttaattcttatgctcatatagcatgtcttcactgcaggaccggctttgaagtaagcaaagatttccccattgtcataaattcagttatagcaggaagatattatgtcactgaataccttggctcagctgcattcagtaaagttgtgcaagcacatgatcttcagacaggaactgatgtttgccttaaaataattaaaaatgataaggatttctttgatcagagtctggatgagatcaagcttctgaagtttgtgaacaaatacgatccattagatgagtatcatgtgttgcgtctctatgactatttttatcatcaggtatatcacttaagaaataaagttgactaagatactccctttgcattgatgttatgctgcatactttttggctattcggaagctaaggaagtttgaaagggatatattgttggtctttggcaactttgaaaaggatctatgatggctaaaagcaatatagcttcttattttcagttgatttcttaaattgcttgcatgcttgtttaattgtagaaaaatcatagaatttattagtactttattttttgcggttgcaaaatcatagaatttctgtaacggcatattgacattgcaacaggaacacctttttattgtcactgaattactgcgagcaaatctatatgagttccagaaatataatcaggaatctggtggtgaagcatacttcacattgcctagaatacaggtatgtttgaccgttctatactaagatgctatctataattgttgcatatgcatagacacttacagttcaatttgtagtatgcacgatatgcaatgttccaaaccaatttaatatgcttcatttaaacataaagtttttgaaccgtaattgatcattttcttggaatgatactgctgtaaataaaatgattaactgttttaagtgcaattaaatttaacttaagaaaaaaggttttgatgaacaaaagttcccccttttctttcaggcaatagctcggcaatgtttagaagccttggtatatttgcatcatttaaggatcattcattgtgacctgaagcctgaaaacatccttatcaagagctacagcagatgtgaaattaaggttatcgatcttggaagtagttgcttcttgacagacaacttatgtctctatgtacaatcacggtcatatcgagctcctgaggtcattctggggcttccttatgatcagaggattgatatttggtctcttggttgcatccttgcggaactctacactggtgaggtaagaagcttctgtaccttgctaatccttctttttggacacgtgctgaccttttagctgtgttaaacccatagtggcctgttgtcatacagcacatagaattttatggagatttcaacacactgcattaatagtgaagtgctgtgttggcatgtttgataccttctttcttgtctaaatgctatgcaacatatagctccaaacagaaaatagagatcaaacttctgtgccagaattatttttttttgaacgaatgcctgagtaaattttggggcacaaggactggctttaataaataaagacaaataagaacgttttacatggaaacgaataatgtgcttcaagttgttttgttgttatccatatggaaacaaagttgttttaaaatttaaaaatgctaatcgtctaattataattcctaactggtacacataacaggtactatttcctaatgaaccagtgcccataatgcttgctcaaatgattgggataattggcccaattgacatggaaatgcttgccctgggagaggagacgcaaaagtatttcactgatgattacgaccttttcaccaagaatgaggtacactattcttagtgctagtggaagtagcctttcctgtgaccactcgaatttcatcatgtccatctctctctgtggactgtgcgagttataacacattgaacactgaactcattttgttgtttacctcatttctattcaggaaacagatcaattcgagtatttgatcccagaaaagtcttctctgcagcatcacttacaatnnnnnnnnnnnnnnnnnnnnnnnnnnnnnnnnnnnnnnnnnnnnnnnnnnnnnnn

SEQ ID NO: 12624 - DNA, 1017 bp, Oryza sativa
tacgcaaaccagcccccaacataccaacgcgagaaacaacatgctatcaacaacggcgtcgtcgacaaaatgcggaggaaaatcaggtggagaaaaacaaatagaagaaaaaacgcacacggaacgctcaaatactataggccacttgtgcctcggctcacgttgacctgccttaggccaccgttctcaccggctggcaggctcgcgcgccattggttcatgccgatcacgtactatctcatcttcccactcaaattccacgtccaccaaccgccgcttcgcccttcgctgctgccgctgggctccaaactatttttaagcgcgtcccgcgtcgccagtgagccgcgtcgcgttgcacggattattgcaatcgatccaaacaatcacgtcggtcgacgagaagaagtgagtgatggcgtcgccgacccggccggggccgtacatgccgcgcccaccggcggtgccggagtggctgaacaccggggacaacgggtggcagctcgcggcggcgacgttcgtcgggctccagtcgatgcctgggctggtggtgctgtacggcagcatcgtgaagaagaagtgggccgtcaactcggccttcatggcgctgtacgcgtacgcgtccacgctcatcgtgtgggtgctggtcggcttccgcatggcgttcggcgaccggctgctcccgttctgggggaaggccggcgcggcgctgacggaggggttcctcgtggcgcgcgcgtcggtcccggccacggcgcactacgggaaggacggcgccctggagtcgccgcgcaccgagccgttctacccggaggcgtccatggtgctgttccagttcgagctcgccgccatcacgctggtgctgctcgccgggtcgctcctcgggaggatgaacatcaaggcgtggatggcgttcactccgctctggctcctcttctcctacaccgtctgcgccttcagcctctggggcggcggcttcctctaccagtggggcgtcatcgactactccggcggatacgt

SEQ ID NO: 12625 - DNA, 5306 bp, Oryza sativa
  unsure (1)..(5306): unsure at all n locations
cacatatgcttcattattttatttctggagtaaatcaagattcgttttggggtagtggtagatatttgcatccctgatgcagtcagtatgcaatgtgtcctaccctgggagtcccaatagataaacaaacttttgccagcattgcacacaagcaaacctcacggtaccatggtttcagtggaatctactgtaaattggttttgcttagttagcttggacaggtctgagaatatctcaaaactgtagagtacgcgaccgcacgtggacgcctgatctgagtctgaagaactgcagaagcaagcctgaagacaggccagtgcaaactgaaatatgacagcctaacagatcaccgaagcaattcatcacttgcatcattcgataacattgcacaggcagtgttagcaataggcgtcaaacttcttgcatatacacaacaatcgtgtgcctgtgaaaggaatttagatacctgatctcacaagttaacgatacaatgagaaaacgcaatccgaggctagtcgaattgctcccagtcggtgtttatttgtgtggaagaaacccgtggtgggggtgcattcaagctgcccatgccattgtcgaacgtctcccactgcgttgtcactgaaacagatttgttttgatcgctgaagggattggcatttcttgccttcagcttatccaacgtctccacaagaccttggacacggcgtacctgcaatgcaagtcatcgttattgtgagggtatgtacagcatacaatgcctccagtgactattactttatgacaacaaaaagattttgcaacagggaccaaacccgtggtcagatggtcatagcagcaacaattattcagatatattaccgtcaagcaaccaaaccaactccataaaattcaaaagggcaaaataaggattctttaaactgaagaaacaaatgaattttgactttattaatatgttacaatacatataagatgttctaccgattaagcttggctcaacaatgtttttgaagcaccctgcgcatgctgaccatttcactggtcttgttcttcaatataatagggcaacaaaaaagtgaggaagctacaaatagcatttcactcttgaccaacaaaggtcctaatctggcaaaattctctcgaaaccaacactaataaatggttataaacctcaggtctatcccatatcagaccaggcatttattaagtataagctccagcaggttttgcattagaagctggattcaaaccacacagccaagttaaaatagttttgtgctatactggttacaagcctaaggctaaatggaccgtcttaatgtggaactgctcaagccacacaactagttcattacccataaccaagaaaataatcattggagtacgggggaaggtcaaagtcaaacaaagaaactagaattagtcctggaaggagttgggagacacccttgtgatgcaaatgaagactataattgattcagcatagcagaaaatagctaaatggcaagctttctttactagatgtgccgtatgtattgtcttttcatggcttttaagccatggtcctataaagggcattaataagatttatcattacagggtagcaatgctacactacatggtaaggaacaaaaaaattccatcatcagcatagatgtatgttgattcatcaggaaaattccatcatcagcataggtgtgtgtggttaaattttagtaaataaaaggaaatcaggtttgagtaatagtatgtgatagctatttatcaacagaaaataaaccattttgaaagcttaggatgaccaatatttcagcaccagtactagtaattgaatttgtattatatgagataagccatgaccaatcatgttgagatgtataatggccactgtacctcagccttcctttgtgcccttgcttctccctctgcctctatgccatcaagtttcagcagctccatcataagaagctccgtcaagacaacaaaatctttatcctcaatctttctccctgcaaacacactcttctccaaatcacatacctggtaatagaacaaaaacaaaaaccgtatcagcatcaagatataagaagagttaatgtttaatggaagaggctggagaaacattattccttcaccttggcagagagtctgtcaacttcagctcttacacggccaacagcctcacaagccttcatcatgctctcatccataattactggctcggccctctgctctacattggcaggggcaggcttctcaagtagaagaagttttgctccatccttgaccccagctgtatgcaggaactcattgtcactcttctccttcccacggaagaagagcctctgcctttcaggctctacgccagttgcctgggtaaggacccccttcaattcaccttcatacaaaagagtgaacaattaatcctaactacatatcaaagcaatggaaaccagttccttctaaggaagcagatcatgatgtactgcttctgcgaactactccaaaaattcgataagagaaggcttctttcaaacgttgaactatataacattgagcttccatctgtacagaaaatgataaaatagtgtaaatttagtaaatcacacaacctcagttgagccagtatgtgcacctatttaacgtcatgaatgaacaggagtgtactaatacaatacaacggtacaacagttttaacgtcatgaatgaacagaagtgtacaaatacagcggtacaacagtaattcagtgtgggcctaatggtggacggatatagcatgacgcacagacatgtcgtcaaatatacacttaaaaactagtatatttttgtcgccatatacctaggtacatctgcttgccacagtccaagaggatattatagttaaaagagcaggaccataatccatctgcctgccccctgccacacaagcacatagtattgcaatgcttttgttctgaatctagatttgcatccaattcgattcacggaaaaggagacaaggacgatgtgatcttattaactcctcgacgaatcgccgggttgactggtcaagatccgtagctcaagtgcaacatagcagatcgagcatggtggtcgctgctgtaactaaccgggagcggcaattcgtcgtgcactttccgggcaagcgtttgagcttgcctacatcaaaaatactaatcgaaacataaccgatcacaaggcaccctcgttgcaatcgcccacggcgagtttcacgaggagggaggaggcgaggatcataccgaaggtggagtgcgccggcacggcgacgtcgcggaaggaggcgccgtgggagaccctgagcctgacggccggacccgtgtcgccgtccctgcgctgcaccagcatcccgccaggccggacctcccactcgccctccgcgtccctcccgcccgatctgcctcctccaacgccgctcatcatcgccgaccccagccgcctttatggcgcccctctcctccccccacacgaccccaccgattcggtcgcggcgaaagcgacgcgcggccggagggaggaagggatggagggaagatgaggagaaaaggaggatttggtggcgcgtggcttttgcgaagggtggaaggctccctccccgcggggttccttcccctccggagaagcaagaacagccgcgcggcagtggcggtagagcttgctcgcgagcggcagcggcagcgagattttgcgagagctgttttttttttttcgccaagtacaactttggattctcgcgaggccgcagggggaaacaaaggaggctcgctggcgtggaggcctcgtctcgcgtcgcgtgctgcctccgctgcggataggacgggagagttcgcggtggggtcggtcgacgcctcgcggggcgcgtggtttttgggccctcgtgacacgtttggttcgtgagaatgtgagatcgctcgcgggacggctcggtgcggtgcgccgcgtgcgcctactggtatcgccgagtcgaactctccacagcctcctcggactagcggtgcagataagtccacgattcggttgcagattttcttttttcaattaactcccatctgaaacctgagtttcgacttgtacgtacaggataaaatctcagctttgttcatagctgccgttcacctgatgattaaaaaaaatgtggtactaacgaggagctgtcgtgatgtttggtgtgcctaatccttgtcttcgatggccaagggtaaacgtcgtaattaaggcccacaaaggcacaaaccgtgattacgcaatgatagcagactttatggtacggctaacatgatggtatggttgcgccgacactagatggtaaagtactgcaattagcggtagtaagtagtgtagtaccactacagaagtacagtactaacattgttaggattttgcagttgagatgtgggccctgtgagctaaattatgaggcccacaagacagtgtaatgtcctcgctgggaaatggaagcgaagccggaagcgtggcaaggccccaaggccggtggcaggtcggtgatagactaattaaattaattagtacttgacaaccatccttttttttaacttacggaggactgctagacagccatctgatgcatatgctccgaggaaaaccaatgcatgcatgtatatacagctagctagcccacatttacgttctcagaaagtaattaattccaatattctaaaatatacatagccctttaaattttagcagcatagctgatgaggacatcccacactattacccgctggcagagacgctaaagtcgagcggcgaccgtgtgagcctctgaataatcccacattgcttagcttgggaggaggaagccaccttaaaagggagagccacccttcccctattggactagtcttttaggaagattgggcatttccccgagtgggtgtgcctatgaactgttggggtccgggtaaccttaagttattgggcctcggccaaccccacctgggggcggaagggactaaaaggctgggcgggactaaaaatatctttagttaatattcttaccaagataactggaagccccaaccgctaagaatcctagtgaacctagaaaaagaatacaggcccagaaaaaattacctctttttcgagaacctttcagaagttctaaaagattttgactttactttttttgattctgaatattcttaccaagataactggaagccccaaccgctaagaatcctagtgaacctagaaaaagaaagctaagaatcctagtgaacctagaaaaagaannnnnnnnnnnnnnnnnnnnnnnnnnnnnnnnnnnnnnn

SEQ ID NO: 12626 - DNA, 1580 bp, Oryza sativa
catcccacactattacccgctggcagagacgctaaagtcgagcggcgaccgtgtgagcctctgaataatcccacattgcttagcttgggaggaggaagccaccttaaaagggagagccacccttcccctattggactagtcttttaggaagattgggcatttccccgagtgggtgtgcctatgaactgttggggtccgggtaaccttaagttattgggcctcggccaaccccacctgggggcggaagggactaaaaggctgggcgggactaaaaatatctttagttaatattcttaccaagataactggaagccccaaccgctaagaatcctagtgaacctagaaaaagaatacaggcccagaaaaaattacctctttttcgagaacctttcagaagttctaaaagattttgactttactttttttgattctgaatattcttaccaagataactggaagccccaaccgctaagaatcctagtgaacctagaaaaagaaagctaagaatcctagtgaacctagaaaaagaatacaggcccaaaaaaaattacctctttttcgagaaccttttagaagttctaaatgattttgactttacttttttttattctgaaatcgccttcgccaactagatactcctgtaaaatagttggttagatacattaactttctattcaaaaagcggaagggaggggggcgggaagggactaaaaacatctttaagggagggggcggaagggaccaaaaacatctttagtcccgctttgaaatctaaattcgggcggctgggcggaagggagggggcgggaagggactaaaaacatctttagttccgctgggcagaagggaggggggctgtgaaagctaaagtcgggcgggaagggactaaaaacatctttagtcccgctgggcggaagggagggggcgggaagggactaaaaacatctttagtcccgctttgaaagctaaagtcgggcggaagggagggggggcggaaagggactaaaaacatctttagtcccgctttgaaagctaaagtctattaaggaagggactaaaaacatctttagtcccgctttgacagctaaagtcggacggaagggagctaaagtctattaaggaagggattaaaaacatctttagtcccgctttgaaaaagtctattaaggaaggggctaaaaacatctttagtcccgctttgaaagctaaagtcgggcggaagggagaggggcgggaagggactaaatagtcccgctttgaaagctaaagtcgggcggaaagaagggggggtggaaagcgtcttgcttagcttggaaggagggcggaaggaagggaggggggtgggaagcgtcttgcttagcttagtcttgcttagctttgaaggagggcagaagggaggggggtgggaagcatcttgcttagcttggaaggaagaagggggattaaggaagggactaaagacatctttagtcccattttgaaagctaaagtcgggcggaagggagggggggtggaaagcgtcttgtttagcttggaaggaggaagccaccttaaaaaggaggggtaccgagctcgaattc

SEQ ID NO: 12627 - DNA, 771 bp, Oryza sativa
  unsure (1)..(771): unsure at all n locations
agatatacttcaatctaagtttatgacatgcaatctattttaataaaaatcttaatgctggaatggcaagtaatctgaaaggaagggagtacgtaagttcacctcataaactttttgttaaccagataattctcatgttttcgatgaactaattcagttaacaataacagaaactacaccagcattacatcaccgaattaacactaaacgttgaaagtaacatacatcagtgccatacatcatcagaatcactggaacgagcaagcacacccttcccgtcttctacaactgaatggtgacacccctggctcccatgttggtcagcctctgctccatggtgtcctccctgcccgcgccgactgcaccttccgtcctcgtcgtctccggccgcgtcacgtcgaacttctcaccgtccccccacagagcgtaggcctcctccccgtgcgccgcgtcgtcgccgatcatgagctggtcgtcggacatgcggagcgggatgaagaggccgatgcaaaggagaatggcgcttgtgacgatgaggtttcagacggtgacgaacagcgcgccgtcgagctgcttcccgagctggccgatgccgctgccgtaaaagacgccgcgcatgttcgggatcgggcaatcgagagcgcaaagcttccgcgtggcgaaggaggcccgtgaggaccccgnccangatgccngcgacggcgtgggtgttgaaaacngccanggtgtcttctaccttcatgaggaaggtgggattcttgtgcaggatca

SEQ ID NO: 12628 - DNA, 1308 bp, Oryza sativa
  unsure (1)..(1308): unsure at all n locations
acctttgctgtctgtagtagactagtagggcttttcttttctttctgtgaattggtgggagtatacactggttgttaatttttggatctgttaatattggaaaatgacaaagtttgctgtatgtggcttggccctattgagtttgtaccatctcatgaggttcataggggttgcaattttgagtcatcttgctttactggtatgtcttaagtttctctacacggattcttcattagtcttctaagaaagcatgggttgttgcattgtgtcagttactgaatataaattctctgttaaactttaaattatagtcttttggttttccagaaataggcatgtatcttcagttttgttaagctgataaggtgaaaccataattctgatttctgtttatcagtgtaattttcctctggtgccagctcgtcaagaaatgggacttgggagcacagaatgaactcatgtaagcagggctccaggtgagctcatgttcatacaaagtttttagatataagtaacaacttcatacaaagcagtaactcagttgtatagcatggtaaagagcgttgtaataaccaagaaatatctgttctaatccacaaaatttgatatgcaaatagcaagatgaaggatcattttctgagaaagatgtaaaattgtaaattttactgctcaaagaatcactatcagtatcatatacaaaggagctctttagctggagcagtacaattgtcaggtttccctactaggtagtaagaaacatacatacatttagtagagatagttgatatcatgttgtaataatctaatcaaattaaaaaataatgtaaaaacactttagcactttatatgattgtcgtagtttactctatcattctgcttcaagtggctattgagttggcatgggtgtattctgcaagaagtgtctgaataatataagtgcttctcgaggccggtgtagtggtacctcatggcctgcgcctgctatagtgacgagagttaatcctttatacacttgactccaacctccaacctgcaagaggaatatatcatgtattcaaatgattcattctgacccagaatttgcttagaactgcaaatagtttttagtatactgacctttccgtggtcataccaagggtaccaattgaccatagttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12629 - DNA, 2157 bp, Oryza sativa
  unsure (1)..(2157): unsure at all n locations
nnnnnnnnnnnnnnnnnnnnnnnnnnnnnnnnnnnnnnnaatttataaatagtatgttttgtaaacaaaaattatatataaaagttttttatgttcaaaatcaaataaactctcttttgaatttataattgacggagcgtggggctcctcaccgggagaccgcgcgggcccccctttgccggttcggccaggggcgctaggtgaggttctaagccctcgatctgtggaatgtttcgcgagagagcaaatgcgcaagacacgggcgatgtagacaggttcgggccgctgagaagcgtaataccctactcctgtgttctggtggatctgtgtatgaaggagttacaaatagctggagagcaagagagttcaaactctaaagaccctcttcctctttctctcctctccgagctccggtgtttttccccccctcttctctcttttttctcttaagtgggcaaggtcctccttttatatctcaaggggataccacatgcaccacttctacctactcttcttttgggtggggactcaccttatcttccaaaaaaaagtggcttgcgccttcgcctagaagctaaatcacagcttgtctttgagtgaggcccagcgtcatcactcgcctgacaccggggatctccctgttactccctcattaatgggcggagatttgccatggctgctgtccgaatgaccctccgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagttagcatgccggctccggctagggacgagtgcctagaggctctcattattccgacgggacggggcgaggcgtgcgaaaggccgcctgttgccacctaacccgcgatctgaccggtctgtgaccggtcacacactatgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccgcagggggtcggggcgccccagccctcggggccgaaacgggagcggcccaacccctcggggagacagagggaggggcggccacatcaccctcgggcccgacccccccgagggggtcaggccacgtgggtgaccgcagctgccccaaacctctagtcaagatacccccggtcccatgtcaccgacagtagcccccggcgttatgccagggcgatcgccctcctcgaggaaagcgctcgggcgtgacgccactccttaggcctggtgacaggcggggccggtctctacaggcgggcaggaatccagtggtgcgcgcatcggcaagggaaaaccgaccgacaataatgagcggctttcttcaagaccgctacattacttgagcagcgcgcgaatcgggacgagccggttcgtttcgcctggagatgtgatgatggtgcatcggtcggcgcgcacgatatgtcccatctcgactgccacggccgcacatccgcctcgtgcaccgcaaacgggcgagcgggattagtggaggagtgggcgtgagaaacgagggggcgagatagtgggcccgggaagcgaggagccgggcatagcgttggcaagggtataaagacgccgaggaagagactcgtttccttcctctcgccattattccccttgccttcgccgcttgcgctctaacttctcgtttcctgtgccctaccctcgccacactcactcgctctcaagcccctcctccgctggcgtcatggcacggggctccgcaccgctcgacggtagcatgctgccgccttctcgcatcgtgagcgagaggcaggccgggctgccgcgccgattcatgccggaatctgccaccggccgggaggtggtcgcgctgggtgagggacgcccggcgccacactacccggggcggtccgtattcttnnnnnnnnnnnnnnnnnnnnnnnnnnnnnnnnnnnnnnn

SEQ ID NO: 12630 - DNA, 1288 bp, Oryza sativa
  unsure (1)..(1288): unsure at all n locations
ttaacgctgagagatgatgaaaaaaaaaaattcagccttgtgccctgatcccctaactacctgagggcgaggagcgcatgctgacgaaggcagaggacgacgccgagtcagagctggagccagggcttgcaggcggcgccgccggcgccccaccgacttcggacgtggacgccggcaaccggaggggcgggagctggggatctaatgcggcatcggaatcggagccggcgtccccggcggcggacgcggcgcgggcgaggacgtcgtcgcggagcgcggaggcggcgcccgcgaacccgtggtcggtgaggaacgccatgacctcgtccaggcccggcgccgccatgcggttggcggcccctctcaagcgcgtggcgcgccgcgtgaggtaaactgttgcgtcggcattgggacttggaagcgaagcgaggcgaaggcgagaggcgaaaagccttccttggtctgcgctgcgagtgacggagggaggacgagagcgaggactggaaggaagcttggaagaagcacaaaagaagtcagaagaaagagagagagagagaagagaaaagcatatgcgcacaaaaactttccgttgattgcgctcagaccctccagtaactctgatattacattttacggcttcgagatttttttctttccaaatacaaacagtccagtcgatgtctcgtgttctcaaaaaaaaaaaaaaaaaaaaaaaaaccagaggagagtcgatgtctcgttgacacgtataggtcataatggaatcttgaattataaactgcgtctatatcaagcggtagatcttaggtccaaccgtggaagagatcagaacctatgacaaccgttgcttgtgtttaaaaggacacaagttgctcaaatcgaattgttgacgactaatgtatttggatttcggagttttgaaacacatgctataatgaacttaaccattgtagtagtactatagtactagtacttctttatgttcaacatggtacttagaaattcttacttcttactagggtgcaatttaggtctgtttagaacggggaaaaataactttctcctgcaaaaactgaactggctgtggcaaattaatgtgaatccttgattttttaagattgttttttaatcttttaaaatttaaaaataaagccctaaaagcttatgaaatttgaacatttttccacgcaacttaaactagtgtgcaatgacaatattgtcacaccagtaaaaagtgatggcatgacannnnnnnnnnnnnnnnnnnnnnnnnnnnnnnnnnnnnnnn

SEQ ID NO: 12631 - DNA, 1058 bp, Oryza sativa
attttaaaaagaccgagaaacagaatcgaatttctcggttagaccgaatgcttatccctaagtgcgcttagagattggacaaaggctaaaggcgccaccaatcccgtcgccattgtcaaccgcatcatcaccattaactacaccatcatcatctcactgccattgtgccgctaatcctactcccctagcatccatctccatgtgtcctcctctcctctccatcgtcaccattaaaaaatatgcatttcgacatccaaaaaattgttacgtcaagcgcattttggcatccaaaaaattaaattcttaggacaagcgtgacacccaagacctgaaaatggtattaggcccaactcattcagtcgaaccacacatatactacgatacactacttttttgtcaacgcttcatgcaaaaagaattcgtaccctgtgttgaaggttccggcctttcgggcaagccagtctcctactccctccgtcccaaaatataaacatttttagaatagtaccaaatcaaactttttaaattctgagtattaatagcaaagaaataaaaaagattaataatgtaaatttgatgttactagatttatcattaaacaaactatcataatatgcaattttttatttaaacattttaaaattttgtaaatattgttggtcaaagtagcatctcgaaaaccgggtcgaagtctaaaagtacttatattttggaacggagaaagtatttaagctgctccctctctttcaaattggcgagatggtattaatattaaggcttgttcactttgctaccatttttaaacttaactttttggcaaagttaaaaaaaaagtgactacatttagtttgttgccaaattttagtttagtacataccaaatcttgccaaaatttgacaaccttaccaaaattttgacaatcttactaaaatttaacaatgccaaaacttaataaggttgaaaatggtagcaaagtgaacaagcccttaatattggctcctcttgcttgccggttagcttgctgctgctgctaaacactgcttgctgctgttgcttgc

SEQ ID NO: 12632 - DNA, 1567 bp, Oryza sativa
ttctgccaaaaacatatcttctacttgcatgtgtcttaagcacttgcttatgaaaaatggttttgataggtattttgttagaggcaagccatacacctgtatgtgaaaaaaatttgcatagtagtgcgagagacaaattataatatatgcgtatatataagactagttatttaaataacagttgactgtataagttttccatgtcacattatttagataatttatagacaaacttgtataatatttcattaatttgttaattatacaattaattatattatttgatttcgtagagaactcgtaccgttacataataggaatagttaattctatcgataatataagtacatggacaactcatatctcctctctctaagcagcactccaaatctcgcatggcatctctccaaggttgatgtcatgccaatattatgtttttaacaccggcaaaagctttgccgttctacattaatagagaggattattttttttaacgttaaaagtatttaaatggcatgggggaagatctcgtgcccgcgaaaaagatctttgttagatctcccggtgtgggtatctctcgaagctttgctgctctcactttccttgccgcctcttctttagttttagctattatggtggcagtggttgacgccatgtgtcgaaaaatctgtgtgttgtgctcacgcaaaagttcctatacaatgagaatgagaagggatttgagtgacatcttcggcgtccgtggcatagagagaatttgttgccaccactcctctatacggtgtcacaggtttcctattgttgttaggtgaaactgcatctattgacatatcgtcatccatatcctctgtaaatatttgtatttcgctagtaggtttattgttgtccccggtgctatccgactgagagtgggcacatttacgggtttggcatcctcttcttttaagcatatccaccgtccaaacttggtatagtcttgttttacaagccaaatggagaacttgcatttaggatagcgcaacacttacagatcatctagttgaaggtagtttaggctgcacctaggaattaaagattgtatatatgttgacttggtcatgtattctctatttaattaatgtgaatttctagacgatatatcttttgtgaatccagtagctgcatgggtttgccgaattatgtggtagagccagacgaactggtgtaaaaggtatgttgtggttatcttgtggtgaatattcccgaaccatctatcctttcattgttggaaagctttcaatataaattcccttcgagcatgtcttttcatccaaagatatgcatgaaacaaaatcctttagaactacaaagctctaagaaatagccatgaaaagatggaaaagaacaactcccactagttggagcagacacacacacaaagttgagagagcggaaacgggaaaatgactaaagttaggcacgcaacaaatccaacaatttccggaagacgagaaaaaacccaaaagagcatccactttacttgttttgttcctaaagctagttgctagttcgagcagtcatcgatcag

SEQ ID NO: 12633 - DNA, 1039 bp, Oryza sativa
  unsure (1)..(1039): unsure at all n locations
nnnnnnnnnnnnnnnnnnnnnnnnnnnnnnnnnnnnnnnnnnnnnnnnnnnnnnnnntttacttttccggtgcgcgctcacgggtcaggacttacacgagtacttgcacccgtacattagcagtacatgtgacgtgtggactttgtggtgaaacgttcggggcacgcggtcgcgggagcacggagtcgtcagcgcccggggtagactagtcacttgcgtgtattgatcgagtgagacgtgttttggacatggacgatggtgaactagtactatggaaagaaacgattcgatgtagcttaggctcgagcctaatttcctcgtacctgcaaaagtacatatatagacgagttgctagaaagaaaaaaaaaaaaaacagtgctggctcagcttgcagaatccagattctagaacagtacgtggcacgaatctcgacggcgttaagtgttaaccacgtgacggcgattaataaatactttttttgtgacaggtggggccgaggctgaagagcgacagggagcggttctcgccgaacaacatcctcctcatgatcgccggcggcgggctgctgtggctgggctgggccgggttcaacggcggcgcgccgtacgccccaaacatcaccgggtccatcgccgtgctcaacaccaacgtcagcgccgcggcgagcctcctcacctggacctgcctcgacgtcatcttcttcggcaagccctccgtcatcggcgccgtgcagggcatgatgaccggtctcgtctgcatcacccccggcgcaggtatcagctgcttcctgctagctttgatcaattctagaatccaactagattagcaatttagtactactacactgtgattagccagttgccattcacatagtttcattaatgaggtcgttgaattggccattcgttaattaattcagttggattaacgaactagttgtgtgatggcatgcaggtctggtgcacacgtgggcggccatactgatgggcatctgtggcggcagcttgccgtggttctccatgatgatcctccacaagag

SEQ ID NO: 12634 - DNA, 658 bp, Oryza sativa
cccccttcatttacctgatatttaattgatagaaccgcttgaaagtttacgcctaattgtcaatcacatgctatttgtcttcttcttttgtgaaggcaggtacttttctttttgttgtaaataatgttttaccctcgcaaagaaagtgaaggagttctgtggctatgttagtttgttagaactgtcatatttactcaaagaggatgtgaaccataacgccccttctcgagtattcctaattaattatcagaaataattactctgactttggattggaagtgcattttttccggatatgttctgttgccctggttaaagcgtcatttgctgtcgcaaactactagatgatgccctgtgctttctgcgggatatatgatagatattggagaaatgatgaaatgatttggtttgaaatattataaaaatgatttgagaatgatgattgagcattgtactcctatatgtttagttttaaaatgaaattaattgaaggtataattactatgcttgcatgttgaactttgtgtgcttaatgggttgatgtgatatgtttgtatgtaggttttaggagtgctaataaatactatgcttgcatgcttgagttttaggtgtttagtggacattttctttatagaaagaaaagattcatttgacactc

SEQ ID NO: 12635 - DNA, 1104 bp, Oryza sativa
  unsure (1)..(1104): unsure at all n locations
tgaactctcttgctctccagctatttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcacctagcgcccctggccgaaccggcaaaggggggcccgcgcggtctcccggtgaggagccccacgctccgtcaattataaattcaaaagagagtttatttgattttgaacataaaaaacttttatatataatttttgtttacaaaacatactatttataaattcataaaatgtgccaacgaagaacgataaaattgttgttttatgttgctgaaatgaactcagccgaagactgccctactctctccgctcacattagtttgattaattccctacttgaagaaaataatgctaccaaagagctggtggcaaaatctttaatctacatctgcgttgaaaaggtgctcaaaaccactgcctctcttggggattaggactagttggtcctgatctgccatagcaagccacctcagtttgtcaccccttttcttcacctctctgttgcctactttcagatccaaggaatctgaaaagacaaccaagttaaacttaaacaagtagagcatcttttcatgcttttagcatgtctataattagaggcagtacgagctaataacaacgaaaatgacaaaaacaagcaaaattctactgccaggaccccatgaaaacagtaatttgtgcagtgctccagcttgttagtactctcccatcccataatataagggattttgattttttttcttacactgtttgaccattcatcttattcaaaaaaaaattgaaattattatttattttatttgtgacttactttattattcaaagtactttaagcacaacttttcattttttatatttgcacaaatttttttaataagacgagtgatcaaacagtgtaaataaaaagtcaaaatattttatattatgggacggatggagtagtatnnnnnnnnnnnnnnnnnnnnnnnnnnnnnnnnnnnnnnnnnnnnnnnnnnnnn

SEQ ID NO: 12636 - DNA, 584 bp, Oryza sativa
gatccccatatgaggcaacatctacataatggttgtgcgacggttctatattgtggttgtacaaccatagcagctgcagctgccatcaatatagatcttctttatatttttactgtatcagtgggctgcaaattagcgatattgaacatatccataaactacaaggaagaaagaaaaggtggtagtggatatgttgagaagaaatgtataaaataataattgtgattgtgaacgtttagctgataatatatgttgtggagaaaataaaagaaagtcgtcaccctattaattgaactatctctaaaccacacaaaatggaaagtgactatagtactagaaattttacagtgcccgccctagtaagctgggaaattttgttttaccggtgaagtgagactgggccggtcaagagtgagcactaggacattttacatatgcacagtggatgcattcatgtgtcttgcatgctttggactagtatgcatcacactcttgctagctggatggaacttttgcatgaaagcacccttcacctacttttcgttgcatgcacgtgttgcatttcatgacctgagaaattaagg

SEQ ID NO: 12637 - DNA, 1145 bp, Oryza sativa
ttatatagtgctggtacttgttttcttcccaagagatgccgatgcaatttttggtttgtagcagcatatgccaactgttacgttcttgtctgcgtgatggtacgatatcactctgtgactaggattattacatggggcgtgaccacatatacagtgcaagcaagcaagcgtgggtgagctctaccgtgcagacgagtgatcataattctaatagagctctcgtctaatgatgacattagccattgctgggtggtaaagcaagaagcggatgagcaagcataatcatgacggctgaattctataggcctgtagttcatcttgggttatcaatcaaccaactttcagttcgcttagaggagtaaaattagaagcgcgtgaatatactgaataacaaccgcagtaaccaaggcctattaataaacaccggggctacaaaaacaggtcaccgaacaaagtttaattcaagaagtataatcaacacgatgatcgtcgtctcgagggtgttaggcgcaccttcttcagacaggacacccgaaagatcatcagagcccgtggtcggcggtagttgcggaaaaggtcattttcttctgatcagcgattcaggaaaagttagccctccctgatgtggatctcaatcaagcagcagaccgtgcgtcacaagattgataattgtactagaacggcactgaacgactgaagaaaacccagacaaagataaccaactctaacttaatttgatccaagaaaaggttggtgatatgcctaatgactaattgagcaataacaatgggcgcaccattgattattccaggctatttaagcgattcacatttcgcgctcgctgtcactaggagtgttacctgcctaaggggcagtgagcagtgaagagagaggactgtgctgcacagttattcatgcacagtctgtgcatgaataacttcatcttaaaaagttcgtaggcaatcaataatgtaatgtgatccggaacttttgcttaatcagtgtgcctacctttatgtcatctaagtaccttttggtggcaaaagataatctattcccgagtgcatgaaaatgtgaaccgatattaacttggtcccgaatcatatcatctctttgcagtacgtaggttcacgatcttaggttct

SEQ ID NO: 12638 - DNA, 849 bp, Oryza sativa
taattattataaggcaaacatcagttcctgtctgaagatcatgtgcttgcacaactttaccgaatgcagctgagccaaggtattcagtgacataatatcttcctgctataactgaatttatgacaatggggaaatctttgcttacttcaaagccggtcctgcagtgaagacatgctatatgagcataagaattaacttggaagtatcatttagcaaccaaaaatggaagaagagaagggagaaacaagaagtgattgtgaacctgttcttgcggtggacaattctcagttcaaatacctcatattctcgatggaaattagcgagagcgagatcaacatttgtctctggattttcttcctcagctttagcagcagttgagttttgcgcatcagtattcaatggtccaatatctccaaactcaaaggtatcatcaacagaactctcagggaaaggctctatgctataaccttccttcagatatttgtcgctactgtttttcatattcttttcaatgctatcatccagtttggcattgtctgtgatatcgtgtacaagtccaggacctaaagacaacaaacatttacagtaaacctaatgaagcaagcagcaaatgatctttatacaggataagaagatgactggaattaaattgcaaattcacacaaacgttggtaaacaaacaacagttcagcaagactgataataaaataggtttggcctttctttgttaaaaaatgtctcctcaaatgtgcatttttaaatccagattcatttcatttctgtagtgttaccaaaaccaagttacatattatattgaagagcagaaccaaattttcaattcttctaata

SEQ ID NO: 12639 - DNA, 1966 bp, Oryza sativa
actatagggcgaattcgagctcggtaccccaggcggtatcgcgtgggctatgtgcgagaccgcgcggtcttacgaaatgaaagagcgaggtcttgctgaaacagtctgcgacagtattaaccggctccatttaattagtgatcaagtacataattaactattagctaataataattagtgattaattatcgtgcacggtgcggtctcgtactttcaatgcgcaataccgtctgcaatgtcacatccacgtcattttcgcgcaacggttgtgcgagatcgtgcgagatcgacgttatattatcgcaaaaaagtttacattcgaaatattttgaaaaaaaaaatagatgaacaatatatttttcaaatttaattcgctttcctgctacctctcctccgctttatttattttgtagggatactggtagaactcaggtgattaatcttctgttacctaggttcgattctgttttacactaatcatacaaaataaaactttatcttatatttttttcttaatatataggaaaggcaacgatggttctatcttttttttaattatttttatcggcagtagtgaacccataaatcaaggcaccggcgtgacaagcacacgatcaagcagcaacgtcgtcgtctcgcggccgcccgaccggccggcgccgtggcctggtgcgcgcgacgcgattgcattgcatgtgcacaaccgtacatgtgcggcaccggcccgtgcagcacgaatgcaggatgcaccactgcacacggctaagctaagctgcgggggcaggtagggggccagattttccatgtcgctactccgtgccagtgccactgcagcgtcgtcagcgactctcaggcgcgcgcggccacatcatatcatatcatatcatatcacgtctcgtctcgctctcggtgcaggcggtcctaggcgcgcgcgcgcgcgctcgtacgtacacaggccggaatgtcacatggcaatctcttcacggcgacgcgacgcggtcggtccgtacgacgacgttgcgcgcgtccgggttctcgctggcgagctgggcctgacagaactgactgttcaatgtgttcatagactattctttgtcacggaagagagccgtgcctccgagacgaccatagcaagttcggtgtggagtaggagtactagaactaaaagatcatcaggtgttccaaattggaaattgagattttcccaaaacgaaattaagatgaggtccggagtataataacgcatggcaaagcccctatagctagactcactaaacatgctcattgccgtcagctttgtgacatcttaaacacacaatcacccacccggccaggagtttttcccatttaatggagaagcttgaagcaatgaaattgttggcgtcaaaagtctaaaatacatgcagtcgtcaaagaacctggattaatttgcaatgagcagatttttttttaaaaaatactaaccggttttcaggcaaatcgactaagaaactactactactctagacatgaaggaaaaaaataaaaaagataggtatttctagtcgcccctaacccgaaatatacataggggcacctaggatcagtggcctggtattaaatatattttagaatagattttgagtgcctccaaatttgttaaagttcagttattttattcatccgttggatgataatacaatggttgccaacacctcctaattacacttatttaaacaaagtcacttctttagatacatggttgaaaaatatgttactctaaccagaaaaaaaatataaaattacatgaaataaacttatagctaataaaaagttataaaatttacgtgcattttttttaacttagattaaatataaagtaaaaaaaatcatatataacgacaaatttgtagttagatatatgcattgtggaattatagatgactgaaaatgtataactccttaaccgtatgaaatctatcaaatc

SEQ ID NO: 12640 - DNA, 943 bp, Oryza sativa
  unsure (1)..(943): unsure at all n locations
nnnnnnnnnnnnnnnnnnnnnnnnnnnnnnntgcttagagagaggagatatgagttgtccatgtacttatattatcgatagaattaactattcctattatgtaacggtacgagttctctacgaaatcaaataatataattaattgtataattaacaaattaatgaaatattatacaagtttgtctataaattatctaaataatgtgacatggaaaacttatacagtcaactgttatttaaataactagtcttatatatacgcatatattataatttgtctctcgcactactatgcaaatttttttcacatacaggtgtatggcttgcctctaacaaaatacctatcaaaaccatttttcataagcaagtgcttaagacacatgcaagtagaagatatgtttttggcagaaaagaaatgattctcatagatgtcgattggtgatatgggcccgggggaatcagggccatagggaggaggctgccccacatagccacatggccctccccccgaggggggtcgggcaagaggcggggtagcggccgccctctatgtgcccgggggccgggctaccctgaccccctcaacacggtgccgcgttagacgggcgctcccagtgcccacctaaccgcatttaagacggtttgagcaagcgcaccatgctgcattaaatgcggcacgtggtgcacttgactgatctgtgaccagtcgaatgaccgatgtagccggggtagtgcgcttgcgcactggctccatgtcaggcggcgtgccgtctgacaccccctgtcacgttgtgatgatgagaggctaactgccggagacggtttgcctaacccagtcagggtagggtttccatttcccagcgtaactgaggacccaaaagtcttcattcattaaatgccgaatgacgggatggcccgcacaccctaactacataggacattt

SEQ ID NO: 12641 - DNA, 2339 bp, Oryza sativa
gaacctcatgagatggtacaaactcaatatggccaagccacatacagcaaactttgtcattttccaatattaacagatccaaaaattaacaaccagtgtatactcccaccaattcacagaagaaaagaaaagcactactagtctactacagacagcaaaggtgactcaagatcatgatggtatcaaacccttccaaaagctcactgccatggcgatcccttccttgactgcaatatcaccctttttgcactcccaatgcgaattccaagactgcagcagcaaattcaaccgggccggaagagatgacaggctacagcagaatcgtcatagggtaaaggcaacagcatcagaatcgtccgacgagggctgcagcgcgttgatcttgatcacgtagttcttctggctcgacgcgctgccgctgctcccggagctcgtggtgcgcaggtcgtccgggccgtcgcacgcgggcagcgccgcggcggcgggttcgtcctcctcgtaggcgctgccgatgcggccgccgcacttccggcacagcagccgcgacctccgccggaagagcccccaggagcgccgcgagtggaagtagggcacgcaggtgacctcgtcggcctgcgtgaaccggctctcgtccaccgcgaagaaggagacgacccccttcttgatctgcttcccgtacttggacccgatgttcgccgtgttccgcgtcgacgagctcaggttcagcgcgtacccgcagtatccgcagctgccgccaagtagacaacagcacttcagaaattggattccctctaaatccaaattagggaaactacaccacatactcggtgaatcatactaaagataaaatcagcataactgacgaaaagaaccgaatttggcagttatttttgatccaagaaccaatttttcgaccaggggaagcagaatcgaacctgtaggtgacatctttgatggaggggtagctgtcgagagacctcaccatggcggtcgagcagccggagcatccacttttttgccgatcagagagagaaacggggcggcaatggagggggggaagtggagagagtggagactaaaaaaaaaggcggttgtttggtcgagttgagccaacggacacggaggattgggcgtccctcgtgccgtgcgcttttgcttctccaacgattgctttttatgagcagctgattactactagcagcagctagagctagtactccagtattatcctgttaattaatccataatcaattgctaagcagcggctaatcagcatgggtgccccgttttctctctgaccaggccggataatggacgtggacgtcggggaaacgtggcgcttgcgagaggaatttggaggccaaagccgcgaataattttcctatatttttttgagcctgggggccgacgtcgcgccatcgtcctcggcctggatcttccaccgcgttcgcccgtatgaccgcgactgtgcggcgtgcggccgccgtgggtatggggcgagaggccgggccgccggcgccgccgtgcgtcatggccggccaagcgcctactacggatcgacccagcggacaggtggccgaatcgttagccgcgatcgatccaaatcggggcttttaaaaaaaaagtccaaacgctgcccggatcggcagggcgcgtcgttgtcgaggttccgtctcgtcaccgtcgatccccctggcgccccctgccgatctctccgcgttcagaattgcgcgtccaatgtcacttccttgataacgagattttggtatgtcaataatactcgagtagtaagatttttcgcggcaccacaagcacaaacatagtatgacagccacgataccagaaagtccattgtctgatagttctctctctggaaatacatcacttattgactcaaatcattcatattgttttcagaaaagagcaacatcatttcatactggacggctttttgcccttttgggtgtacccactagagactccccttgcctcttttttcttaatttgttttttacaatgacttgaacaagcagctcatatgtgcatattgtacatcacatttgcatatcgattgttcattaaaaactcaggaaacagacaagacatgcaaacagtctagcatattcattacccagccttaggttgtgaaatgtgtctcagtcctcaatcacaaaagttaccccgtcgtctttcttgaaatcgtgcgtagtgtggtcgacaatctgaaaagaaataagcaaaagtattatgactgaaacaaacaccatatgctcagtttaacttcgaggtgaattgcaggaactccctgcccttttcaaaggttcacaagggggaaaagg

SEQ ID NO: 12642 - DNA, 1244 bp, Oryza sativa
  unsure (1)..(1244): unsure at all n locations
cccccaccgttgcaacgtaaagtggggcgtgtcctcatagacgggggggcagccctcaacatcctttcccccgcagcctttgacaccatcaaggccccgggaatggtgcttcggccgtcccagccgattatcggtgtgacgccggggcacacttgcccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcaacgagaggctcagcacctccatcccagccgccccgaggcagcggatgatcacgtgcgacgaggtcccggtcaagaaggttgccctgggcgacggcccgtccaagaccacacgaatcggtggtcttctggacggcaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgagaggttatccatccggagtggctggtgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatcgctagggaggatgaggaaaaaactgctttcattacccccataggaacttattgttatacgacaatgcctttcgggttaaagaatgcaggtcctacttttcagcgtactactcgaatttctttgggtagccaaataggacgtaatgttgaggcctatgttgatgacttggttgtgaagannnnnnnnnnnnnnnnnnnnnnnnnnnnnnnnnnnnnnnnnnnnnnnnnnnnnnnnnn

SEQ ID NO: 12643 - DNA, 1043 bp, Oryza sativa
  unsure (1)..(1043): unsure at all n locations
nnnnnnnnnnnnnnnnnnnnnnnnnnnnnnnnctgaccaaatatggctccgtcggctctgtatcggccatcccgagcagcaccatcccggcctccagggggccggtctgaccgcgcaaatgccgccggtcagaccggccttatgctccggtcagaccgccttcttgcggccggtcagaccggccagggcacgccggtcagaccgccactatgtggccggtctgaccgcccctggtcaggccgaacccagtgaatttgcaagtgaatgtatgtgtgatgaaaaagagagcacaaatgaaaatgcaatgacctaatgtggcaattgtaatcatctctttgctaggtcattacccctcttaatagtacggcgaaactaaaaataaactagcaaatttgatcgccttacacctcgatcaattctaaattaaagcgctagttttaccgtcttctttctctttgctttgcgccgtcaattttaatccatcgataatcatccatgcgcacatatgatgtggacctaacttaaaatgtatagctcaaagacaacggttagtccacaattagcgcttgtcattaattaccaaaattaacaccgggggcctaaatgcttcaatctccccctttttggtaattgatgacaaacaccacaaatatatataatcagacatatagcacatggacatatattgtattgacaagcaaaagccccccctaaacatatgcataacaatcacaaatagcaaatatggagccaatgcacaattcaatttcacatttcaacatatcacaaacacaagagcaatatctcaatgtgaacttaaagaaatattcatccatgggcataagatggtcacaaatatatcaatgtcacaccaaccattcatcatagcagaagttcacattaagaccacataaagggctcacaaataaatatacgctattacaagaccacgaagggtccaaatgacatagagaacatcaaaacgaaaaaggaacacacaatatagagtaatagcccatacccataccaaatatagcccaatc

SEQ ID NO: 12644 - DNA, 14017 bp, Oryza sativa
  unsure (1)..(14017): unsure at all n locations
nnnnnnnnnnnnnnnnnnnnnnnnnnnnnnnnnnnnnnnnnnattacaagaccacgaagggtccaaatgacatatagaacaacaaaacgaaaaaggaacacacaatatagagtaatagcccatacccataccaaatatagcccaatcctccttagcctataaatatgaggtgactaacctcactactactagtcccaacccacaaaacataaaacacactattctcccccttttggcatcaagcaccaaaaaggtcttcactcttgtggaggagaaggaggacgcgccgaagtggaaggatgagaagcatcacggtggcgatgatagacaaaagcttgggtactctccaaggtttggactcgagaatccaatacacccaccctagtatgcaatcttcccaccgaagtattcaagttgcaaacatcggtgcgcaagccacgaacatcctcatgcaatgcttcatgcccggtggataagcgttgaatgctttcacttagggtattaatagccccaaggaccgggttgaagaagtcattgggttgcattccaaagtaggcatattgtggatggaaaaaaaaacacttggatcatacccttgaggaggaggggggctgcacttgagcttgcaccttgatcgaatgttggttggcgcacacgaggagctctaggggaggagagtttgagacgaggcttgtactccttatgttcttttaaattgtgaccaatttgtcccaacttgctttgaatcaacctcattatgtagggagcataatagattccttgtccaagagtcccctttgagatggcaatctccttcatcataaggttgataacatcaaaccgacgaccatccataatggcatcaataacatgccaagcaactccgcgtatgtcatcattgttgccgcctcttgggaggatggtggcccttactatgcggttgatcacacttgggagagccctcaaacccgccaccttgccatatgtgtgccttctcccttcttcataaaactgagaaaagtgatcaatggggaaggggttgtgggtgtgctcatcatgaaggtcatccccgttgttgaagcgaatgtgcaagagctccttgaattcatggcggttgatagagcatcggagggtccccgacatccacttcattgcatcacaatcgccggacacccatacggtggcatagaattgccggatgagatcttcatcaaaaggttgcttcatggtgacaattctatcaatcccaacggtccggaacatctcttgcaaattctcaaactccggtgtctcaccaatgtgcctccaagaaatccacttgtgctcggcgaaggctttgttggcatacacttgtgcatacacggacttttggaaccgtgtatgaaatcttggatcattacaatcgttaggcctccggaattgatcatgatgacggaggatagtgtattgttgagcattcctcaaattaagcacaaattggatggaggaatcgagaggactcccatcatcacttgcctcatcatcttcaccatttccactcccattgtcatcaccatcatcacttacttccatctcatcaccctcaacattttccatattgccatcataactttgaacatactcatgtccgcttgattcctcattctcactgacgggatcgggcgtgggctcacgacgaccatggctagtgcggggaggcatggctgaaaaacaaggagcaaaggatggataagcaacaattttagaagccacatagtgaagagggaggaatgggggtgctgcctgtcaggggcggtcagaccgagagccaaggccggtcagaccgatggccaacggccggtcagaccgacggccattggccgatcagaccggtgtctcacggccggtcagaccgacggccataggccggtcagaccgccgctgacagtagcacaaccgaatccttccacaatccacacaaatgattctaaaaattgctaggacaaagttccacaagattggaacatgaacatcaaggtgtaggtctatttcatagagattgaagcaatgggggaaactacccttaaccctagagatttagatagaccaatttgagagcaaagcacaagagggagagtgatgtaccggttgaaggagttgaatcacaccaagaaaccaccctctattggtgcaaatcgaagaacacctcttccttcacctagtgttccatgccatggatcacaaactcaataagaactcaaatcaatccatggaatagagagaggaagaggaggagattcacttacggtgtaaccggagtgattttgacggttgaaccggatggatttggtggagggaggtggctagggtttgggagaggagagaggaggagttttttcgagttggagaagagaagagatgagatgggatgaggaggggtcgggtagaaggaggatgaggaagaaaggataaagtcctgggcccaccatcctaggccggtcagaccagctttacgcgtccggtcagaccgccgggttgcagccggtcagaccgagccctagtggccggtcagaccgctgccaccaggccggtcagaccgcgcatatagcgccggtcagaccgcctggccccccagccgactgtgcacagcccttgcacagttggctgcccccactcaataaatatcaataaaattttgatttttggagcaattttgaaatgtgtgagttgaaatattgccaaccattcataatatttgaaatttatgaagatttgcaacaaaactcacttgagtgctaggaggtggccttttatggtctataggggtttttggacgaatttgattttcaaacaacttttgaaatatttggtttttgaatatgattagaatacctaaaacatttcaaatactcctctctaccaactttgttttgaatcttttttcagatcccttctcaaactcattatggggtttaatctcattttggccaaaaacaagaatctagattcttcaaaagagagccaaaatggcatttttcgttcaaaaatcatttttctagcaatgtgaggcttggaaaacatatagggacccttttgaaacattttccaagaaatagttttcaaatttcattgattttgcaaaagttttgacttatgttgacttgggcattttgaaaaacactactagcacttttagttgatttgctcacatataaaaggaagtagagcacatgcaagagtccaaaactcccccttaatgtgacatgctccattttcacaatgaagaaccaaatggcaataagtccaaagcataagagcaaataggagcaaatatacaaaatgcaaaagaagcaaccatagtgcaccatctcaaaccacattagagaaatctatgacatttaactcattcctcaacttacaaaagcgggtttcatcaagaggcttggtaaagatgtcggctagttggtcctcggttcttatgtggctaatgactatgtcacacttggcaacatggtctcttaggaagtgatggcgaatgtcaatatgcttggttctagaatgttggaccgggttattggctatttttatggcactatcattgtcacataggagtggggttttggtgaaggatatgccatagtccaacaaggtttgtttcatccaaagcaattgggcacaacaactacccgccgaaacatattccgcctcggcggtagagagggctacggagttttgtttcttggatgaccatgacacaagggatctaccaagcatttggcaactaccggatgtgctctttctatccactttgcaaccggcataatctgaatcggaatagccaacaagcttaaatttagcaccttttgggtaccacaagccaatagtataggaatgctttaaatccttttcacggccactaagtgacactccttaggagcggcttgaaaccgtgcacacatgcaaacactaaacatgatatccggcctagatgcggtaaggtaaagcaagctaccaatcatggaacgataaagctttaaatctaccggtttacctccctcatcaaggtcgagatgtccgttggttgccataggtgtcttgatgggcttcgcatcctccaaaccaaacctcttgagtagatccttgatgtacttggtttggctcacgaacgtcccatccttgagttgcttgatttgaagtccaaggaagaagctcaactctccaatcatggacatctcaaattccctagacatcatatcaccaaattccttcaacttgtgtgaaaccttgcgccaccaaccttgccttgtttctcaccaccaatccactttgttcctaaatatccactttgtccctatgacattgtggtctctaggtctttcaaccaaagtccacaccttgtttcttgcaaagttgttgagctcttcatgcatagcattcatccaatccggatcacaaagagcttcatctacatgttttggctcaagacaagaaacaaacgagtaatgttcacaaatcgaagcgacacgagatcgagtttgaacacccttactaatgtcacccaacacttggtcaattgggtgatccttggaaagagcggtgtgtattcttggaggcataggtggatcttgtgccttctcctcctccacttcaacttgagcttgacttggcgaagcggaagtagatggctcatcttgagtggaggtggatggcttgtcttccacttcaatagacttgacatctctaatagacatgttcttcatagctctcatcaagccttcatcacctacaacatccaaattctcgtgcccctcttgggagccattagtctcatcaaattgaacatcggcggtttcttccacaatacctttgttcttgttgtagacccggtatgccttgctatttgaggcataacctagaagaaacccttcatcacaccgactttcaaatttggttagtctaacaccatttcggtaaatataacacttgcaaccaaaaactcgaaaataggcgacatttggcttcctcccaacaattagctcatagaaagtctttttcaagagacgatgcaaataaagtctattggttgcatggcaagcggtgtttatggcttccgcccaaaaagaatcggaaacaccatattcatctagcatagttcttgccatctcaatcaatgtacgatttttcctttccactacaccattttgttgaggtgagtaggtagcggaaagttcgtgtttgatatgaagatcatcacaatagtcctcgatattggtattcttaaattcggaaccattgtcacttctaattttcacaagagtgcaactaaattcattttgggccctttttgcaaactttttgaaaaactcggcaacaatagacttatcatgcaaaaagaacacccaagtatagcgagaataatcatcaacaatcacaagacaatgactattaccaccaatgctcttataggttgttgggccaaacaaattcatatgcaagagctccaatggtctagatgtggacatgatactcttagtagaatgagaacctgcaacttgcttgccggcttgacaagcactacaaagcttatctttctcaaacttcagatctttcaagcccacaactagatcacgttttgaaagtttgctcaattgattcatgccaacatgagctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggctagaaacaataacttcttgtgggaagaaggcacatgacaagccaagatcacaaatttgagcaaccgaaagcaaattaaaatttagagatttaacaagagagacattttcatttgacaaatcattggagataacaattttacctaacccaattacctttcctttgctattgtctccaaatgtcactttctcttgttcattctctcctacttcaaatgtggtgaacatagccctatcaccggtcatgtgttgagtgtatccactatcaagcacccaatggctcccaccggtgcggtagttcacctacaaaagaagatcaagctcttttaggtacccaaacttgtttgggtccttggaggttagagaccaaagctttgggcacccaaatggcattctttttaccaccgagtataggggaacccacatatctagcaacaatactaccatcataagccttcctaagcatataatgagaatcgaacatgcatgtcttaggaggcttaccaccggggcaatcactcaccaaatgcccaacctcacaacacttggagcaatacttaccattgctcttgacaaaacgagtggcatggtgagaaggtttcttacccttctttggagtgaatccaagtccctccttgttaaggatgcaccgttgctcactcaaaatcttgtcaagagtgttcttacccttgaagcatctctccaaactcttgttgagcttagccacttgctccttaagctcattgttctcaacaataagtgaggcatcacaaatagaaacacaagagctagagctagagctagggctaggcatatccataagatcatcccaagaggtagaaatgctagatgatgcaatatgagcaatatggcaagtagcactatcatcaagcaaatcacaagatatgccaacatcaatgtgagctccatgttgagtagtggaaaggaggttgtcatgagcttccttaagcttctcatgagaaatggtgagtctctcatgagaggtctttaactcctcatacaagacctccaaagaaacatgatccttctttagggccttgaacttgacaatctccttctcactataagcatggagctcctcaaacatactcacaagctcatcataggaaacatcatcacaatcatcatcactctcactatcactaagggatgttaccttagaggagccctttgccatgagacaaagtggagcgaagagtgatggagcctccttgatgggaacaacggccatcttcttcttcttggagcttgcatcatcaccaccttcttcctcggacccggatgagacggagctctcctcatttgagtcccattccccgatgaaagcctcaatcttcttcccttccttcttaagcttcttcatgagcttgtagcctccagtcttcttcttggatgacttgtctccatcatcatccttggaagggcacttggaagcaaagtgtcccttctcaccacactcaaaacacctcaagttggagagagtcttgttgggtcttctatttcttctcctatttgagttggagccccttcctctctcctttctccttcccaagagatcattgaactttctagcaagaaggatcatctcttcctacaagtcctcattgacttcattcaccttgctcttgctcttgtcttcaactttggcttggagagcaacgcacttcttggagggtgaggcttcctccatctccttcttcaacttgtacatgtcattggtgttgatcttccccaagaggcttgcgggtgtcattcttgacatgtcggagttgatgagcatggtgacaagggtctcatacttctccggtagggctctaagcatcttttgggcaacctcaagatcggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtaccctcatggatctccgccaacttgttccaaatctcatatgcggtctcaaggttgctcactctatcgaactcctcttggctcaaagagttgaacaaggcattcatggcttgggcattgagttggaggttacggtgatcactctccgtcaagggtgtgccggtgatatcaaagcctacatccacaatactccaaatatggaagctcatagctttgaggtgagtagacattttaattttccaagtggagtagtttgtgccattaaacatggaagccttccctacatggttcacctcgttcgacatcttctctctaggcggtgaagcccaatcaagagagaccaagctctgataccacttgcaggatcgagatgtcgactagaggggggctgaataggcgatttaaagaataaataacacctaatcaaatctaacctaagttgctaggcttggtgagggtgaactctaactaagcaactaatttatgttttgcaaacctagggtgatagtggctcaattatatctctaggaaagtaaattgcacaaatgtaaatgcgacaatcaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaagcctcgatcactcggggtagttcttacttcactccgaaggtggtgaactccaaaccactcacaaaccggcgccgggcctcctccacaatcttctcagagaggtcaccaggcaactcctccacaagccgtctaggaggcggcaacctccaggagtaacaagcaatgacccggtgttgagatgatcaagtgccacactagctctacaatagaagcaaatgcacttgactcttggctaaacaaccctctaacacactagatggatgaacacaaagctcaagtgagtgtgagaaaggtgcaaggagtgtatgcaattgaattgggtgccaagagagcccccttgctgctggtggggaagtatttatactcccacccaccaaaactagccgttgggggcgaaatcccccaactctgtgctctgccggtctgaccggaggtatgtggccggtcagaccgtgctactctgcaacggctagaaaactagctgttgtagccctgtcagagggccccatctgcctggccggtcagaccggcatggggtggccggtcagaccggcctcggctcggtctgaccaaatatcggctcggtctgacagaatacggctctgtcggctctgtatcggccatcccgagcagcaccatcccggcctccagggggccggtctgaccgcgcaaatgccgccggtcagaccggccagggcacgtcggtcagaccgccactatgtggccggtctgaccgcccctggtcaggccgaacccagtgaatttgcaagtgaatgtgtgtgtgatgaaaaagagagcacaaatgaaaatgcaatgacctaatgtggcaattgtaatcatctctttgctaggtcattacccctcttaatagtacggcgaaactaaaaataaactagcaaatttgatcgccctacaccacgatcaattctaaattaaagcgctagttttaccgtcttctttccctttgctttgcgccgtcaattttaatccatcgataatcatccatgcgcacatatgatgtggacctaacttaaaatgtatagctcaaagacaacggttagtccacaattagcgcttgtcattaattaccaaaattaacaccgggagcctagatgcttcacggcgacgcggcgggcggtgcggcggtggctggcgaggcaacgggccgttcgtcttctttcttttttttttgttgagaatctgtgattcgtgtcacaccctaatctgataccgccgtacaacggcacctgacaggagcgtgtcgtagggaaaacaacgtgaaccgcttcctacgaaaccgcgatctcggtaccagtcccaggacatagtgctggtacccacggtgactcccagagtccagctgcccagcagcacaacaatctgcttccactcgggaagcctaatctatgatgcccgcagacatcccgaatcacacagattcgtttctgaccactcagatcgtccatctgccacataggctgattctggttacgattcccacaccacaacaacttttcacaaagcacaggcaaacaaatctacgcaacgggaaccacctcacatccacccatgaccgtgggcacggctgttcgaacagttagttaacctctgcagagggggtacactttacccacacgacacgaacttactccagacactggccggtgtcagaggttcgcgacaaagcctttcccaagccgacccagggatacctcatgccacatagaaggatcaaatcctcacataaacataggccattttaggcgttcacaattcaaactccaaccacctcgatcggtaattcagcaagcttctcgttcttgcattaccaggaacccggtttggctccaaccgaccccgccccggcgttcccaactattggcatgcgaggttttcctgaaccgactagttacttagccagggtgtcccatttcaccttgtggttgcactttgattatgttcgatgagtttcccacaggaatcggtccttatatgcgaatacgggacagtgccacataggcacaacccccgcatcgcgagttttcaaaattcattttgttttcaaacacaccgacaccacatgtcgggttttgaaggcttcacaaacctatttcccatgttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaataaaataataatgacttttcaattataggggcaattgatcaaagggtgacttgccttgctcaaggtcttcacgaagcttcacgaatcttcgggaaaacccgcgatcgacgaaaaaccgataaccgcaactatacgcaacaatcgaaaacctaaacaagagaccaaaagaaagatcctatttagactaattagtagtgccattaaatagatctcaattttatgaaaatactggaagtggaacggagtcaatcggagttgcgaattgggtgatatgaatttttagaagtttaattggagtttctggaataggagaaatggtttatgaaatttataatattctcaagaatattattgacagtcattgtcacgcgggaccaaaggaaatggtttatgggattttggaataaggaattgatttatgggacaaaggaaaaatgatttattaaatccctgaaaaagaaaaggatggagggatgttaattggacttgggccgagcgaagggacgcggcccgaagagatgcgcgggcgcggccgaggcgagcgggccggcgcgcgggagggaggcggcccaaggccgaacgaggcgcggcccacgcgacgcaagccggtggacgcggtccaccgtgccgggcgcaaggtgggacccacaaggcggcgacacggctcacgcgagcggggtgcacgcaaggcggcgcgttggatcggtggaccgggagacctttgaccggtctccgcggggccaggcggctgaggtggcatccacatggatgccacgtcggatggggaagggagaggaggccgggcaggctaatccgatggccggcgacgagcgacgtgaaccggcgaacagcggcgaggtggattgggggggtagcaccggaagagagaggaggccaaggggaatcgattcaatggagcggattagccgggggaaaaacgacggcggctggcggcggcgaccaatctcgccggcacgccgacgtggccacgcgcgagaagagcgaagggcgcgcgggctcgggctaagccgaaccagtacgcgaccgcgatgcgcacgcggggacgcgggacccgatggtcaccggcggcgcacgcacggcggcgttaggcggcggcggaagcggcgacacggcgcggagacaaaggagaaggccggcggccttggggcagccagggggaggtcaaggggatccccgggagcgtggcggcgagaggaatcgacgcgagaggagccgacgacggcggatttcgacagcgatcgtcggcggcgagcaaagagggaaaacttcactggggcaacgggggttcgattcgttggagctggagcatctacgcgaggtcgcgagctcattccaccggttgagagggcacgggcgacgccgatagaggccggcgacggcgagcgacgcccgggacagagcaagggcgcgcggcgagatgtgacacacggcggcgggcgcggcgcggcgtgcgacaggggaaaaggggttcggtggggagctcaccgacgagagaaatggagtcggcggcgcggatggagtcgcggcgaggcggacgcgacggcggggcggcgcggcaccgagagggcgcggccggggaagaacagatggagaggcgcgaggatgggggcggcgcggagctcctcgtcgactcctcgtgctcgcaagttccccgacacgcacgacggcagaggagggcgagaacgacgacgaacggcgaggcggcagtggtgtgatggaggagaggaagcgagaggtatgggagggggtgtgggttttataggtggcgatgtcagtttgagagaaccgaccttggggcggtcaaggagatgaggcgggtggcgcgagcggtcaagcggcgcagaggtggtgacgccggcggtggtcggggaaagggaaaaaaagaaggggggaaaaaggggggttggtcctttgccatattgaggagaggggaagcagctgcttctcccattcttggacgatgcggcgtggagtggcaggggccatggatgacgtcggcgatgacggcggcggtcggtttgtcatggagcgggggcaaggcggcagctcgtggcgtcggcggcgcaagggctgatggcggcggcgttcggccggtcggccacctctcgagcgagcgcgcgcgacgcgggggtgcagccggatttcgaacggcggcggcgggaaatcggcgctgaggagagggagaaaggaagcagagagagagagcgaggaaagagagaggaagaagagaggcgatgcctctctctctctctcggcgcatgcagcgcacgtgcggggaggaggtgaagcgggctgagaggagatgggctggggaagaagagtcggcccactgagccagagggaggtaaaatagactttcacagagaaggctgatttggagagaattggagtttggatttggattcaaattcgatattcgaactcgagggttcagggaggaatcaaggaaagctcaagatagggtttggtatttttcggaattgggagcgagtgtttagcgaggattcaaaggatgcgactgaatttcggaatttgatttggagacttgaatcggaagaggaatttgaggtggaggattttgatttcgatgagagggaacaatgtgatttgagatgagatcttggcacgacttagactctcacacaaagaacgaaaattttcgcaattaggattttgccgaattagtttttaacgcctcacgaaaagcggagcgttacaattcgggtctgagacgatttgtgtgtgatatgaatatgtgatgtatttgtgatgaattttgtagaagttgtgatgtaatttttttaagattttgtgatgtatttagagatattgatttgagaatttggagactattcggggatgattgatttgggattttgggatgagatagagtgaatcaatatattaaaaacaatgaagaaaagaatagaataaagtagcaaccgatctgttaccaaccgggactaaagaaacaccaaccaggactaaaaatggatttttactctcggttttttcattcgggactaaagatagcgatctttagtcccggattcatagtcccggttacagggggttacgaaccgggagtaaaaannnnnnnnnnnnnnnnnnnnnnnnnnnnnnnnnnnnnnnnnnnnnnnnnnn

SEQ ID NO: 12645 - DNA, 7814 bp, Oryza sativa
gcagaagtacatattaggagcaattataaatttaccgctgtttaaattattgttgtaaaactgtcatttgaatacttgtaaaaactgccataaactaccactcgtgtggcatttttacaaaatatcaaaaacagtggttggcttgcaaatgcccctaaatattatggtcacgttgctttcatgtttgggatttttttttattaattaggatagcccaacatgatgacgggttagcatttgtggagatgagggagtcgtcgactcgaaccattttacgtggcctacacgagtcaactcgccactgcatatggtcttaggaaatagcaactatgaattttacagtattttaataacaatttaatggaagtgatatatttttaaaaatataagattttttatatatctgaaatagaaaatccggaagaaatataccttagtcagtataaactgtgtatctttgcaactgatgagtttaagggcacttacgtccaagtccaacaatgtgtcaatgtcacctagctagcatgtggtcgctttgtattgccattttataatgaaaatccttttagagatagtgataagaggaaggcgttgagggtgcccgctagtggtccatttggaacgtactccttccgtcccaaaataagtgcagttttagtactatttatgttcaacgtttgaccgtttgttttatttaaaaaaagattatgattagtatttttattattattagatgataaaacatgaatagtaccttatgtgtgactaatttttttaatatttttcataaatttttcaaataagacggatggtcaaagcgctaaacacagatatttatggctgcacttattttgggacggaggtagtagaattttgttgtaacttatactactgcattcggttaattataccctaagttaatgtgtaacactttgttataagttgggagtggattttgatccctcgaggtgacatcccctcgttgtttgcgtgtcactctaatagttataaaaaaattgagaagatgtactaacatgtgatataacactccacaaacatgcaagttcaaatttaacttctacatttcgcaacgaaaaaaacaaatttaactgtgaatacatattaacttgttgtagtttaattttttttccgttgcaagatgtagaagttgatttttgaacttgtatatttgtgaagtgatatatcgcatgttaatacaacttctcaattcttttttcaatttttgtcataatcatttgagtgatatgcaaataacgaggggagtcccctcgagggatcaaaatagtttcctgttataagttaaatagtacactctttatctcaaaataagtttatttttcacttatctcacacatatcaatataaaagatcagagtacttttactttatcaaataccaatgaaattattcatttgttaatttgttcctaatatatttattttcatacttttacaaacacttatgcaattattatttaaagaatgaacttattttgggacaaacgagaaaaaagcaagttaaaaatgaaattattctagaatagagatagtagtaattagtactccttccgtttcatattataaaactttctagcattgcccatatttatatagatgttaatgaatgtaaacacatatgtcttataatataaaacggaggaagtaccaaaactaatgcattgtcgacaattttatttgtcacatccaaaacgtcagttatttgtgacgggagtagctaagttagctagtattatctaagctttcataatagtataacactatatgtcgaagttatatcttatctattattatatattaaaagtctattaaatttcctacaaacgctctcaagccgccacgtgtaaatcctacaaacgctcctaagtcgccacatggtgttttaataaatttaaggaatatctaataattcttaaaaggtaaaccatagattttattttaaatacggtggacccactttaaatccgtatcgtgtacgtgcactggtgcacgtactgtgtgcacgtacgtacgccatatatcctttctctcctcctcttcatgctatattatgtagaaaatacataatacatcattagaacattagaatatttaccaaaaaaattatagttgaagacccaaactaactatatttagtaagtaaaagaaataaaacacatttatagggaaaatcgtatagatattttaacaatctatttagcaacacatatattttaaatagaacaatatgcaataataaacaattttaattagaaaatatatatttaataagtatagaactttgggtcattattatgtttgtaaatatagataactcaagttggtgaaaccaatgaatctatctcaaaggaaataaaactcatctcttcctaatgtcgggcgtacctgtgcacgtctcctgtaagcaagatcaggatacatatatctaatctatctttactgatccatatgtaaatatatgtataacaaattacattaatatgaaccaattaaaaggagggctagcttgatggtccattattaaaaataatattttttaagatttgttaaaaaaatcccaaaacattcaatctaaaaagaaaaaagcaccttatttttaatttgaactattagacatgttttctaaacaaactaagtctacctcatttttaaatgatgaagaagaaaataataattacttatagagatgaattaaatattacgtagtatgaagataacaaatacctaatgaaaaatatttgagcaaagccagcaaataaatttatgaagaaaatgtacttctgatccttataagtttttcaaatacgggcttatgatatacttgcccgcgtgaatacgtgagctaccatccttgttgattttaaaagttcaaaccatctttttgtgaccgggggagcgagtagtaatgtactccctttgttcctaaatataagggattttggttagatataatgtatcctaattctatgaatctagatagggagcatgtccagattcgtattaggatacgtctcatccacctaaaatcccttatattttaggacgtagtgagaagaatatacgtactatcatacatgccgcaaatggaaaggaaaagaaattaacacagaatggagctgaacgataaacatcagactaaccgaaatggtgagatagcaattaagcgatcgagcaaacaagttcagatttcagaatgatatctaggaagcatgcacgcatgcatgtaaaacaaagctctgttatgcattgctccaacagaaccccatgcatgcatatatgcattcttacagaaatcaagagtctagctaatttaagggaccatgaccaaccggtaatatattggttgacgacctaggtaagctaagtagagctagacagctagtgggtagagccaatattcgagcatacttaaggaaattaactacctaagcaagccactgtctcactagctagctaataagatccttgcgcaccagactcctcaccgtggacattgcacaccgagtagcacgaggggtcagtctcctggacgaagacacagcaaggcaaaggaggcagctgatgagcgccgcccatcatcagctgccccgctggatcgagcgcttgctgcatcatctgatgagccgggccgtcgccgtagcccaccgcctcttgcatcggcgccatctccagcgtcgtcatcccggcgtcatcatcgccggcgccgccgtggcgatggttcagctcaagggccagatcggcgtcggcggcggagaacgccgcggcgacgtcggcgtgctggcagccctcctcgtgctgcacgagcgcggcctggtgcagggtgacctgcgccttgaggaacttgacgtagtggatggcctgctccagcatggacaccgtgtccatcttgctgccgcccggcacgaggctgcggagcacgcggaagcggtcgctgatccggtgccgccgctcccgcgccgccacgctctgcgggtcggtggagagcttggcgccggggcgccgccgcccgccgccccgcatcctgccctcgccgaggccgccggccgtggggtggaggtggtacggctgcgggtggatggggaagccgcgtgggtcatgcatgttttagtcgtggtatggatccatagatggtgcgctagctaggagatggatccgcgctcgtggctagctagctgcgcgtacaaacacaaatgtgctgggtttgtttcagcccctggagctatttccgcttgctgggaggagacgcgcggtatgcatatatatactgcgcgcgtacaatcgcatgggagagtataagcacatagatgcatggttctgttactccgcgtgatcttttttaaccatgtatagtacaaattataactggacaagaagttttatcagataaagctttgtcaagtacggtttgatatttactttgttcctagattctgtaattctcgtgctcataacttaccctaagagggtagaagttggaacccgggccaatatgttatttggattaaccatcgtcatggccaatcttgtaagtgatttggtcaatcttgtaagtgatttggtggttcagtgatatcactgaaccaaatcggttaataaagaggaaaaataagagaattggtgttgagattcatactctaagacttgacaccaacaaattaaaaacgccaatcgaagagacacagcatgaagtgtgtgtctagagcttgtagggatgatctagatggctaaaacctaaaggtgagcagagaaattaaagggcgtcgttatattattccaagcaatgaattgaactggatgaggcagtggtagattccactagaaggtgagaaagaccaagtatgtttaggtatgtagtagagggagtgtgtcgcataagccactacagacaggaaaagtgcgacaagacgaatcaccgacaaagaagaaaaggggggcacatgggagtattgctgaagaggtggggaagagagaaggggcctttagcgacttcattggtgacgagagcgtgacaaaaatgtacaatgaagatatcatgggttatgtaataggaccaggaaatatatattagattacgatcttacatgagtccgatgtaagctggctactcttttaatttgattgaatttttatattggacaatagacggtcccctcttaagaaatacatcatgcactgttattgtattttccccctctagtctcatagtttgatgctttgaattcttatagaaaagggataggaactctgccaatcaattaagaagaaaatagggttacagtcaacccacctaagaccagggtttgaattgattttaaattgatgagtttaattaatttaaattgatgagtttaattacgtttgaaaaaggatcaacgcaaggcttcttctattaataaaaaaacgtaggcaatgttttcgtaattggcctagttatttctgatgatcagtgcagtgggcagaaaaattgtgctccgtacctactcaagtgcacgtgcactcgtttagattcatgttttttgttcttaaatatcaactgaatggttatattttttaagaaaaatatcacaacatttaaacaattaattaatacatatatctacaactttgcaaaattaaagtcctaatttgtactatacagcgagagatgaaataaacagattcggtcatgaataatgttgacattgttagttcacaatacatgctttaattcatgaagaggtacgtacatggatgggatagctctagtctctagagatctcgactttaatttttactagcactcatacagtaccagtgatcgaaagcccgctatatttttggtgaaaagaagcctagccagctagggtcttcggaagccgtacaatccctttttattgagtgcctttgtgaaatacatgatcacatgattggtacctgtgtcacattcacccctttgtacacatgaccacccgggaggtaacacatccccggagatggtggcaaagagacagcatagaataatggctctttattcgtttctagctagcttcacctctagtcttctgtctactccagttgttttaccttgtacagacttgtgtttggtggatatttgaagccctgtacgtagccgatgctgtcattgaaaaaaatatttcagtcattgggtcatataagctccatgagcgcttatgggacttattagcgtggtctactcttggaagcattactttggacgatccctccattcatttctatcgggaattaccatcgtactcaaattatttttgcttaagcaaatgctagcttattatagtttaagcaaataggagtatgagacaagttatatatgaccgcagcaaacacctccctacttataaattttagaatttctggctctgtgatcactaggataataggtaaccacacatatatacgttgagagaaattaattcaaatagagttagcgggatttgaaacacatattttttttaaaaaaaactattttttaatataataaacgcgaaagagttgaacacactgaattatcacttccataattatcctaagaaagttcaacgaattttggaaaaccttcggcttccaaacaagatgggatttcactgtcgagcttataacttaacgacacatgcatatatgcgcatgcatggttgcacaagactcgagtcatccaaatctctgatcatcatcattggaaggatgttatagcactttgaggaaatcgttgaatcgaaggcgcccgataccgtacgcctacaagcttccaaccgagcgtgcgcgagtacagttcttggaaatggaagtcgctgtgacacagtggctacaagtacgtgtactttctattctattcggtcgatggccatgcatgaacagtgcccagccgcttcgcggtgtagcttagcttagcttccatatcgacgagtacgtacgtaccaggtatatatttccttctatatatattggctctgcttgcaacaataggctatatagctactcctaccttccgggcctctggaagattaagtgtgtgtttagttcacgttaaaattagaagtttggttgaaattggaaagatatgatagaaaagttgaaagtttatgtgtgtaagaaagtttagatgtgataaaaaaattaaaagtttgaagaaaaagtttggaactaaactcggtcttaacacgtaccagctatctactgtactgtagcattctagcctgcaacgagtcagagcttctcgtccgcgcgtgtacgtgcatgccttgccgtgttacatcgcgcggtcgcctcgatcagcttaaacaaatggaggctaggcaaagaggaggagatagaggatgggaggcagagacaagccatgcatgacagatcactgcagggcggaggcaagtaggcaacggaggcggctaattaagggggtgtttgtaatttacctcaaaatacactggtaaggtaggaagtagctagaactgccagaaggtgatagtgttgtttatattttagaacggatagagtagaaatgcttatatatgataaatggagagtacgtgatatttttctctccatcaatttacgttaattggattggaacatgatgtgcaattctattttaattagggatttgatagatttcatacggttaaggagttatacattttcagtcatctataattccacaatgcatatatctaactacaaatttgtcgttatatatgattttttttactttatatttaatctaagttaaaaaaaatgcacgtaaattttataactttttattag

SEQ ID NO: 12646 - DNA, 5649 bp, Oryza sativa
acaggttctaaactcggcccgagttaaaatacgagcgctagctgaatccggcctttgcatccccctgtgtatctgctgtccgctggtacgccttgcatcatgcctgcaggctgcagggattgggctgtgcgggaataaagggcttcattaacgaggatggcgacgtccacccgtgtgatcagaggcaaagattttggcaggactgatgctatgtcacgcagcggccgatttgatgttttagggagttaaaattatttctaggcaaaggcagtaggctggtattcctcgattcatcaggaccggctagcttgctatagctgccagacttgtctagatagcctccttgctccagcgtacggtttgcccttccatgccgctcgagtggctcgacgctgtctccgcgggtccggctacaatgttgacattttcttttatattatacctgcacacgcacacacatccctcggcatgtcacatcacactcatgcaaggatttgaaatattttaggcacctttaaatcccagcaatgaaaaaataaaaaaaaataggaaaaacacagcattatgataggaatacaagcgtaaaacagaaaattgaaaaatacataaaaaaaacacaggaatgaccatttgattggaccgctggaaaaacgtaagaatcagattagagagataggctcaaaagaatttttccaagaaattgaacctcttactaactttcctccaaaatctctataggattatttattccataggaatttcaaagtatatgatatgatacgatatggtttccataggaatttttttcccataggattaaaatcttccaaatttcttatacttttcttacaaatcaaaggggcccttagaactactttaaaacgcaggatttttaaaacacggggtggtagaaaaaaaacactagtaggattgaagtgcctttgagcccatcttaaatcctataatagaaaaacacacaaaaaaacctgcgaaaaagaccttttggatgaaacacaggataaatataggaatcagaaaagagatagacacaaaggaattttttttccagaaggttcgaatttatgtcaaaaatccaccaaaatttctatggtttgaggtaatcctaaagaattttaaaggggtttaggagagccattcctagtttcatttcaaatgaccacataggaattatttctatagaaatcctatctttaaaatttcatctaaattaatttatttgttccaaacgaaccccttggagtctgaaagttttctttatcttaaaaaaaagcccaaacaaatcttattttgtgaaacgtttgctataaaaattttgttcacaagtcataaaaactatttaaattttattgtgcgagcctaggtggcactataaaaaaggatttttgcatgtggtcattttttccatgcaattgggtcgatcacccgtatgcctctaaaaaggtatgcaaaaataacgattttagagtttttattctaattttggatatttgtgtcctaaagttattttggttatttgaaaaaaaatgtagtatattactaacggagactgaccggatggtgatggtaaatcgtagaagttaagcaaaagtcgatggtatattgtagaacgtgacaaagtcaatagctaatcatagaaatgagacaaactcaatggcatataatggattctgtatattgaccctaaactaggcccaacacgtaagctgttcagcctgttgtgttttttttttacccaactggtagaagcgtgatggtggggcattggagggatcgatgcagcttaggatgtaaataggtcaacccgtgaatctatttataaataaaattattggataacctataaattaactcacggttacctactaatttgatctataaattggtttacgggtatatccacttacatctatttcggctctatttgcaatgcccatcgcctcagattgggcctggcccatgggggttagggtgttgttattaggtcagtgccatgccgatcgtggtgctcctgtgactgtgggagaaaatgggaacgagttcacttcatgcagtggtgcacgtatgttcacagaactagctagtggagtctgtgaagacgtggctcctgtgcaaactttcaagagtccaatatggtctacacggacaactggagaagtgaatatatcaccaaattttggacctcttcactttgatgccattttcaaccatacctttttttttatattgttaaaaaaatatctacgtttagtttgctaaatttggttaacacataagaaatactaccaaaattttagtaatattgtcatcttgctaaaattttagcattattaaaacttgataagatttattttggctacaatctgaattggtcatttgtgtatctagacaaacccgtcataacgatgaaactgacccgcacaaaccaatcaaataggactactactctgcctagatggttctttcagctgctagcataatcccgacatgtgacagtagctcagcaagcagtaccatgcatgtcagcacgaaccaacgacagccacacaaaactcagcgaagaataataacaccgattaagatgcttccagaaattcaaagtaaccgcaggaggcctctgtttttccacaaatctgcatattgagaacaaccaatcggtacgtgaaacattcctgggaatctctgtggtaactgtcgtgtcccactctacatgaacagcgtcgagccaacagtcgctgcctcatttcttggcccatgaacgactagccttcgtcaaacgtaaaagggaaacaagctaggaaccaccatatcacacactcaccggcacaccgcgcattttgagcaccggctggggacagggatcgccgagcccgcgttagccacgtaacgcagcgtcgcagcgtgcagcgaaccgcacgcgcgcgcgccttaaattttgttccgccgaggcgcgacgaacgacacaaaccgacactacgtgaatacgtgacgtgtgcgtgcggctgctgcgtttggactttggctcagccgcgtaggagtacgttgcacagcatggcggcagcgcaggacgcgtcgtcccaggcgttggggctccggtggcgctacggcgacgtcgacgacggcaacttcgcggtgcgcggccgcgcggtgccgctcctcgtggcgctcctcttcgtcctcgtctgcttcgtcgccgtctccctctacctccgctgggcgtgccactgccaccgctacggccgcgacacgacgccgatgcccgccaccaccagctccgggttctcctcgtcgcacgctgcggcgaccgcgccaggttcagcctcatcggtgaccggcctcgacgacgcgacgatagcgagcatgcccgtggcgctgtaccgggccgtggcgtcggctgcaggtgatggcgacgacggcggcgccgcgcagtgctcgatatgcctcggggagttcgaagagggcgagaaggtgaaggcgctgccgctgtgcgggcacgggttccacccggagtgcgtggacgcgtggctccgctcgcggccgagctgccctctgtgcaggagctcgcttctcccggccgcggccaccaccaaaccggacgtcgccgggagcgatgctgtctgatcatatgcacgcacagggctcgctcggtcgtcgcatgtaaactgcgccgtgcgcccgtacgtgcacattccattgcattgcacccgccggtgcctgggctgctggtccggaggttcaagcggtgggaaactgattaatttcttagttaatctgtacatcagttagtaagttcattaatagtatagttaatatgtgcatcagttagtttattactactcctacatggtttcgttaacttagctcacagcaacggatgccacttgcagtttctgttttgaattcactgtcaccaagaggaaagtgatgcactgatgtcattgcaatagagcgttgaacttgccctcaaagggcgctttagcgttcagtttctcatgatgttaataggtactttcttcgcgaaacggaacggtcgaacggacgcaatacataaggatacgattgctgtgcgagcttgtgctgcaacccagcgaacgatgtttctgcatgattgtttcgagacgtggacacacgaaacacctgtctgcaccccaactaccccaactggcttcgtttagtccccaaaattccaactggcttcgtttagtccccaaaatttttcccaaaaacatcatatcaaatctctgaacacatgcataaaatattaaatatagataaatgaaaaaactaattgcacagttaggggaaaatcgcgagatgaatcttttgagcctagttagtccatgattagccataaatgctaccgtaacccacaagtgctaatgtcagattaattaggctcagaagattcgtctcgtggtttccaagcgagttatgaaattatttttttcattcgtgtccgaaaaacccttccaacatccggtcaaacatccgatgtgacccaaaaattttcttttcgcgagttctaaaaaaacgtcacatcgaatctttagacatatacatagaacataatatagaaaaaaagtaattaacaatttgtatggaaatcgtgagacgaatgaacattaaatatagataaaaaaataattaacagtttgcatgaaaatcgtgagacgaatttttttagcctaattagtccatgattaaccaaaagttaattcatggcccttcttgataaagttgccgccacaagcagtacacgacaaatcgaacgaaaatttacagcgaaaacaaaacaatacggctagactgagacgggaactctactattgaatctatcttggagaaggatcaacgcaaaggatggatgaaatctaggagtaagatgaaggagtacttgcttgcttggagcctgaacctgaagagatagggatctttgaggaggatagatttataaggcggccggcggcggcgagcagcttcagggggcgttctctaggttataaacgagctcgggccccggggaagaaatagtgggccgggcctagaagaattagtatggatcaggccggcccatgcttcctatggctttccttaggtccatgcaaagcaaatgtagtacttaaaatcgttgggaaacgaaaatcgatcaagtttaagtaatggtagtgtattttcctcacagaaatatactactagtagagtagtatagtttgttgtgtattttaggaacatgattatgccttacactctctcactagcagttaaatgtgccagtcggtgaatgcctgaatggtatgtaactctggggccttgagtcttcagtaatcccttgttctttttataagactgatgactgaagctgtggcttccccactgttgcaattcttaaacctgcatgggccgggcctagtagaactaatggtccatttaatggtcccaattctgaaacctgcatgttggcaaaatggacaattttctggacattcgactgcatagacacacgctcctacacttgtcgcatctgatatcattcgttgcacaaggactccacagctatatgacataggactggaaatggaaaagggccggccaaatcgttaaattcgttaatctgactatatatctgttcag

SEQ ID NO: 12647 - DNA, 4034 bp, Oryza sativa
  unsure (1)..(4034): unsure at all n locations
nnnnnnnnnnnnnnnnnnnnnnnnnnnnnnnnnnnnnnnnnnnnnnnnnnnnnnnnnntggtgttggaagagggcggtgggctgatgttggtggcggggcatctcgtcgttgacggcttggggaggcagtcggcggcacgatggggcggtggcggcaggggatcaggcatagcggagaaatgcgtgatggtggcggcgaaatgagcgatgcgaggggaacgggaggagagctagggttaatgtctctgcacaaatcttaaagcatatccgatggtacaaaatttaaaagataaaagtggcctaaaatttaaaagataagaggtaaaattttctgccaacggatatagacagtccctttatttctacagagaagacaaagcacgccccgtgctttatctcccagcaactttgctcctcgcatacatggaacggcctcgtcgacgtgtggcgtgtccagtgtcctacctgtcgcagcagcagcatcttgccacgacaaagaggatacgcgagctttgctaccgcaacgaaacgcatacagaaaaatgcaggaaactaagaagcagcaggcttgcatgcctcagctgcatggacggctcgtagtggagctgtagtccccctcctcaactgttgacaggtggtgcttctttttgtcactcaactttcaggtagatgattttcaggctttacatcgaaatgatcaactgaaagtgccttttcgatctgtttcccgtgtgtaagtagggaaaaaaaatacccggagaaaagaacagatcgagcagagttttctgtcatggactcatgggtaggcagtaggtatccccacgaggccaccactactcgatctgcagctggacgcatgaagccgtccgtttctctgtaaaccatatctgttcatctctttcgctttaatccttttcttccccaatgtacagtttggtcaggaaccttacagcgcatctgtgcacgcaggcacgtaacgtacgcaagcatggccatcccattagccatatatataaccatatactgtatcgatctcttcccacttaacctaacccctgaagaaaaagaacaaatgaaagacatcttctgacagcaggtgaaacggccagaaaagaatgtgaagaaaagaagaagaaaaatctcttttcagtacgatgattgtgtataaccaaccagctctgcctatgagtaatccggtctccgtaaattcttggaatttgctataccagctgcggcctggacattatcctggtgtagaggatgaggttccagatgtcagggacgccggggaggcaccagtggatgcagtcggcgtaggtgccagggtcggcctgctgctccggcgtcagcaccttgccctgccggatggtgtgcacggaggtgtgcccgtccttgcgccgctccgacatggtggtcacgtcgacgaaggtgatgggcacccgcgtcgccgccgtgcgggacacgttggccgccgcgtggaacatgtcccagtccgtgcccagccagatcggcccgtgccagttgagcagcggcatcgtctccttggcgcaccggatcccgcccgggttcccccacacctccgggctgcagagccacgaaaacagatttttcagaaaccgaattaacgaccaggatgtaagttttgtcagtttgataacggtgaaatcatgggcaaattatttagcagacctatgcatagtagcataagcatggggatcgtagtcctcactccgtcccacgataaatttgacaactcgtcttattcaaattttttttgcaaatataaaaaacgaaaagttgtacttaaagtactgtagatattaaaataagtcacaaataaaataaataataattttaaaaaattttaaataagacgagtggtcaaacgttgtaagcaaaaactcaaaattacttatattatgggacagagggagtacatgatatcggtagtacggagtaattgtgctttggttgaccaaacttttaactgtatctgttgacgtgacatgcctccgaacccaaagaagccaaaagcgtaggttcctcagttgtagacgcaatccctactcggaatagtcaacaactttcgagatcacacagctggacacggcaaatgttttttcggccttcttcctaatccaagaaggaaagcagtaatactactagtaattaactgacgataaaaccccggtgatttgtttgtttaccagatgtgacatgaacctcggcaattttgtccggttactagttaaccatattctcgcatcctctttcctacaccatccgtcccaaaataaatgcagtcatggttttccgcgcccaactttgaccattcgttttatttaaatttttttttaaaaaaactaaagatataagtcacgagtaaagtactattcatgttttatcatcttataacaacaaaaatgctaattataaaaaattttaaataagacgggcgattaaagttgggcgcgaaaactcatgattgtacttattgtgggacggaggtagtatacaaaagggaatcattgacttcaaaattcgcagacaaatcaaagtggtttgcttcacgggaccctaagcacctatcagtttcaggataagactgttcctaatattagggattttcaacccaataactagtatggtgtccatataattaaataagttgccacgtagaacaaaaaataatgtggcaagtgaataaatgaggaaagagaaggaaaccatatcttgtatgagacatgatttttacacaacatccaagacatcatgtgagataagtagcattaaattgaagtacggaatagtggtgtttgcattagaagagtagtgtctagtactagtttcttgatgatgtagagttgaaaccatatctagtgttatgggttgggactgtcctaaaagtttttatagagggagagctttcgtaaggcgtcatccgcgggccatgccaatccttatcaagcctaattgacatcgatccgcaacagtaaccagcacaaccttctgttcgatccgatactaacaaagcagcatctgtcccttcatcgtaaagtacgcaataatacacgtatgggcatcgatctaccaggccttatttatgtttcatcacacatatcaattgcaaaccaccatttctttttgttcagtcttgtaagtttgaattctccaccagtagaacacggggttgaggaactctcaagctgaattgcacaagaagaaaagcaaatcgtcaaccacaagcgacgtgtagtagctaggttcagccaaccagatttgaattcccctctactaatcttcaacccctatatatgtgtcagattagataatttatctacttgctccgtggttcaatgcgttctgtactccgagatcctagaattccggtcacaagatgatgagccctcacaacgatgatactagtatttttcaatatgtcatcacgaactacggtgcccgtcctgcaggtctgggatcgtcgtcgtcatcgtgggattcactcatccacggctcgcaaacggcggccaaatgggaaaaaaagatcgtgcggagaagcttccatctcggactcatgtgcaaataattctcctacccatgtgagcgaacaggtacacacaactatgcatatatacccatggcgcagtaggggagtaggagtattaaaattttgggaaatgcgagatggccacaacaagcagaaacaataataggggcgcccgatagtaacctcatttgattggacatttgcagaccgggtcagttatgtgacgcacattcttgggcgcagaaagtgcgtgctaagtgagaactggaaagaagccacagcttagctaagaagatgccgctccaagtgatacatataaaagcgtagttttcaacagtggtgtggttgtgcaaactgctcaagtgtggtcaccattggggtttgcagataattttaagcttttcagcaacggagctgtgtgtcgtgctagnnnnnnnnnnnnnnnnnnnnnnnnnnnnnnnnnnnnnnnnnnnnnnnnnnnnnnnnn

SEQ ID NO: 12648 - DNA, 1836 bp, Oryza sativa
ttattatttatatattcgtttaggtttcctggatcctgataaaaatcaagtcaaggttcgtacagaattgccatgtctgaagacaaaaggaattgtaatctagcagaatgttagattggtatttgtgtagtggggcatttaaacaccagttgtatatcaccttctgttgtaaaatttcattgttgatagttcagttagtctaattggtatgctgccagcatcctgcttgttccgttcagcaaagggttcagcatcagaaatgttcttggcactgtaccatcacttcactccaaccaaaaaacatgtatttatataaatgtagttatctgatgtttatatttacaaaggcctaagcccaacaaacagcaccgatcagtgataacactttggtgtctaaaatttaattgaaaaagaacttccacagtggccacgcgcacttacaagttacaaccttgaattgtcaatgacactatggtgtgtattgctgtctggcaatacacctgaatttgtcgtcagagaaactggaggttctcatctgaacttctggacaccaatggcgttggggcttcttatctggctgataatctgtgacgactcatcaaacttgcatgctctctcgtacacgccggcagccacaaggtaaagctccctcttgtcgatgctcgggtcatcgctaagctcaccgagcagtgcctccagcgcgtcgaagtccttctgggcgccgagcaggctgaccatctggaagtgcaccctgtctgagaagacgcatccttcctccctcatcgcccggtacagcgccgccgccttgtcgaactccttcagcttaccatgagcattcatcgtgatggcgatcgtctccgagtccggcaaagaccccgccttcctcatttcgtcgaacacctcgatcacactccggtgcctccggctctttgcgaacaagtcaatcatcattcggtacaccgatgtgtccctgacgtcgccggcgtcggctgcacggcggaacagccatgcggcctcctccactcggccggcattcgccaagattttgatggctgtctccttggggacgtcctctgagtctttgaggtcatgcaacaggcgcttggattgtgaaacaagcccggcacgctcgtaggccacgaccatcgtctggtaaagcaccgggtcgatctccgtgccggcttcccggagcttctcgaacagcttcccggcacggtcgagcttcccggccttcacccatatggacaggatggttgagtaggtgatggcattgggctggatgccattggcctgcatgtcctgcaccaggctcccggctttctcgtcctccagcgacttgccgtagatggcgatcatggtgttgtacgtcaccacgttcggcttgatgacgctgccaccgcggtcgctgccatcggaggcggcgctacgcatgaggccgaacaggtggaccgcctccccgaacagcccggcgtcgccgtacacgcggagcatggtgttgtaggtgaccacgctcggggcgacaccagcacggcgcatggaccagaacagccggtccgcctcccgcgcgaggtcgagctgcccgtacgcgttgagcacgatgttgaacacggacaggtcgggcttgacgcgagccacggcgcgcatgtgcgtgaagagcgacacggccgcgaggtgccgcccgcggcgcgccagcgcggcgaggatgggggagtacgactccgcgtcgggcgcgacgccgtcggagggcatgtcgtggaggaggagccggttggcgtcccggagcaggtcggacttgcagtacgcggcgatggcggcgttgtaggccttgaggtcggg

SEQ ID NO: 12649 - DNA, 1912 bp, Oryza sativa
tcagcttaagcagcagttgagttttgcgcatcagtattcaatggtccaatatctccaaactcaaaggtatcatcaacagaactctcagggaaaggctctatgctataaccttccttcagatatttgtcgctactgtttttcatattcttttcaatgctatcatccagtttggcattgtctgtgatatcgtgtacaagtccaggacctaaagacaacaaacatttacagtaaacctaatgaagcaagcagcaaatgatctttatacaggataagaagatgactggaattaaattgcaaattcacacaaacgttggtaaacaaacaacagttcagcaagactgataataaaataggtttggcctttctttgttaaaaaatgtctcctcaaatgtgcatttttaaatccagattcatttcatttctgtagtgttaccaaaaccaagttacatattatattgaagagcagaagaaaattttcaattcttctaatatacagagaaaacccatgtgaagcataatcgtataacagcagtaatgtttctggaagaggttaccactaaaatgcaccatttttttttagctctgtgcatatttaacagcaaatttcagtttacaacagtaacaaaacatctctcattcagcattgtctgcaccactcatacacaattcaagttgaattggatcccaacaccaattatagttgaaatttgaattggaccaccatttccacaaacacaattcaattctttttttttttgggataactacacaattcaattctggcatccaaacggtgcctaacagtatccaaactctttaatgctgtaattcaaccctgttctcccacttcaataaataaattcataatatcttcatcggagcaaagagggttaatgttgaaaattagtacaaatactgtatttagtggagtactaatattgaagggtgaaatcaagcagaaagtttaagatttcagaagtacttacttgtaaaagcatctgcatcaaccctagtaccaaatgaactgagcatttgaagctccttctccactacactcagctccgatcgctcatctccttccccagaatctcttggcaaatgacactcaagcacaacatccgcagggtgcttcaactgaaacccatccatgccacactcatcaagtatctctgtctggtcatcaatgatctggtacctcccatagacagtggagctagaatccttcaccacctctagccccccgttcttcagtccctcaccacagcatccgcagagcggtgatgaacatgtgtacacctcagcacatccctcacagccgtcattgccaacatgttcatgacggtggtcatcaccggcactaagcactcccatctctatcctccctgagccatcgtggacaccaagaacaaacttgtcctcctctttgtcttctccattgtcgtcgtccagctccgacttgctatggaagagatggtcgtcgtaaagccaaccttcttggaaaaagaagtcggtggcgtcgtactgacgcgctgtgccaaactccatctccgatgacgacgtgtccgagtgccgcggcgaccagactccatatggattcagcatccctaatctcacaaacaaaatatatcaaatttaggaccaaaatcgtgacttaaacacccacaaatccgcaaattagaacactcaactatactgagaaatcagaatttaacgacaagcagtatcattggtgtacaaaacccaggggaaggggtttaaccagcaccctactagatcaaaagatcacaattttcctccatgaacatatgcacagagatatgctggctttgatccagcaggttcgacattggacccaaagccaaccatagccgccaaaaacatcggcgcacagatcgggtaccgagctcgaatt

SEQ ID NO: 12650 - DNA, 1087 bp, Oryza sativa
cctttcctatatattaagaaaaaaatataagataaagttttattttgtatgattagtgtaaaacagaatcgaacctaggtaacagaagattaatcacctgagttctaccagtatccctacaaaataaataaagcggaggagaggtagcagggaagcgaattaaatttgaaaaatatattgttcatctattttttttttcaaaatatttcgaatgtaaacttttttgcgataatataacgtcgatctcgcacgatctcgcacaaccgttgcgcgaaaatgacgtggatgtgacattgcagacggtattgcgcattgaaagtacgagaccgcaccgtgcacgataattaatcactaattattattagctaatagttaattatgtacttgatcactaattaaatggagccggttaatactgtcgcagactgtttcagcaagacctcgctctttcatttcgtaagaccgcgcggtctcgcacatagcccacgcgataccgcctgcgacgtcacgcatccgttattttcgcgcaatgattgtgcgagatcgacggtatattttcgcaaaaaaaaaattttcatcccaaatattccttaaaaaaattaaataaacggtatattttgaaatttaattcgcggggactctcaaactctctcaatgttaaaaccctaaaagctaagtcgtccaatcgaccgacgctaatcgtgaggtgatcaaaaaattatcaaaagagatgttgacgcactctacttctcctacgtcagcaagaaccaagagaagaaggcaaccgaaagattaggaagaagagaaaaggaagaacggcagcaagtaaattaaaatgaccgattacaatgacttcatcctcatgacagtagattaataaatttgacattaaatagaagtgatcattctaaatcattggaattttgtaaattagactcccaacacacctgcgctcgtcctagcgcggcaagccgacgacggtgtcattgcggacgaccacgaaccagacgcagatagtactgactgtaaaggtataatttcttgctgatcgacctatcgagaaaaccttccaaatatcgtactacga

SEQ ID NO: 12651 - DNA, 1270 bp, Oryza sativa
  unsure (1)..(1270): unsure at all n locations
nnnnnnnnnnnnnnnnnnnnnnnnnnnnnnnnnnnnnnnnntagaatatcaggtgtctatttttttgtagtgctatgtaaaacgtaccaagaacttgctttgcagttaacctgagttttggatcaggctccaacatgcgtcgaaccaaatctttagcattttctgaaacatttggccagggttcgcgtttgaaatcgatatttccacgaagaatggcttgtgccaccccttgctcagtctctgaaaaaattccaggcgagattgtttgagggagatgacagccaatgatagcgaaggttttaaaagaaaagcaacataccagcccaaaatggaggaactccacataacaaaatatacaagataactcctgcactccaaatatctatttccggaccatagtttctcttcaatacctctggagccatgtaatatgggcttcccacaatttcagaaaacttctcacctaaaagaacataacaatcacataaggactggatggaactaggagttttgtctgtatacaaagaacaacgatcaactgttgtacaagcactgtgagtccacaacattataaaacaggaaaatgccattattgacaaggattgacttcatattcaattctctctcatttcctcatgattcttaggtaccataattttcatgaaacatactaaggagttcaactcacaggggttccacaaacaaacaagaaactattcaagtttctgagccttctgtgtcgaaatgctctaccttgttacaaggtaacataacaaaattcagttgtctgcagaaaaatgtaaaatatgacacaagcaaggtagcaatgtcaccataagaattcaatgcctccgggtgattagtgcatagcagtgcgtatgtagcagctaagaagaatccaataatcactgaagataaaaaaaaacataaaatgaggtatataggcaatgagcttgccctgtgcagcagtgcggactgccttggctgctaggtgctttaggtgttagcctcagtgagcttgctgcattttgttctaagagacttttttttttaatcttgtgccactcttcacaactctattctttcttttccataaaaaaatcacgcttctatcttttgccactattccattagtgtgcatttctctatttctatccctgtctgatcaacaaaggttggccatcaagctttccccccgaaagacaattatggcattgcatatgttccaaatgaaaagaaaaaaatactaaatgaacaatgtagagaaagg

SEQ ID NO: 12652 - DNA, 909 bp, Oryza sativa
  unsure (1)..(909): unsure at all n locations
nnnnnnnnnnnnnnnnnnnnnnnnnnnnnnnnnnnnnnnnatggttaaatcttggaaaggtcaaattcaggttttacagcgaggttgggggactcgacacgtttgaaggttgcaatggtgcagcatgcatgggcagatccactgtgttgatggataggattcgatcttgcttgttgaaacttgaaacagagtgcctaactaccctaactgcaattgcttcttgccattgtttgcagagcaagagagatcaaggactacatttgcacctgatctcgtgccagaaatgcaagtgcaatcagtatccttactttccaggaacaaagcacactacgcacaagtgcaatcacagttagttataaactgcgcgagaacttctcacgaaaatggcattagcacaaaagtgcaatcacagttagttataaactgagaacttctcacgaaaatggcattacggtgacgtcgatatagatactaatttaactaatctccgaatctcaaaggtttcgcatgcaacttgcagcattgtagctgtcactagaaatggaccgagttaacctgaagaaacgaatggaattcgcgaagaaattaacctgaatgtacgatcggagcttgccgatgaggagggcgtgatactggtccagcgtgtnnnnnnnnnnnnnnnnnnnnnnnnnnatgatcatgtcgttcgtcccggccgacacgaggaacagcgacttgttcaccacctcaccggccttgccggcgcccatcctcccgacgagctcgctaaagtccgcgatctgcgaggccatcgtcgcgacgccggcgttcgtcgccgtcctgtcgtcgagtcccgagccgccggacgcgaagctgacccccgtggcggcgtcggcgtcgctgaggacttcggaacccgagtggtacgcc

SEQ ID NO: 12653 - DNA, 1584 bp, Oryza sativa
  unsure (1)..(1584): unsure at all n locations
catttttcatgctttggctgcctcacaggtcgtattctgctcactgttgcatggttaatgtcgaagcaaacggggaggtttgcttttttgtcgagcagtcgttgtcgccccttgccgtcgaaagcatggctaattaagccaagatgacagccgtagctagctccgctttgtccctgagtgtttcggaagcattcgctgtccggccacagatacacacacttgaatttgctcatattggttaaaagctggaacgctttttgcaagggtttcaaaaatggaagggaagaagacctccgttgttaccgatccaaataccgtctactagtttattgccggctagaagctagaaacgtgtaacaagtccatctcacagctgtgtaagtgtaggttaggctttggcttttgatccattgatggcgttgaaggttggcaagagaacgttgaaattttaacgagaggcttctaacggtagttgcaacggcccacgtattgttgacattttcgcatttcaacgtctcgagctacaggaacgatagcgtaaactacacttattgagtggtatagacataatcgcacagtgacacacaaacatcacgcacgcaaaatcacggcatattgttccgcagctaggcgctgcaaagacagcaacaatactatactacacagcttcgttaacacgatctttgacggtctctgaaacagtgacagggacagttcagaaggttgaatcctaaacacatcggttttcggagctcaangcagtctctagcanaaaagaaacanaaccagagatgcatagaggaaaagcgtatgtgccgcagtgattttcttgttaaatcacactgctaatatggcttgatgttcttaaccgtttaagattagagcctcattatttggcttatgatttatatgccaatattaatatttgaattctaaaacttgattttaaagttgatttaatattatttaaaatgtaatttttatattaacttttaagtcgataaaaacacatatacaaaattttaattataattattttttaactattaatgtgccattatggcttataataagaagtaagcaacaaataagaacatagattattaacccaattattagcacgattatataataaaataaattaacaaatagcctggaataataataatcttaaaaatacagtagaaaaaatgtagtaatgttttgtgagagaacttatttttagatacttgaccaaaataatccagcaaaaaaaccgggcagactgtgagagattagagataagacggcgccacggcggacgccctttccgtcctttttctctcgcgcacacgccgttagacaaccggagcggcgaccagcgcagtcaaacccccccctagccgtccttccccacaccggctcaccgcaccgccgcgaaagcccaaaaacgcaccggagaacccacccaaaaaaaccgtaagggccccaccggtcagcgacaaatctcgcacacgccacggcgccacgtgggaatgttcccccaccctcgtcctcgtcggcccaaggctaaaagctaccgccggctacgcgtccccagcgcct

SEQ ID NO: 12654 - DNA, 4082 bp, Oryza sativa
tgtggactcacagtgcttgtacaacagttgatcgttgttctttgtatacagacaaaactcctagttccatccagtccttatgtgattgttatgttcttttaggtgagaagttttctgaaattgtgggaagcccatattacatggctccagaggtattgaagagaaactatggtccggaaatagatatttggagtgcaggagttatcttgtatattttgttatgtggagttcctccattttgggctggtatgttgcttttcttttaaaaccttcgctatcattggctgtcatctccctcaaacaatctcgcctggaattttttcagagactgagcaaggggtggcacaagccattcttcgtggaaatatcgatttcaaacgcgaaccctggccaaatgtttcagaaaatgctaaagatttggttcgacgcatgttggagcctgatccaaaactcaggttaactgcaaagcaagttcttggtacgttttacatagcactacaaaaaaatagacacctgatattctacttgcgtgcatcataccataaaatatcaaattcaatgatcattcaaacttgattatattttctgttctttccagcattatagcattgtgatggaatctgattcgatattactagttctccatttcttgggatcactagccatacataaattaatcattgtctaatataggcaacatataccatatattgtcttttaacgacatggtattttcgtttgtgaattaggatctagagcattaaaaaggtcactacttacattaattagtataaataacttgttaacttttgttattttcctttttttcttggggaatcttgatatcctttcttttttaccacagaacatccatggcttcaaaatgctaagaaagctccaaatgttcctcttggagatattgtgaagtcaaggctcaaacaattttctagaatgaatagattcaaaagaagagcactaagggtctgtatcttgctctcttaacctttccatcttgttccgatgctttccaccaagtatctaccatgtcaatctactgttgagtgacaaaaacttatgttgggtatctgactaggtcattgccgatcatttatctgctgaggaagttgaggacataaaggagatgttcaaggctatggacactgataacgatggcattgtatcttatgaagaattaaagagcgggatagcaaaatttggttctcatctggcagaatcggaagtgcagatgcttatcgaagctgtaagtgttttcagatattcagccacaaatttgtggattttcaaagtcactgatctgtgcatccttcatttagtaggccatgatataggcccctctgatatcccacaatagcacaagtacccatctgagtcaaacatgctctgggaggtctatatgactatatatgtctatatggtccaattccttcacatatagcagtttcaaggatgcacacgggactatataggaggaactagatgttagggggcttctaacttagaaacctcaactgctgcatctatttgttttatatacatggtacacatgatcttttcaatgagatcgacaatttttgcatgaccatgttttctgtcggtccattgccccagttttcatgctaacctattgcttacgtgtaaaatatgtattgattttgttctgttattcacgatatatttttagaattagagtacatgtcaatggccaatggagtattgcatcaatgtgtttccttccagaataagactgaaaatttgcaatggatatttattctagttcaccacttgttctaggttcatgtaactggtatccttctagctgacaaaagctaggataaaagcatttggggtgcatgatttctacatcatattcgagtattttgtctgttccatcttcactagtgttattaatggcttgttagtgttgcttaggtgtaggagctgaacctgcacttgtagattgtaggactaggaaactagctggtacgatttgattgtagtacaattatttgctgggataaatatatttttcttctcattttttaagcaataggagtggttttacttttcaccatatgtgtatcaagaaacttatgtgtagtaagtagccttgtgaagtaacagaacggtagggcaaatagaatgaagtattgcatcttgttttgatgtgcacaatgaaagttacctaaccttcatatagaaccaccattctggcagttccatttcggggcttaagaccctttggaaccatatcatcacttgagttatgtgtttcctttggtggatcgtgtttgatgatggatccgcatggtccacggcatcacctgtggagctgtcttgatcgagtaaatggttaatatattactactacaatataacgcaaggaacaaagtagtgtgcagggagaagcatattcatagaagtgggatagattactgaattcacgactaacactcacttttgtagatgtattatggttatcgttaatcagatagttcgtatagtactagactactttgcaagtctttaattgatcatgtgttttgcaaataggtggatacaaatggtaaggatgctctagattatggtgaatttttggctgtctctcttcatttgcaaaggatggcaaatgatgagcacctccggcgagccttcctattttttgacaaggatggcaatggctacatagagcctgaagagcttcgagaggctctagtggacgatggagcaggtgacagcatggaagtggtgaacgacatattgcaagaagttgacactgataaggtgatgatatttctgaatacaaccattcttttggtaatatcgttcaaaacttttttttatctaaataacatatgttttcttttcactgcaggatggcaagattagctatgacgaatttgtagcaatgatgaagacgggcacagattggagaaaggcgtcccggcattactctagaggaagattcaacagccttagcatgaagcttataaaggatgggtccgtaaaactggtcaatgagtgaaggcctaagggtgataattttatgcgtgtagtttaggcctttgggctcgctaagcagaaaccctttctccttttcttctcatgattattttgcgtggaaatttagataggtggaacctcccgattggcttacctgtgtaattagctcatctgacaagcacgcgccgaatgatataccaaatgctgtgcgcctgcttagccctcgtggccttgttcctatggggtacctgatgccaagtgttgtacaatgttttgccgtgttcaaatgcaatttgttcatttggggtgctatctagcctgtcgcaaaattcaatgtgctcgtggaggcatcgagtgcgtgctatcgactgaacgaaagttacgaggcagtgttcatctagtacaccaggtactaatatcgaattctgttctatctgcccccaagttgttctgacccgcgatgctttcgtaatcaagaagtctgagatcgatgccgctcgaattcaaccacgcgccggaatttttcccgtggtaatgctacatcatcagaaatgcatcactgctggagagcaccaccgggcgcatcaaccgtggagcataattaagataaggttaatgctgccaaattcagggaacaagattaaaccaggacgaacacggctctattattttaataggcaccctctaaaccccacggtcaaacctagcaacaggtgatgacgcatcgatcccaaattcccaattcgatctcttgctgctccatccgccggaataaaaacgcaaaatcctcgtgcgcgggtggaccttcctttccaccagggcataacgtgtcttcgttttcgcttctcccaaacaaaagcgaaatcaaatcaactgcctgcattgtcttgtggcgctggttccgccaactaatagcacagtcgcaccgcatcccatgccaagtatcgtggaatgcccgcgcagcacatacgccgtcgtcagaaaagcggccgcgaagccgtcaattcggtcgctgtaggctgtagcagtggcacggtcaggccccatcacgacaacccaca

SEQ ID NO: 12655 - DNA, 1928 bp, Oryza sativa
  unsure (1)..(1928): unsure at all n locations
nnnnnnnnnnnnnnnnnnnnnnnnnnnnnnnnnnnnnnnnnnnnnnnnnnatagagctaacaagttatgctggaaaatttacatttaggtcccttgccgccctgtggaagggcgatttttaaaaatcgccctcccaaagggcggcaggcgattagatttgtaaattttcgaaacaacaaattatttttgtaaatattttaataaaaaaagtataaataaaaaaaattccacggttagctccctgcttgcttttatttttcttttcttatctaattattacggggcgttacataagtcatgcagaaaaatatttgagtttgaggatcgacttgaaagcatattgtaaaagatagtcctaaatgtaaaatccttatctttgtcagtgcccaagctacgtcatttgtaccatgaacttaaatatgatacattatattaaaccaagtttataaatctagatatacttcaatctaagtttatgacatgcaatctattttaataaaaatcttaatgctggaatggcaagtaatctgaaaggaagggagtacgtaagttcacctcataaactttttgttaaccagataattctcatgttttcgatgaactaattcagttaacaataacagaaactacaccagcattacatcaccgaattaacactaaacgttgaaagtaacatacatcagtgccatacatcatcagaatcactggaacgagcaagcacacccttcccgtcttctacaactgaatggtgacacccctggctcccatgttggtcagcctctgctccatggtgtcctccctgcccgcgccgcctgcacctcccgtcctcgtcgtctccggccgcgtcacgtcgaacttctcaccgtccccccacagagcgtaggcctcctccccgtgcgccgcgtcgtcgccgatcatgagctggtcgtcggacatgcggagcgggatgaagaggccgatgcagaggagaatggcgctggtgacgatgaggttccagacggtgacgaacagcgcgccgccgagctgcttcccgagctggccgatgccgctgccgtagaagacgccgcgcatgttcgggatcgggcaatcgagagcgcagagctccggcgtggcgaggaggcccgtgaggacgccgcccaggatgccggcgacggcgtgggtgtggaagacggcgagggtgtcgtcgaccttcatgaggaaggtggatttcttgtgcaggatcatcatcgtgaaccacgggacgctgccggcgaacatgcccatcagcatcgctgaccacgtgtgcaccagccctgcgtccatgcaaaacgtacgtgaggatttggacccatgaactgtgtgtgtgctgtggttttgatcggacgaaagatttgttaccggcgccgggcgtgatgcagacgagccccgtcatcataccctgcacggcgccgatgacggagggcttgccgaagaagatgacgtcgaggcaggtccaggtgaggaggctcgtcgcggcgctgacgttggtgttgagcacggcgaccgtggcggtgacgttgggggcgtacggcgcgccgccgttgaacccggcccagcccaaccacagcagcccgccgccggcgatcatgagcaggatgttgttcggcgagaaccgctccctgtcgctcttcagcctcgggcccacctgtcagagtcacgttgtaacatggaggcgtgtgaatagtgcaacaaacagtcgaacacgatgcatgcaatgcacggttgcacgtgtgtttacccagtaggcggcggtgaagccggcgacgcccgaggagaagtggatgacgtatcccccggagtagtcgatgacgccccactggtagaggaagccgcccgcccagaggctgaacgcgccgaccgtgtaggagaagaggagccagagcggggtgaacgccatccaccccttgatg

SEQ ID NO: 12656 - DNA, 584 bp, Oryza sativa
  unsure (1)..(584): unsure at all n locations
cgaattcgagctcggtacccactgaattaattaacgaatggccaattcaacgacctcattaatgaaactatgtgaatggcaactggctaatcacagtgtagtagtacaaattgctaatctagttggattctagaattgatcaaagctagcaggaagcagctgatacctgcgccgggggtgatgcagacgagaccggtcatcatgccctgcacggcgccgatgacggagggcttgccgaagaagatgacgtcgaggcaggtccaggtgaggaggctcgccgcggcgctgacgttggtgttgagcacggcgatggacgcggtgatgtttggggcgtacggcgcgccgccgttgaacccggcccagcccagccacagcagcccgccgccggcgatcatgaggaggatgttgttcggcgagaaccgctccctgtcgctcttcagcctcggccccacctgtcacaaaaaaagtatttattaatcgccgtcacgtggttaacacttaacgccgtcgcgattcgtgccacgtannnnnnnnnnnnnnnnnnnnnnnnnnnnnnnnnnnnnnnnnnnnnnnnnnnnnnnnnn

SEQ ID NO: 12657 - DNA, 496 bp, Oryza sativa
  unsure (1)..(496): unsure at all n locations
ggtcgactctggaggatccccgtatcgagtgatcggcgtcccccggccgggctccgttcggctggccacgggcgacggcacagagctgcctaatccgtggaacatcgaacaccttcgtcgcttctacccctagtgggggtcgggtgtcaggtctcgggctcgggccaaccccgcgcccccccaggcgtgcagggttggccgggggctaccacatgcataaacttatatttttttctcttccgtatttcaataaaagcattttcgatttcctaaggactgtgtctgtgccattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12658 - DNA, 1225 bp, Oryza sativa
  unsure (1)..(1225): unsure at all n locations
ttgtccccgcgcgcgcgatcgggtccagcgtgaccgacaggatgtcctcgccgtacatgatgatgacgaagatgacgaagaagacgccagccacgtacaccggcagccgcccgcccttccgcagcgacgacacggcctgtttcgtgccgaacgggtcgaacaccccgccgccgccgccgccccccgcctgcgagaacttgcgccggttggccatggcgacggcacccggagctagccccctctcctcttcgctctgcacggtgcgcgtgcgtgagagacagagacgcgagcgagaggggcaagctaagctttatggagatggcgaggaagtagtcagcatagcaaagctatagagggaggctggggatttggtgaggggaagccatctcacacttaaaatttcgcgtgatgcttccccctcccttctcctccgtgatcaggcgttgaatcggccactaagcatgatttaattggacgggtggatcggaaacagggagggttttattccttaccaattcaaagcctcgcagacttggccaatacgaggcatgcagaaacgtggtacagcacgccactcatgggagccattattaagtactgtgtatatctgcggcccaatcctgttnnnnnnnnnnnnnnnnnnnnnnnnnnnnnnnnnnnnnnnnnnnngaagctatgctcctttcctggctgcagtagcaccagggattaatattataaggatgcttctgctggggttaggagtaatgaaaaatgaagctatggtaaaatcaatgagccgatctggagacccgaggttgtatactcgcatacaccaacctttggcgattacataattaataagcttgtttctgctcatatttgccttttattctttgcatttttcactctgattttcctttttcctattctatgccttctttttggcacagatttgcttattctttgtttctgttgaatatctatagttgctgctgctgctgcttcaggtcatgatcctttagacttcattttctcatgaacacagggaacttctcaagggtccactgtattatgctaccactataacttttgccacttctatattctggagaacctctccaatcgctatagcccttatttgcaacttatgtgctggggacggtatgtgcgtatatctccagtccttagcttagcgtaaacaagctatgcatactttccttgctgacattccctcccccccccc

SEQ ID NO: 12659 - DNA, 1572 bp, Oryza sativa
  unsure (1)..(1572): unsure at all n locations
nnnnnnnnnnnnnnnnnnnnnnnnnnnnnnnnnnnnnnnnattgggataattggcccaattgacatggaaatgcttgccctgggagaggagacgcaaaagtatttcactgatgattacgaccttttcaccaagaatgaggtacactattcttagtgctagtggaagtagcctttcctgtgaccactcgaatttcatcatgtccatctctctctgtggactgtgcgagttataacacattgaacactgaactcattttgttgtttacctcatttctattcaggaaacagatcaattcgagtatttgatcccagaaaagtcttctctgcagcatcacttacaatgccctgattcagagtttgttgattttctatcctatttgctgcaaataaaccccaggagaagaccaacggcaagtgaagcgctacaacatcaatggctttcatttgcatactaatgactaatgagaaaccaacaggtcatttcgtttgttttaagtgctttgttcaactgctcctaagctggatccctgcaatcttctaaagatggattgattttctgatgtttccccatgagtccatgacatgaaacattttacactttccttgagttttagaaggatttacctttgtgcttgctgaactagcatgcggcacaattttcttgtttcgtttcttcagggcaattcttggagtggaagccctgctctcagtgttaagattcgtgagtgtatgtaaatatgaggaaattttcctgtgtacatgtacagttgaaacaggctcttgtaagccatctgattcatctttcataacatagtgaaaatatgaaataatcatcctgcatttcttcagttgtcgccatacttctgtgaaaatttcccttctaatctcaatcccgtggagatatgttttgttaaatgcacaggaaagtacagaaggaattttattgtccatgagaaatttttagtctcatgagagagtttttagtatctttgagtaacccggaagagccgaaggtaccaccattgcagatttgcaggcccatgaagttgcacaacgcggcccagcaagggcagtgtaccgtgtacgtccagcccaacaactcctatccatccgatcttgaaccaacgtctcggatcagatctggtcgcgacacttcgctctgtcaccggcacgcaaaaatctccctcccttctatccattatccccgtgccccaccactggcgccgctcaccggtcacgaccaatgccgccgaccgccgccgtcgccgtcgccgtggccgcggccaccgcgctcccttctccctcctcctcctcctcccaccgccgcctccccgccaccgcaaaatccgtctgggtaaaccccagcctcccgagctcccagcccttccatcgccggaaacccgccgagccccagcaccagcgccaggaccacgtgcccgacctccccgcgctcctcgcggccctctccgccgcgcgcacggcctccgacctggccgccgcggtctccccgcaccgccccgtctccccgcgcctcctcggcacgctcctttcccgcctccccgacgcgcgccg

SEQ ID NO: 12660 - DNA, 6431 bp, Oryza sativa
tataggcgaattcgagctcggtacccataccaattagactaactgaactatcaacaatgaaattttacaacagaaggtgagatacaactggtgtttaaatgccccactacacaaataccaatctaacattctgctagattacaattccttttgtcttcagacatggcaattctgtacgaaccttgacttgatttttatcaggatccaggaaacctaaacgaatatataaataataatgtacaggtgctatcccctgagaacggacttatggcgtggcaggcgtttcagccttcatcaaaacaatttcatgtagcggctgcaaaatttacactgcctgatcagtttgggggatgccatgtttttggaaccattcaggcatatgaaatctttcgtatagtgctggtctaacatctctctggatagagagatgcttcagaagtggaaatataacttccatgagctgaaaacgtttaaacaagtcagaattagtaagtagtggaaactcaaacatggctaaagactggtggcagttatcagctacctgattatcattatgttgtccagctgaaaatggaacacagggtattccattcaaaggttgcaatatgaaactgaatgggttgttgtcaacaatgacaactctgcagaaatcttttgacacgcaagaaagatctttgacatgttctctgtattccctgaaattgtgcatcccatggatatcagaaagcgcattggccaaacaccaaataggtcctatgcgacatttccagcaagaaaaaaagccacttaacacatagccctcaactaatttggcacacatctcagcaagcatagtaatgaatgcagcagcactatgataatatggtaaaacaccatgtgtatccataggaaagttaacagtaacttacgtagtaacagttgatggacgatatagacggagtttgaatctattatggacatctattctgtcaactaaaggtcttgcataacctgagaacaaacatgggcatgtgaggtggcgctaattgggttcaaatgaatgaagaaaaatagtagcaagcacataccttccaaacctgctgtaaagagaataagatctgcaaattcactagttttctgcaagaactcgtgcaaaccaggacgttcaaaaacggtgacatgattcactttgtttctcccttcaacatcctttacagttcacacaagcaaaagatcctttagcagtagtgattaaaatcattacatacaataagagccaaaagcacaagttctgtaccttctcagtggatatgcactccatgtcaaagcaatgtaatccagcttcaacagcttgggtgcgtacaatagctggaagactggatgattcatatgcagaaactaaagtttcatccaaatcaagcacaacctgaatagataacccaaatattttcagaaatggtgaatgaataacttataattatcatttcatttttcgttttatgtaaaactgttatcatttcatcttttgttttatgtaaaactgaaagctcaacataaaaccatccaagttcttcacccactaaaacaaaatatgctaacaggaaaccctgctatgagcaaattagccaatgttaatcccacatgataattcatatataatcaccatatgtataatctcataattctgattcaattacagtcataatgtatcatcaccaaatgcattatcccacaacactgctcaaatatctactcatctacacatcgatttcaacggacgttctaaattaccatccacagctctgctaaagactgcagcaatgtatgggacccggttaagtaccaacaccagcaccgttgcaattttggaatattaaatcatcatttcatgaattatccaagcagtataattcagagagacggattaacgccattgttggctgctaaacgaggacttgattggggattgcaggacaacggattgcccatgctcgtaagccaagaaaacaaaatcatcgcaattcaaatccccacaaaaaaggtcagctttacaacccacacaataattagcccccaaaacaaatcgaattgcctgaattaagccggaataacacccagctaacctcaaatcaatcactctacgcatctaccaaatcctaaatctcccacgaagaccgggacatcaaaaatcagatcaagaggctcctcccacatctactgtttcatccaaatgatgcccatatcatccctaaactagccatttccccccttaccaaactaccgaggaaccccatagcgtcaacgaatccactcaaaaccgaatcttcgtaccgtgaggcgctgcagggattccggcgggggcgtcggcgcaggggccgtgtcggccgggatctcggagcggagcggcatgaaggccaccgacggcgactgctcggagtcggccggcccggagaggagcgggtagcggaacccgacgaaggagaggagctgggcgcaggatggggtgccccggaggatctggagcaggacctggaggaggaacccgatccaccccaccaccgcctgccacgcctgcgccgccaccttcccccgctgctgctgctgcgccgccgccgccgccgtcggcgagtacacctccgccgccgccatgatcgccgcccgcggcgagctgtctccccgcaacgtggggcggttgggaggcggggaggcgaaggcgatggcggtggcgaggccggagaggcaaccggaggagggaggagggggggaggaggacgtggtggtcgactggtcgtggtcgtgtgtttgagggggaggccgcgggtgccccgagtccgtattcgtctacgtgtgcgtgtgtgtgttggcgcttcgtttgcccgtgtccgtgtggacttagcggagttacaggagtagatttagcgggcccagttgtcagtgagaggctcggctcgtctggcgagctgccgggagtgtgattatacttacgtgcacacgaagttttctcctaaatttgtctagaaagaacatgcaaaccgctcacactcacacccatgtgatgcggacacccacaccctatctctatatgccctctggaagactaatatgatatatctcgcctaccaggctacctctatatgccctctggaagactaatctgatatatctcgcctaccaggctacctctaaaaaataattagacataaatacaaacgtctgtgtcaagtttagtacgaatttactattagactaatttctcacaaagaatttaatcataggtcctgtttagttcacatcaaacttctcccaaactcccaattttccatcacatccaaaactttcctactcacataaactcccaacttttttcccaaaataacaactttccctgaacttctcctcaatttcagaaactaaacacagccataatcgtaataagttaagctaaactcacttcatgtgtttctccatctcctgtgtatcatctactccctccgtcaaaaaaaactaaattaattggggatgcgacattgcctagtacaacgaatcgttggatatctaatgttctattcctaactggattgggttttatggaacggacgagtacatactacttgtgtatgtattttcctgcttgcgtatgtgtttatcctatctggtttgattttgacaaagtatcaatcgaggaacagtaacgttgacatattattatacttgagtacatgttaacgaattcaatcatgcgaattgatttttccaggaacgcatgtgtttttgttgttgtacaatttgttactgtaatcttgagtaaggcatggatttcttatacagggcaaaactgagtgaacgattagaatatgattaattaaatattagcttaaaatatttttcttattttttaagaaagcgtacctttaatagtttgaacgtatgtgcgaaaaaaatgagggaatggaggttgaaaaaattaagagaaaaacacagcctaattgtatacacttggaaaattataaatggaacagttataacctacatttgcgcatataattagaaaaatataaatggaacatgtgcatgctatctaaaatagcggtcatattgctttcagaaaaatgtcccagaaatattgcttcgagaaaactaaaccaatacatttatgtagtactagcaaaatggttggttagacataatgagttctgtaacttacgaaaatgcaatcaaatatttttcttagctagtgtacacagagtatttcctcgcctcacaaaaaaaaatcatttcctcctaaagatgccatgccttgcattgcaccaaaggcatgctttgctattatttctttcttgttgattatacctaagcaaagcagggcccctttgatcttttttagctataggggcaacggaaaaacaagtgggacatgctccatgaatatcgtttggtaaaagacacctaaccaaagcaggacaaggagagtacaataaaaggggccttatcttgttcagttgaaaaataattaccatcacgtgttgattaaagtttttttaaagaaaaaagcctgagaaatggcctctctaggactgaatattgtcacttgctgtcatttagggcttgtttagttcacgaaataaaattttttaggtgtcacataggatattttaccggatgtcggaaggggtttttagacacaaataaaaaactaatttcataactcacctagaaaccgcgagatgaatcttttgagcctaattaatccgtcattagcacatgtgggttactgtagcatttatggctaatcatggactaattaggctcaaaagattcgtctcgtgatttcccccataactgtgcaattagtttttcttttaatctatatttaatacttcatgtatatgtccaaagattcgatgtgatgtttttagaaaaacttttggggatctaaacggggcttagcttaaagttactgtggccatggtgtgtagtaggagtactagttgttttcagatgaaacatgctgctgattagagcatgcattctctgaaatctgtatagtcagcgagtcaggtactcaggttactatacagatgatacagttctgaagttttcacccatgaagttttgaacggcagaagtttcttgagggtaaaaaaaacgagttaaggcttgcatgtgtttttttttttttgaaaccaggcttgcatgtgttttatgagttctgaatgtcttcactatggtccctcaactcattagtttttgtcctgttcattgttcacatatgcttgtcatctttcatccctctttattgcagtggtcaataactgaacttgccatcaatgaataaacccaatgttaccttacctacgacaaaaaatgaaattctgtgacaccgaaaatactcatcatggagaggttgttggtagctctgaagctgtccaggtgaacgaattgaatggattaatttaattttagtgcggagactctcccaaatttctaatagcacaaactgattcattcgttttagtaaattctttgctgagaaagcgtcttctgcttggctacgcttaccggccactcgtagctagctgtctggctgctttgtaattggaacatatcaatactgttttgatgtcacaccatggatgagtccaaaattttatcaggatgtgcttctatgctgttcattggttgcaccatcgtctgtttcgtgctggaacacgaatatgcggagcgttgcgagcaacttaggatttaactaatagtttattgattttctttaagatttacttgatgttttaagatatttaacctatatttgaagataagtttagagctcaagcccttggtattataggcctacctccgcctttgattgcaacattggattataccataaacttagaataaaaatgaaaatgaccattagcttttcaggcttatctatactacttcatccgttttatattacaagtcgtttaacttttttagtgttaagtttgatcaaatttatagaaaaatttagcaacatctaacatatcaatttagtttcattgaatctaatattgaatatattttgatagtatatttgttttgtgtcgaatatagtactatatttttctataaacttgatcaaatttaaataagtttgactagaaaaaagtcaaataacttattagagtagacaaattatatttagcaccatattcatgcccaggaattatactactccatccgtcccataatataaaatattttgactttttatttacactgtttgatcactcgtcttattaaaaaaatttgtgcaaatataaaaaatgaaaagttgtgcttaaagtactttgaataataaagtaagtcacaaataaaataaataataatttcaatttttttttgaataagatgaatggtcaaacagtgtaagaaaaaaaatcaaaatcccttatattatgggatgggag

SEQ ID NO: 12661 - DNA, 6902 bp, Oryza sativa
  unsure (1)..(6902): unsure at all n locations
nnnnnnnnnnnnnnnnnnnnnnnnnnnnnnnnnnnnnnnnnnnnnnncagggctggtcccgccattctcttctttcttcatggatgttctggagctttatgatctccagatggcgcacctcacccccaacgcggtaatgacgttggccatcttcgcgcacctgtgcgagatgttcatcggggtgcgcccatctctccggctgttccgatggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgaaccagcccccggcgcaggcctccagctggcgggcgccggtagatctgggagacggctacgacgccgttcttgaccgcctggctggtctgcgatcccaggggctcacggggaccatggtgtacggcgattaccttcatcgccggatcgcgccactccagcggcgcgcccggggcgcctgggagtacaccgggtccgaggactacatgaggacccaccagggggtcaaatgggactgggtccctgaagacttcaagatggtgatccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgagagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgaggaggagcgaaaaaagaagcggctccgcaagatgggggggaccgaaccatgccggggaaacctcatctccccccccaaggtggtcgtttagccgacctcctcgcaggttcgtccccgcgcccactgcggccgtattcattctcccatctcccaaggcaagttttcactcacccgtttttcgtcttctggtttttcttctgcctcagcgagatcccgtcgcgcccttcccgccattccaagtccggccggtctgaggtcgaggagacggcgaccgcggaggcccggaggcgggaagctgaccggcgagaagccgcagaccgcctccgggaagccgaagaagctgcccaggaggccgtccgggctcgccaggctgaggaagccgcttgggaggaggccagactccgccgggccgaggagtccgtccgggagacggaggcggcgcgcacacgccgggcggcctgccaagcccccgacccgactccgcccgaggcgacaacgacttccgaggccacccacgacgaggccgcgggcgcgccgctcgggcccgacccctctggcgacgttcgggacgagcccgcgtcgggggacgcccccgagttcggcacgtcgatcggcgggccgagccgcgcggcgcccacaccgaggcggctctcccctctgccttccgctgccccactgagcgcagagcccctcctgcaggccttggccgctgcgaacaccatggtgttggacgggttaagcgcccagatggaagtcctgcaggcagagcgggcggaggtcgatgcggcgtgggcgcgcgtcgaagagggacggcgctcggtggaagccatggtggaggcgggccgcaaggcacaccgccggcacgcctccgagctcgaggcccgtcgtagggacctggcggagatcgccagggaggtggaggaggagcgggagactgccctcatcgccaccgccgtgttcaacgcggcgcaggacgacctctgcctccaatacgggagccgggcggcggagctagagaagaagctcgacgcgtcccggcagcgcgaagaggcccttgaggctcgcgccacggtgctggaggagcgcgcccgcgccctggacacgaaggagagggaactggcgggtcgcgaggccgccgtcgccatccgggaggcaacgctggcggcgcacgaggccgcctgcgccgaagaggagtccgcactccgcctccgtgaggacgagctcactgagtgggagcgagctctcgaggaggccgaggccgcggcgcagcggcgggaggagcaggcgcgcctcaatctggaaggcgcccgcgcagagagggccgcactggatcagcgggctgctgaattcgaggcgcgggtgaaggagctggacgcgagagcgcgcagcggcggggcggccgcgggcgacggcgacctagccgcccgcctcgcagccgccgaacacaccatcgccgagctgcagggcgcgctggactcgtccgccggggaggtcgaagccctccgcttggcgggcgaggtagggcccggcatgcttcgggacgccgtctcccgtctagaccgtgccgggcggcaggcgggcctctggggcgggcggaccgcgaaatacgccgccaaccaggggggcctcgcccagcgcctctcagagatggccgggaccctccagcggctccccgaggagctcgaggagacgatcaagtcatcctcgagggacctcgcagggggggcggtggagctcgtactggcaagctaccaggctagggaccctgacttctccccgtgggcagcgctggacgagttccctcttggaaccgaggatggcgcgcgcgcgcaggtccgggacgccgccgaccacatcgtccacagcttcgagggtacggcccctcggctcgcgttcgccctcgactccgacgaggagggcggtgacggtggtgcggacgtcagcgacgatgaggccggcgacccgggcgcgtcggcgtgagcccccaggcccccgccaatcttaaatagctttttctttcttcttctgaggccttcgggcccccttcttgtataaactaatttaatctgcaatcaaataaagaggaaatttttgtgtcaatttcatttgttgtgtgtatgagacgaggatggtctgtgccacggtccttctgtgtctctgtgtcttagcttaaacaagggctcgtgcctaggtcctagcctcaaatggcgcgggtcggggctagtgcctggggagatccacgtgtcgagactggccaggccgggaatgtggtgaccgagggttatggatgacccgattgtgggcctttgccgattcccccccggagttcaccacgccccggggcacggctcggttctgggccccttttggcgattttagccggcccgggccaccgagggcaggatcgagcacgagcgtgctaattcaagccaagattcttcgaaaggaaacaatggcacagacacagtccttaggaaatcgaaaatgcttttattgaaatacggaagagaaaaaaatataagtttatgcatgtggtagcccccggccaaccctgcacgcctgggggggcgcggggttggcccgagcccgagacctgacacccgacccccactaggggtagaagcgacgaaggtgttcgatgttccacggattaggcagctctgtgccgtcgcccgtggccagccgaacggagcccggccgggggacgccgatcactcgatacggaccctcccatattggtgagagcttgctcagtccagcacgcgtttggacacggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctggcaactcctcgatccacgagtcgccgtgcttcttgaggatgttgaaggttttggttttgaggcccttgaggatttctgcgttggcgcgctccacttggccattgcttctggggtgggcgggagaggcgaagcagagcttgatgcccatatcttcgcagtagtcaccgaagagttcactagtgaactgggtgccgttatccgtaatgatacgattaggcaccccaaaccgagcagtgatgcccctgatgaatttaagcgcggagtgcttatcgatcttgatgactgggtaagcctcgggccacttaatgaacttgtcgacagcgacatacagatactcgaacccgcccggggcccgcctaaacggacccaggatatcgagcccccagacagcaaacggccatgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacgccttgtttccgaggaatgcacttcaggaggactctgttagccgtgcaccgatagagggtcccttccaccagcacgtagcgcttggagatgcgctggacgcgttcactcccttcgcggtcctcgggtagagtcttatctgtgaggtatgcctggatctcagcgatccaagcaaccaatctaagggagctgggagcgctcccctcgggtcccgaggcctggactccgacgggcctcaggggccgttcaggcgcgtccgtctcccctagggggtcgggccgcgccgacggctgggcaagcctttcttcaaaggcgcccggtggggtctgggcttgcgaggaagcgagcctcgagagttcgtcggcgaccgcgttatcccgtctaggcacgtgccgaagctctatcccatcaaaatggcgctccatacgccgcacttggcgcacgtaagcgtccatctgcgggtcagagcaccggtactccttacagacctagttaacgaccagctgggagtcgcctaacaccaggaggcggcggatccccagtccagctgccaccctgagtcccgcaaggagtccctcgtactccgccatattattgatcgcccgaaagtcgaggcgaaccagatatctgaggacgtctccgtttggcgaggtcaacgtgacccccgcaccggcgccctgaagagatagggagccgtcgaactgcatcacccagtaggcggtgtgaggcagctacgaggggcccgagctggcctcggggacggagatgggctcaggggccggggtccactctgccacaaagtcggcgagggcctgactcttgatcgcgtggcgtggttcaaagtgcaaatcgaactcagagagttcgattgcccatttcaccacccatccagtaccctctcggttatgcaagatttggccgaaggggtaagacgtaaccaccgtgacccgatgcgcctgaaaataatggcgcaacttcctcgaagccatcagaatagcgtaaagcatcttctgggcctgagggtatcgggtcttagcgtcccggagggcctcgctaacgaagcagacgggccgctgcacctttcggcggggccgatcttcttcgctaggggccacatctccagggcgctcttcgtccgagaggccgcgcggggcgcactcggcttctgtgccgacgacctcggggtcggagggcgacaggcgcggccttcccgcagtggccccggggccatcctgggggtcgggggtgcctggcaccgtcggacaagcgggcggagggccaactccggccgtcgggggcctcgggccgccgttcgactcgggggcctctcctccctgctctctcccgggtcgagtcgacacagggtggggatgcgcggagtgagggttgtcctcgtcgcgctccaagaccaacgccgcgctgaccacctgcggggttgccgctaggtaaagtagcagcggctcatctggctccggggcgaccaggactgggggagaactgaggtacgccttcaactgagtgaaggcccgctcagcctcctccgtccagataaacggcccggagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgagaagcttgcccgcaggcacaccgaacacgcacttgtcggggttcagttttatgcgggcggagcggagactttcgaaagtttccgctagatccgagagtaaggtctcttggttgcgcgtcttcacaaccaagtcatcaacataggcctcaacattacgtcctatttggctacccaaagaaattcgagtagtacgctgaaaagtaggacctgcattctttaacccgaaaggcattgtcgtataacaataagttcctatgggggtaatgaaagcagttttttcctcatcctccctagcgatgcgaatctgatgataaccagagtatgcatctagaaaacacaaaaggtcgcaccccgcggtggagtcgacaatctgatctatgcgtggcagggggtaagggtccttaggaaaagccttgttaaggtcggtgtagtcgatgcacatccgaagcttgccgttcgccttgggaac

SEQ ID NO: 12662 - DNA, 3108 bp, Oryza sativa
  unsure (1)..(3108): unsure at all n locations
nnnnnnnnnnnnnnnnnnnnnnnnnnnnnnnnnnnnnnnnnnnnnnnnnnnnnnnaacctctcggatgaatccggcctccagaagtcgcgccacctactcgcggatgaaggcttgacgttccggggcctgccaccgtactttctgccggaccggtcttgcgcccggccgcacggagagacggtgctcaatcacctccctggggaccccgggcatgtccgccggtctccaggcgaagacgtcggcgtttgcccgcaggaaggagacgagcgcgtcttcctatttgccgaccagaagaccaccgattcgtgtggtcttggacgggccggcgcccagggcaaccttcttgaccgggacctcgtcgcacgtgatcatccgctgcctcggggcggctgggatggaggtgctgagcctctcgttgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccgaagcaccatccccggggccttgatggtgtcaaaggctgcgggggaaaggatgttgagggctgcacccccgtctatgaggacaccccccaactttacgttgcaaacggtgggggaaaccaccatcgcgatctgtcctccccgggcaacgcacggcgggtggtcggtctggtcgaaggtgagggcaacctccgaccaccgcgtcgcctcatgggtaggggccgcggccagaagctctcgcttcatggccttgaggctccgacgagaagcgtgagcgcacgctcccccatcgacggtggcgatggtggccccaggctcctggaaccctaggtcatcgtcgccatcgtcgatgtcctcagcgggggccttttgcttggcctcacttcgccggttgccggagggagccgccggggccttgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggcgctccctgctgggagcgccagcctccttctttttgttgctcgcaggcctcccctttcgggtggcccgcgaagcgccctcgacggcgaggacgtgaccctcgtcgtcggaatgggccgacctctttttcctcctcctgtcccgccgctctgaccgagcagcggatccgggggcggccgaagctgccacaccggaaccggtggagttccaggtccaggcctcctccttgcgagccacacggtccgcgagctgaaaaagctccgcggtggtctggggctccttggaggcgatcttttcgagcatgcggttgtgccgcacgccccgcctgaacgcgtagattaccgcgtgtgcagggatgcatggtatggtgttgcggacttgacagaaccgctgaatgtacgagcgaagagactcatcgtcccttcgctgtaccgcatgcaagtccgcttcttcacctgggcgtggatatgtgccttggaagttcatggtgaactgctggcacaaatcctcccaagagtggaccgtcgcgggcggcaagttcattagccaaccccgcgcctgtcccttcaggtccatggggaagaaattcgccatgaccctgtcgtcacccccggcggcctcgatcccggtcgtgtagacctggagaaactcggcggggttgacacttccgtcatatttttcggtgatagtgggccggaaccttgggggccaacggacgttccgaaggctcgccacaaaggctcgacagccgacaccaccaaccgggggcacggggggctggcccccgcgcccaaaccgaagtggcgctccggacgaggaagcgccttccgttgcgtgggcagcacgacgaccattgcgccggcgctcgatactgaggcgggcatccggccccctacgcacatcttcttgggtcggaggcgttgacgaggaaatggcagacgaacggcgggtaacggccgccgctcgccgcgccctccggctcgacgacacggagccggcggtagcagcgccagaggccttggtggcggaggaccgcccaccggcgcctaggcgctgctgcgccgtcatgaccaagtcggccacgtcatccagccaacgtcgggctggagtctctggatcggggacgacgggcgggtgacgcaagagcgcgcccgcagcttggagcgcgccctggggcgtgctgccatcgccgtagacgaggaggcgacgctccccgtctcgccgtccttctccatcgctcgtgggcggcgaagtcgcggatctttcgaccccctcgagcacctcctcccgcctaagacttcggcgagaggggggcggtggagtacgagctcgacggcgcgggttctgctccccgtcgtcaccgctagcgctcggagagaggttgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcgggcccccctttgccggttcggccaggggcgcaaggtgaggttctaagccctcgatctgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctaaagaccctcttcctctttctctcctctccgagctccggtgtttttcccccccccctcttctctcttttttctcttaaggggg

SEQ ID NO: 12663 - DNA, 2036 bp, Oryza sativa
tcccaaggtctctcaacccacacgctgcgtagctagcatcgatccatcgatcccgtctgcatctctggttcctgcacctgatttaggcgaaaggttcccacttcctctgatctttttttttctctcctctacttggcaggttctacatcatgaggttggagaagcggccgctcaagttctggacgatcacccaccacgcgagcgtgacccagtgcctcggctccatcggcggcgaagattggtacctcggcgtggccaagccctcgatcgtggaggatggggcacacgagcagggcggcgatgggaggaagcccgtgcagtcgcgtgctggccactactaccttcctcccgatccagctgaagtctgcgtcttcagggtttccggcgctaagtttctgaagctgcacatcgggacctggcatgcggggccgcagttcaaggcggatgcggtggatttctacaacctggagctcagcaacaccaatgtgagttctaagctgttgaattgaacttcgacttattagctattggttcttgcgttcagtaatactggaaaaaaatggcttctcaactttaaaaggtaggaatgtttttgtttgttccattttgctatgcacgggcgcggtgcgtttacgcatggccatacagttgtgtttgtttatatatgtcttagagcctgatacaattttaggaataaaacttattcaacttttaatttcaccaatccttatcactgacagaagtgtgtgatcttgcttgcaatactcagtactacaatgtttggatagtccagcactatgaaaacattcttttgagtaaatttcacaaaactacaatttagcaactttagtaaggtatttcgcagaacagcaacaacagaattttatcagaaagctataactttatccccataagttgtatgattgtatgtaggaattgagaagcatgagtacttcatatgtgtatgacacgccacccaaacttggcacacaaataagagaaattttacactacttgagaaagtaccttgaggtacctaaatttttgataccttgagatatacctagagttaccaaattttactatagaaaatatggtatctctaagtaccttctcaaggatggtaaaattaccccacaaataaagttgcagttttatgataaaatcatatactgttgtcacagttctctgtaatggctagctaaagttgtagaaaattgatagttttgataacaacagttgtagttttctgaaatttactctattcttttagaatagttttctatggtgctgtgggaaatactatagttgtgcctccttaatagatatttcatgaaacagtgcatgaaaatttcatctttgtgcactgtttacatcaaattcttaagcccttactcatcttttaggcattttggagagtttatcaggttcaatctggttgcatctgtgtatacagttcattgaagcagtgtgctctgtggttgcatttgtcttttagactaaagcagtttattcaatgaccgatttggcaatttctattgtcttcctagttaataaacttggttctgcttattgctgacttatatgcatgttttcgtaattgtattcttgccaataaatctagggtgccagtgtggtaataatcttctctaaatgaattattgtcagttagagttggaaacttatctggtagtctctgattgctggtgtgtccagaaccgaaatccacagagtcttgtttctgtgtcacaagaatggaccaactgaacctgccggttctaaattttgcgatggactccagatatctgatgcttgtctaatctaaaatgagttagtaattatctgctagttggaggccaatgacaggacccatattcctacttttgttagggtgcagaaataacaaggacattctttcgaaaacaactcaatatgttgtagcactaaagaaagtccaacaatctagttggtctgccaagtttggtggtcgtccctctttccataacttctgataagtgtctttcttttttagagga

SEQ ID NO: 12664 - DNA, 401 bp, Oryza sativa
ccatattatcatagtgctgctgcattcattactatgcttgctgagatgtgtgccaaattagttgagggctatgtgttaagtggctttttttcttgctggaaatgtcgcataggacctatttggtgtttggccaatgcgctttctgatatccatgggatgcacaatttcagggaatacagagaacatgtcaaagatctttcttgcgtgtcaaaagatttctgcagagttgtcattgttgacaacaacccattcagtttcatattgcaacctttgaatggaataccctgtgttccattttcagctggacaacataatgataatcaggtagctgataactgccaccagtctttagccatgtttgagtttccactacttactaattctgacttgtttaaacgttt

SEQ ID NO: 12665 - DNA, 455 bp, Oryza sativa
  unsure (1)..(455): unsure at all n locations
nnnnnnnnnnnnnnnnnnnnnnnnnnnnnnnnnnnnnnnnnnnnnnnnnnnnaccatcttcatctatcgtagttctagccatctcttttaatgatcgacacttccttcccactacaccatcttgttgaggagagtaaggagcagaaaggctgagttggatatcaataatatacaataatactccaaatagctatattgatggcaggtgccattgctattgttgatcatcaccaaaatgcaaccgaatcacttccgtgctctttatgcagactcatagaaaaacattgacaccttaaactactacctccgtacgaacacctaatggatactagaatattgatcaacaatcacatgaccgtgtctcttaccaccaatgtttttattagaaggtgatccgaacaaattcacttgcgcaagctccaatggggtaaatgtggacttgatacttttatatg

SEQ ID NO: 12666 - DNA, 658 bp, Oryza sativa
  unsure (1)..(658): unsure at all n locations
nnnnnnnnnnnnnnnnnnnnnnnnnnnnnnnnnnnnnnnnnnnnnnnnccctctctgcgcgggcgccttccagattgaggcgcgcctgctcctcccgccgctgcgccgcggcctcggcctcctcgagagctcgctcccactcagtgagctcgtcctcacggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgctgccgggacgcgtcgagcttcttctctagctccgccgcccggctcccgtattggaggcagaggtcgtcctgcgccgcgttgaacacggcggtggcgatgagggcagtctcccgctcctcctccacctccctggcgatctccgccaggtccctacgacgggcctcgagctcggaggcgtgccggctgtgtgccttgcggcccgcctccaccatggcttccaccgagcgccgaccctcttcgacacgcgcccacgccctatcgacctccccccgctctgcctgcaggacttccatctgggcgcttaacccgtccaacaccatggtgttcgc

SEQ ID NO: 12667 - DNA, 554 bp, Oryza sativa
aaatccttttcacggccactaagtgacactccttaggagcggcttgaaaccgtgcacacatgcaaacactaaacatgatatccggcctagatgcggtaaggtaaagcaagctaccaatcatggaacgataaagctttaaatctaccggtttacctccctcatcaaggtcgagatgtccgttggttgccataggtgtcttgatgggcttcgcatcctccaaaccaaacctcttgagtagatccttgatgtacttggtttggctcacgaacgtcccatccttgagttgcttgatttgaagtccaaggaagaagctcaactctccaatcatggacatctcaaattccctagacatcatatcaccaaattccttcaacttgtgtgaaaccttgcgccaccaaccttgccttgtttctcaccaccaatccactttgttcctaaatatccactttgtccctatgacattgtggtctctaggtctttcaaccaaagtccacaccttgtttcttgcaaagttgttgagctcttcatgcatagcattcatccaatccggatca

SEQ ID NO: 12668 - DNA, 2405 bp, Oryza sativa
  unsure (1)..(2405): unsure at all n locations
tgtagcagctaagaagaatccaataatcactgaagataaaaaaaaacataaaatgaggtatataggcaatgagcttgccctgtgcagcagtgcggactgccttggctgctaggtgctttaggtgttagcctcagtgagcttgctgcattttgttctaagagacttttttttttaatcttgtgccactcttcacaactctattctttcttttccataaaaaaatcacgcttctatcttttgccactattccattagtgtgcatttctctatttctatccctgtctgatcaacaaaggttggccatcaagctttccccccgaaagacaattatggcattgcatatgttccaaatgaaaagaaaaaaatactaaatgaacaatgtagagaaaggtacaatgttaatttagatggcacaattcttaatagcaatccaaacatatgtgcaaaacaggcggtaaattttagactaaggattaagtacttgaataagttacatcacagcatttaagagttatgacaaatacaactacttgtgtaaatttggcatgtttcccgctatggcatgcaaaaaattgcggttcaatgccaaagtcatactgaaaaagcttaattaatcataaaatactgaacatgaaaaggggaagatgaactaatataaagggaatacttaaagatgagaagcacctaaaagggaatccaatctaatcaagttaaaaacatgaaatagagtattgtgctaaaggcagggatgtgtcttacttaatacatcccatgttccaactggtaaaaacatgtgataagtttatatgtaaattaagtgccataatcaccactgctgtagtaaggttagtgcatttactgctaagacatagcagtttcagttctatagcgttctcccaaagtacagcacgctgaactcaacataatgtattgacacaatgaatgtacaaataacatgtctggtgcaacaaaactaaatttagccatgactatgcatcagcatttgtttcttctggattctataaatagtaagtccatacaacagacaccttagatcctaaacctagtgtaccaaatactgaacccacaatacagtcttcaggaaaccaaactactgagactgatgcaatcatagaaatggccaatattgaactagtgttctgcaaattatcagcattgaactactaaggagtgcaccaattccagcaaaatagcatcccatagcaaggggaacaaccaacattgaactacggtttggtgaaaaagacactaactccatccaaataccatagtaaaggcgctgtcatatacagtattcgattgaccacccaaaaatcctgccttcaactagaagtacaaaaactggtgatagctttttcctctatggaagaaatgcaaaatctttgcagattacacagcagaacaactgcatttagctacggcggtatccactaccaagtattccacccaaaacagaccattaggctagagatctcacgaggctgtacggaaattcagaagtgcgagtggataattgttcgaaattgggaacggatctcgattctgcagggcttaccgggcttgaagaagatggagaggccgaaatcgatggccttgagcggcgagttctccttcttgttggcgaagaggaagttctcgggcttgaggtcccggtggataacgccgtggcggtggcagagctggacgacctccacgatggtgcgggtgacattggcggcggcgcgctccgtgtagtggccccgcgcgacgatgcggtcgaagagctccccgccttcgcagagctccatgacgaggtgcacggcgccctcgtcctcgcacgcctcccgcagcgacacgatgctggcgctcttggggaggtggcgcatgatggcgacctcccggcgcacgtcctccacgtcgaccgccgtcctcagcttccgcttggagatggacttgcaggcgagcagctccttggtgtcccgatccatgcacaggtacgtcaccccgaactccccccgcccgagctcccggtccagcgcgtacttgtcgtcgatccctccgatcagctcgcacccttcctccccgagcacggggagccgcttttgccccgctcctcctcctcctccgccgccgccgcccccgccgccgcctccccccacgccgccgttccgcgcctggtggggcttcttcttcccggccgatgcggggaagtgagacgacttgacgtcctcccgcgccgcggcggccggcgagcggcagcagttccccatgctcgcgcgagatcaaggggagggagggctagggtttgtgctgcattgggcgccgcggtgggggattgggagatgggannnnnnnnnnnnnnnnnnnnnnnnnnnnnnnnnnnnnnnnnnnnnnnnnnnnnnnnn

SEQ ID NO: 12669 - DNA, 17634 bp, Oryza sativa
  unsure (1)..(17634): unsure at all n locations
nnnnnnnnnnnnnnnnnnnnnnnnnnnnnnnnnnnnnnnnnnnnnnnnnnnnnnnnnnnnnccgtggcgccgtcttatctctaatctctcacagtctgcccggtttttttgctggattattttggtcaagtatctaaaaataagttctctcacaaaacattactacattttttctactgtatttttaagattattattattccaggctatttgttaatttattttattatataatcgtgctaataattgggttaataatctatgttcttatttgttgcttacttcttattataagccataatggcacattaatagttaaaaaataattataattaaaattttgtatatgtgtttttatcgacttaaaagttaatataaaaattacattttaaataatattaaatcaactttaaaatcaagttttagaattcaaatattaatattggcatataaatcataagccaaataatgaggctctaatcttaaacggttaagaacatcaagccatattagcagtgtgatttaacaagaaaatcactgcggcacatacgcttttcctctatgcatcttctgttttgtttcttttttgctagagacttgcctgagctccgaaaaccgatgtgtttaggattcaaccttctgaactgtccctgtcactgtttcagagaccgtcaaagatcgtgttaacgaagctgtgtagtatagtattgttgctgtctttgcagcgcctagctgcggaacaatatgccgtgattttgcgtgcgtgatgtttgtgtgtcactgtgcgattatgtctataccactcaataagtgtagtttacgctatcgttcctgtagctcgagacgttgaaatgcgaaaatgtcaacaatacgtgggccgttgcaactaccgttagaagcctctcgttaaaatttcaacgttctcttgccaaccttcaacgccatcaatggatcaaaagccaaagcctaacctacacttacacagctgtgagatggacttgttacacgtttctagcttctagccggcaataaactagtagacggtatttggatcggtaacaacggaggtcttcttcccttccatttttgaaacccttgcaaaaagcgttccagcttttaaccaatatgagcaaattcaagtgtgtgtatctgtggccggacagcgaatgcttccgaaacactcagggacaaagcggagctagctacggctgtcatcttggcttaattagccatgcttccgacggcaaggggcgacaacgactgctcgacaaaaaagcaaacctccccgtttgcttcgacattaaccatgcaacagtgagcagaatacgacctgtgaggcagccaaagcatgaaaaatgaaaaatcaccggtgaacgaagtaacgagactgtttctacgtgtggccatgtttgcccgcatgcgtcacagggttatcctcgccttcttttttttctcctcgcgggatgagccgcgggagatgagagatcgccgtcgtgcacagcgaattcgaaagcagaacatgcagctatagcaaagcgcgcggttactgtatctcatcgtgagcagtatagtatgaaacggaggggctcagcggtcacatcgggagtggattctaatccctcgaaaggatatcccctcgtatacctttttttcttttaaattcgatgcaaatagttatgaaaaaatctgaaaaaattgacaatgtagagtataatgatacctactagtctaccaaaattcaagttcaaattcgatctacacatcgaaaaaaaaagacaaatttagatataaacagtacgctactactcatatgctgaatttatcttttttatatctcggcgtgtgagttgagtttggacttaagattttgtggagttgtatatatgtgttgtatgaatattgtcaaatttttccaaaattttttataaccgtttaaatagcttttaaataaatgagggaactcccttgaaggattagaataatttccccggtcacatctgcagtgggggcgagagagattggagaagcctttgctgcgtgcagcgtgcgcaggaagcagcggtcccagtcgtccgtcccaagcaggtgacacccaaaaaccaacgactgctgacctcgctaccggaaaacggatctcggcgacagcaaagtcccccgcgccgtaccaaacctttgcctgaaaaagcaccgagctgatgctgtgctgccgctggccagggctccacctcccgccctcctttttcttcggatgccatcatctaccctgcgcccgtacaacacaacacaacaccacccttcttctccatcttctgcatgactgcatgaccgatcggcgaacctgcagcagccacaagatcggttggtttggttcatccatgcagcaacagtagcagcatgtagctgtcaatatatcttgctccgtatctcgtgttgcttctccaggagactggacgattatcgcgggtaggtgaagtagtatctagctagtctcgcgttaagaagaacgagctgaattcggtggcactcggctgtccgtctatcaggacgatcgagccggtcacatgttgaggcctaataaaagcggtgcgaagcactgtttactgccgggcggagcgcgtaaacgcccggcgatctcgcattcacacaccaacgagagccgtcgacgtcgagcggttgcagcggaattaaattcgcctgcccgaatgattggttgatcggagccgctgccactgcaggctaacgcgcacaattctgatggggcgtacttgcgcgggtgttggaacaatagatcgcgtggtggtactacttggtaaagagaacagctgtagttggtgtcctttagcatggtcgtgtagagcaacagtgcatctggcggcgccggcgacaatgatacggtgagattgcaggtaaggatggcaattattaccgattgaacatttaaggctccattcttttctacactgctggagcaagggtttttacccacggttcgtaaaacccttacagttccgattatataaccggactatgaattcggtagttccggtttaaataatcaagactaaagatgtatctttccggtcagtaacatcaaccgggactaaaaatggcccgaggatagtgccaggtcattggtccctattcgtctcttttttttcattgttatttgaatattgatttcacaccaatctcaccaaaatcataaattccaaatcgagttgctcctacataggggtgaaaacggtacggaaactttccggattccggacctattttcaaaaacggaatctgtcggtcagaatttttcagaaacagaaacgaattcgaaaatattttctcggaaacggaatcgaaaatgataagggcagtttccgttggaactcggaatcggtcggaaactttccagaaattttctcggaatttttggaaaatttctcggaatttctagaagttttgtgactgaaataccctggattctttttttaagcaataaatagtgaatactatggtgtttggctgctattttttaaaaaaatatttgttatggaaatctaaaattatataagaatatttttttcctgcattgggatttatcaacaacattactctcttaaacatagataatgtattccttaggttgtgttttgtgatgtactattgatacataacaattggacttatatgattgtgttttatgatgaattgttgaccattgagacttgaaaattggatttatcatttggaggggttttttattccgataaattttcgttaccgtatgcgcgccgattcgttttcgctccgttttcggtttcgataatattcgattccgttttcgtatccgggattttcgatccgattccgaaaataatatgaaaacaataaagatggtttctgtctgtttccgtactgttttctcccctactcctacatccccaaatcaaagtaacaacatcacaaatcataatattcacatcacaaattgtcaaaaaaatcacaaattctaaaaaaatacatcacagatcaaatataacacagatccaataaatcacaaattcttaaaaaaaagaaaaaaaaagaaaaaaaagtaagaaatctagccgccgtccgccgcctcctactgcgggctcccgccgctgcctcggctgccgcttctaccgtcgcctccccaggccggtggccgccaccgcccccgtccggttgccgccgaccgcgccccgctgccggcctcgctggccgctgctcgctggccccgccaccgtgcgtaggtcgccgccgcgccccgctcgctcctcgccggcgccgtttattcctagagaaagagaggataagactgtgatagagaggaggaggaataggaatataaggagaggataagagtgtgagagagagggggaggaataggagataaatttttttgaagattagtgcaagagattttttatttttaagtcccggttagtaacaccgaccgggattaaagatctacataaactttagtcccgggtggaaacaacaatcgggactaaagttatgatctttactccttaaagatctctggggacctgacagcctttgacacgaggtgaactggaactatctttagtcccggttggtgttatcaatcgggagtaaagatcacatagtcctcttgcacttataaacgggactaaaaatgcttttggacaatcgaccaaagatggtttctccagtagtgctattaggatataaattttatttagattttcgttaacgcatttttaaattgctaaacgatatattttgtatgggaactttctataaagtgatttaaaatatcatataaatttatttttatagtttaaaataattaaaactcaattaattatgtgctaattattttttagttttacgtatccgtatttaatcttcaatgaactcaaacagtcaaacgggaccttaaatagtgagtgtaaacatgttaagattaggcatgtcaaaacctataccgaataggtaaatggacatgaataatcatgctcgctttgcctctttgcccgccaaaactaaccggcatgtgaggtatactagacactactgtttttgtatgtactacagttagtgtctaattagtatgttacacaatgataatgtcgtttttatattaaaaccatgtttgttttacctaaagatgcattgtatttgctggttaattcctaagtagttttattaagagtaaaccgtactttggacaaggtttcttacataagttgcataatggattggatcttatcgtgtgctttcactttgggtcaggtttccttttttttttcctcattggaccaggttcatcttttggttgccaccagcccaccaagctggaggactacaattgtgtctctttccgacaacccaagacatatgtacttttctatggttttgcccatgaacatatccgtgaaacatgtagcacccgtggataatgggtatgagccaaatgattatggatatgtttagatccactgataaaatttttcaccctgtcatatcatatgtttcgatatatgtatggtgtattaaatataaacgaaaaaaaataactaattacacacattacgtgtaaattacgagacaaatcttttaaatctaattgttccatgatttgacaatgtggtgctacagtaaacatttgctaatgacggattaattaggcttaataaattcgtctcgcagtttataggcggattctctaatttgtttttgttattagactatatttaatactttaaatgtgtgtccgtatatcccatgtgacacggtaaaaattttcaccactaaaactaaacgcagcctatatttatttttctatcgtttttcccatgaccatatccgtaggacatatagcaccgtggataatgggtatgagcaaatgtttataaccgttctacatagtaggtggtatatccgtggacataaatttggctgtgtttagtttcttttaaagttgaaagtttaggttaaaattggtacaatgtgactgaaaagttatatatgtatgacagattgatgtgataaaaaaagttagaagtttgaattagatctaaacacagcctttatctcgttggtacaatgtagtactacaatggtacactgcatgtttctttcaaaaaagacagtacagagggagaaattcgagacggtttgggtgtttgactatttgggctggtccatcgctccgtccggcaaggtggccctgaacggtgggcccatcatgtgtcagcccactggcatcgacggcctgccagtgccggcctgccgggctgttcgctcccggcgcgtcgaaattccttgcgtgacgtgtcccccccttccggttttcttcaatctgtggtcacgccctctggaagccgagagcccgagaaggcggagaccccgggagcagaggggagagcagcgcagccgccatggaccgcgtgcagctcgtgctcctcggcctccccatcctcctcttctgctccgacctcgtcacgctcttcgggccggagcagctgcccaccccgcagcccgacctgccgccccaccccagccccgacgcggcctccgacgccgtccagcccgacgacatcgccgccgatgccgccgcttccgcgcagattgctgtaagtccgagcttcgctgctcgatccagtgccaattttgatcttcgatctagtttgaactagacgagtcatgtgcttttccctctctgttgactcttgtgttgtaggagccgcaggtggatgggcctgcctccggcaccaccgtcgagttgaagttctgcgcctcctgctcttataggtaaaaccatgtactactcatggcttctgtcatctgtggagttgttagctggtttggtagaatcgatagtgtcgaataatggccagtgaatcacagatcaaacccgacaggtttcgtcagatttccttgtagccctagatcgcaggggttcagaactatgtatcaatagttaagaccgcgttgaccatactgatatctagagtacaagtttctattgtacggccggcctatagcttttctgttactgtaaggccccaaaatgagatccattctgaatttagatttgagttcagtgtgcaacacacgagcacctaacttatctgagctgataccatgagctcaaactccaagtgtcatcatgatgggaatggctggttgactgtaattataacacctaagtaacctgtgcagaagccagaaataggtggagtcataccttgttctagtaccgtacttcctaatactggtcgtcttctagttcttttaagaccataataaggactgatggtagttgtcttctaacattttcatatatgatctgcttcctgtgaagcatcgctgaaacttcttactgtttgccaatggtattgcacaatgggaaaaaaaagcacacacattttatttttcaaaataatatcgtattcttctgttttcatcttcttaattcaaagatacaccagcattttctgtattcactaaccaacagtcctttaatttattttttgacacaaggcttgcgccatgagttgagtttgagtgccttcatatgtttttggttatttttttgaagtgaatagcttgtgatgagaagaataccacttacatagttccactaactacttctctcttttatgcatttctagtgtctgttgggtaagaatgcagattctcagtccattcatttatattcttttagtttgtgaatgagcatgttttgctccaaacatcttggttcatcctctcaggaatgctctaactcttctctctgacctagttcacacccacttatgctcgtgggttattatagagtctggaatgctatatttctgtggacttcgctgtgttttttgctccttttttatgcccatggcatgctaggagagatgaactgagagaaagaagagttcatgctgaacatatctttgtttgactttaaatgaataaacttgtgttgatgtgatgaccatttatttcaacatgtaatggagcagaaccttctttcacatgctctagtgaaaatgccttttgttttctcttctatgaattggtttgtgagttagacagataactttaagtcgaattctgcaggggaaatgcagtcaccgtgaagaagatgctggaaacctcatttcctggtattcatgtcgttttagaaaattaccctccaccattcccaaaacgcgcactcagcaaagctgtaccttttcttcaagttggagcaatggcaactttaatggccggtgatcagattttccctaggtttggaatggttccacctccatggtactactcgctccgtgctaatagatttggaacaatggcaacaatctggctgtttggcaatttcgcccagtcatttctacaaagttctggtgcctttgaagtttactgcaatggacaattggtatgtttgttatgcatacatccttttttttgctgcagtggttcagtagtacttttgcttgtgttatgtaatgttagaatcccccccccccccaaaaaaaaaaaacagccataagatcttttttatgcaaaccagtacagcaactgttgtttactatggttataacccatggttgtttagtgccaaaatttctagttattatggtttgcttcaatgggattttctttatttatataatctctctcgaaagaaactggcattttggagccctcagtcatagctgaactgcaatgatgctagactctgtagctgaatctttgactcaaaatgatctgttgtgtggcacaatatcagttagtggtgaaaccttgaagccagagtaaagttgctgtagaagagagctatatcttgcatttatatgtgcaagttgactgtccatttatctgtctattggagttctaatcccaagaccccctagttgccatcaatttttttcagacccttgcattgctgtgtgtagtgatacacttgaatgattagattgggttcatactaaattagtaataatcagtagactagctgtttcaaaacaaagagtagcttgcatgtttcctaaaactggtttgcaattgtacttattccctttaattaaatgaactgtgcaatctttgtcctgatcacttaataatgttcaccaggcgctaggtgctagttgggtggtagaccagctcctagcaactaattggcaatttggtgggctaggtggctggcttttagaacacagttactaaactttgtttagtgtgtttgaggtgttctgtttttttttttgcaagattaatttcttacgcaatccatctgttaacttttgctttgtgtgtatgaagttctcctggtttttcttttgcgaagcttaattcattatgcgctccatgtctccatttgtacccgatacactaactcaattcaatttctttcttcaggttttctcaaaattatccgaacagagatttcccagcgagtttgagctacgggagctcattggcaacaggttaccagattctcaattcgggaaaaatctggaaaaggtttggtcatagatgttgatgtcaagagagcccacttcatttacctgctatttaattgatagaaccgcttgaaagtttacgcctaattgtcaatcacatgctatttgtcttcttcttttgtgaaggcaggtacttttctttttgttgtaaataatgttttaccctcgcaaagaaagtgaaggagttctgtggctatgttagtttgttagaactgtcatatttactcaaagaggatgtgaaccataacgccccttctcgagtattcctaataattatcagaaataattactctgactttggattggaagtgcattttttccggatatgttctgttgccctggttaaagcgtcatttgctgtcgcaaactactagatgatgccctgtgctttctgcgggatatatgatagatattggagaaatgatgaaatgatttggtttgaaatattataaaaatgatttgagaatgatgattgagcattgtactcctatatgtttagttttaaaatgaaattaattgaaggtataattactatgcttgcatgttgaactttgtgtgcttaatgggttgatgtgatatgtttgtatgtaggttttaggagtgctaataaatactatgcttgcatgcttgagttttaggtgtttagtggacattttctttatagaaagaagagattcatttgaaactctatgactgaattgcaatgattcagctatagctagctcttttttttttttgaaagtacaaacaaataaagattcagacatatggtggtgttattaatctcaatcctattggaaatgatattgatcctgatatttgcaacaaaaaaaaaactgattctaagatagtcctcgtggcctctcctcgaattcatcagattcctgattctaagatgagccccttgatcgccggagagcgacctcggcagcgtcggtcagatcccctccccgcctgcgggcgtagaaaggtatgggtccgttgccggcgtccgggaggagtaccagggatcaaactctggccagtggcctgctcctgggctcctggcgctccctctcagctgcaggcgtttcatcattctcagcaaccgagatgagatgaggttatctcatggtctagtggcacttgcagatgtttacagaagtaccagagttcaggccatcatatgagttctcaaaaaaaaagggggccatcatatgcagttaaactattctctccatttcgtattacatgatgttttgatttttttaaaaaaataattctttttaagtttgaccattcgtaggaaaacgtgccaatattttttaacacaaaacaaacatactatagatctaatgttagacttaataaaattaattgtattgtagatgttacaaaattttcgtataaacttgattaaacttaaagatgttttacttagaaaaaaaaatcaaaatgtattatagtatgaaacggaggaaattaaaggcaagcaggctggctgtcgttccccgtggatgatgcaggacagtaatcttggggcttgtttggttctttgctatgtactccctccgtccaataaaaagacaaactctggtttccgtgcccaacgtttgaccgtccgtcttatttgaaaaaattatgaaaaaaattaaaaagacaagtcacgcataaaatattaatcatgttttatcatctaacaacaatgaaaatacgaattataaaacaatttcatataagatggacaattaaagttggacacggaaattcagggtttgccttttttttaaaggacggagggagtgtaaccttgccaaaaaaattttggcaaaaactggctaggtttttgtttagtttgctaccaaagttgtatttaggtatttaactaagccaaataatttggcaatggcaatttgacattttctttggtttggctgagttagagcaagttttatgaaagggatagctgccaccttcaattttatctttatcatctctatataaattaagaagtagtctgtacagtatgttatctctaaacataaatctcaataaatatatttattgaagtttgtattggggttgtatcttacacgagggatggcttaattctttctttcatctcttctctcttccacaacagtaaataaatctacatggtatgtagagataaagtgcttacaaacttatagtatttgctcttagaccgtaaaccaaacaaacccaagaagcctgataaaaaaagccagtgcacaactagcaacagcaattcaggtcggtaatggttgcaagtaaagcgttgcattgaagacgaagttgcaatggttggtcttcaaagatgtactataagtactgtcacagtgcgtacaaacctttcagagctactgctagtaagttgtggcattaattaagccacatttaatcatcgaactgcaacatgttagttcgcaggaagtggtcagcgacagctttgtatgtggcttgcgtcggatggacagagtcccagaacatgaactgggccggcgtcgtgcaggtcggcatcagatcggtgcacaggggccccatctccagcagcccagtgccgcagcaccccttgccagtttcggcgaaacctgggttaacagaagttccgaaagcaacatcaaatgctgtcaattctgtaaaaaacaacgccgaaatttttcgatcggtttcggcttcagattttcagaagttagctctttactcaccatacttctggggatgatcgaccatgtccgtgagaggggtgtagatgtcagcgtacacggctttcgctccgggcgaagttgactggaacttggtgagcattttgcggagcttggcgttgtacttctccgcctccgcgttctgctccgcgatgcagccctgtggcctcggcggctgcctcagcgccgccagcgtcatctgcaccgggaggcatccgaccggcggcaatccggcgaccaggagtctccgggcgcccaggttgtacaggctctgcacattgtttgaccatatggttaaatcttggaaaggtcaaattcaggttttacagcgaggttgggggactcgacacgtttgaaggttgcaatggtgcagcatgcatgggcagatccactgtgttgatggataggattcgatcttgcttgttgaaacttgaaacagagtgcctaactaccctaactgcaattgcttcttgccattgtttgcagagcaagagagatcaaggactacatttgcacctgatctcgtgccagaaatgcaagtgcaatcagtatccttactttccaggaacaaagcacactacgcacaagtgcaatcacagttagttataaactgcgcgagaacttctcacgaaaatggcattagcacaaaagtgcaatcacagttagttataaactgagaacttctcacgaaaatggcattacggtgacgtcgatatagatactaatttaactaatctccgaatctcaaaggtttcgcatgcaacttgcagcattgtagctgtcactagaaatggaccgagttaacctgaagaaacgaatggaattcgcgaagaaattaacctgaatgtacgatcggagcttgccgatgaggagggcgtgatactggtccagcgtgtnnnnnnnnnnnnnnnnnnnnnnnnnnatgatcatgtcgttcgtcccggccgacacgaggaacagcgacttgttcaccacctcaccggccttgccggcgcccatcctcccgacgagctcgctaaagtccgcgatctgcgaggccatcgtcgcgacgccggcgttcgtcgccgtcctgtcgtcgagtcccgagccgccggacgcgaagctgacccccgtggcggcgtcggcgtcgctgaggacttcggagccggagtggtacgccggcaggaggcccttgacgccgagcgcctccacgaggaagtcgctcatgatcttgccgtcgcagaacctccccgtcggcgcgccgccggggaagtcctggccgtagggcgggtggtcggcgcgcaccgcggtgacaaggcggttgttgttgcccgcgtcgagcgtggagtccccgaagacgaagacggccggtatgcgtcgcgcgctcccaccccgtgacacggcggcatcggccgcgtcgacggcgacgacgacgatgccgtggatggcggccagggagaatagtagggcggcgagcgttggcttgagcgccatgtgggcaacgtacgcatgcacgttccagctaagatggtgtacacgcacagtgcagttggtcgctcgtgtttatatatgctagtagcatcaactgctatcagcattggccgcttgtatttacgagcagcctgtcaactaactctttgtcattcttgcattgttcatcagccccagtcagataatggcacaagaggggatgtgattggttttaaatgaccatgcatccatttaagcatgcatagaattcaggaaaagagataatctaatcagtaccattgagttttatttggttactagggtttgaaaaaaaaaagagataatccattccataacattgacaaaggatgaattctacaatataccaccgacaaaactgagttttataatatagcgttgaacaactagttttcttacttacataccattgccgctagtcaacggttagtttaattccgttaagagaaagaaaatgtccattttacctctagggtaccgtgcgtacgatcatggatttcattggtcacgatccactaattcttctcattgatgaaaaatagaaatcacttgtctttctatcatccaagattatttaattaggcatggcattgtgcaaaatctcaattttatcctaggggtaaaattgccatctttctcctttaatggtgtatgactaacggttgactaacgctgatggcatataaggaagaaaataagttgttccaaggtatattgtaaaaccgagctttgttagtgatatattgtagaacccgagctttgttgatggcatagaatggattgaataaaaaaatgatgaagagcatgcctatttggttccctcattttgtagtgttggataaaacacatactaacatactaactctagaaacaaggtagcaaaagacgcataaaggctcctatatactttctccgtcccataaaaaatcatctctatattaaagttcaggattggagggagttggaagtaaccagatgtgatctatcctgactccctgagtatgacaacgtttgttaaactgtgatcaggtataaatgggtgaaaagcgatcttaaaatcttaatagactcattacaccggtaatcatctataaatgggtcaaccagcctagcaaaaacccaactactgtatactacaactgtatgaaaacagtgttcattaaaccggtgatcagctataaatgggcacatggtcttctttaccgcttccattatttccgtcagcaaaaaagaaaaacaatagtttgccactactgaggttgctcataattctccttaattcaaacatgattagcgcttaattctcataaaaaattggtaactactcatgcgtcataaattttgtctcataacaaaaaacaaaaatatgaccctttcggagctatttttttcgtgtcatcatgcccgtttagaatgtaaaagttttcctggtttttatatacgaaatgaaattgttcacatgaaattcctcctatgtttcaaatagacactagattctttcttaaaaatattttttttccaaaatacccacactcagaaatagaaaatttgaggatttgccactgtcaatcatgcgtgagtcttggactctcttccctgtcaaacacatgtgattgacaaatcctaaattacgagtggcaaaatcctcgttttatccatccgtttgtccattactgcggtggtcgaagtcgttagttggaggttggaacttgtgggagtttgggagcttcagagttcagaaatcggtatggtcagtctcatcagtgcccatctcctctcgctaccctcatccgcgccgcgctctcgcccgcaatcgaggccgcccctctcgccgcccgccgccgccgccgccgcctcctgctccttcgacctgccccggccccgccgcctcgtcgccgacgggagccggaggaaggggacgatggctgcggcgatcccgcccgaggcaagcggcctggcccacgacctcgggtccgcggccgtcaccgcaggcgtcgccctcgccctcctccgcttcttcgaggagctcgccaagcgcggggtcttcgagcaggtcagccaccgccgcctcttcgcttcgccctttcccccgttggcgcgtcactggaggcttctagtagctaaatatctccaactaagatgcatgctcccttagtagccattactatttgaatttcgatgcaacagtaaggaggtcgctactgaattacacgctcactgactcatactactgagattcccatgggtgggtgacgagacagacacgcagatttggattcgtttctcgtatttttgccaaggttgcatgtacgaacaattatatttgtgtgatcatcttcacggtgctctgcgcttctcccaagcagtacaacttgtttgttaaaatattcagcgcaattagtcccagcctccaagctgtacaggagtcccatactgctaagtattaattgtgctcatctgaggtgtctgtttagtagttttactttgagataggatttttaggtggggattagtgataaatgggtaagcatttccatattcttccgaaatagaccctttcagtacaagtctagttagtgcctgttagattcaagaaagatataatggaaaaggtccatggagatgcatgtgaaatatgtcaatttgatggtctaccgttatgttctaagaattccaagttaagaacgaggagcgagggttgcgaagcaaatcctgatatttttgttcaagatattaaagcatatatttagtgcgagaagtaggcttatgagtcttgtatttcattccggtctctgtcccgtgctgttctttctttgattctaaataacttttatttctcttaatggaaaaaatgcgcccctgggtattcccgaattttatgcagtttttattcaaaagtataatgttaccttttctagtttctgttaacaagattgatctttctatcccatttccaacactcgtttagaaaaaaaaaatcaagcatgatatttaagccataaaacccctcagtgtctcactctgcacattgcaactcttaaagttttactttgcagcgcattcatgtgagataatccaccaactgttgttaaatatatttcagaaatagtgaaaaatgaagtataagttcccaccaacaaaaactcagattcacaaaatcttggggtaaatgcacagcacagccttcttaccagtaatttcagatggatgtctgatggctggcattagctcattgacaccagatgaaattcagctaggttctcaacataacatagacatataaactgaaccatgcaattagctgacaaattaacagtagtttttcttattgagatttgcttcaatacgatgatgctttctattgataaattccatttgtttgcctgcagaaactcaatagaaaacttgtgcatataactatcggtatggtattcttgctcttttggcctcttttcaggtaagaaaatctaattttctctggtcaacataaatcaccatattggtactcacatattgatgctttatacagctcaggaagctatgctcctttcctggctgcagtagcaccagggattaatattataaggatgcttctgctggggttaggagtaatgaaaaatgaagctatggtaaaatcaatgagccgatctggagacccgaggttgtatactcgcatacaccaacctttggcgattacataattaataagcttgtttctgctcatatttgccttttattctttgcatttttcactctgattttcctttttcctattctatgccttctttttggcacagatttgcttattctttgtttctgttgaatatctatagttgctgctgctgctgcttcaggtcatgatcctttagacttcattttctcatgaacacagggaacttctcaagggtccactg

SEQ ID NO: 12670 - DNA, 3198 bp, Oryza sativa
tccccccccccccccccccccactacactttcaggaatagcagacatagtggggagacgtcttggccaagaaaagcttccatacaaccccaacaagtcatatgcaggcagcatagcaatggcactagctggtttcatggcttcaattgggtaattatttgagaggcttttactgaagttttctgttgcatatgtgtttttaagtcattcattcgcatattgttcaggtatatgcattacttccagtcattcggtttcattgaagaaagctggtccttggcttttggcttccttgttgtttctgtaactgcagcacttgtagagtcccatcccatcagcacacatttggatgacaacttgactgttcctttaacatcattcctagttggtagccttgttttctgatgtttacctttgaaggaaaattactgggagatcttctgacatgtaaggaatatttcaataaggaactttggttccaatggtatgaacaaaattgcccactggtacttttaccaactagcattatgtacttccttgtgaaaaagaaaacattatatactttgtacagatttagctagatatttgaagtatgtcaaaaaaacaacctgctttttatttcttccatttgctccctaggttgatgtgcgaataagcattctaaaatgatccccattgaattactggcttatcccaaacgcttaagtgatgcactggatctgttcaactagcatcgattttcagtatccaggacggtaggttcatgtccctccttgtaaggctttttttctattgcaggttatgaaacagtgtaactttacggttcccttattccgataacctatagaagtttctctcaagttggtaagttgataattcggctatgctacagcggaggtagacaagcctcccagcatttcagtaatcctggcaagcattgagcatacctaatcgattactctgaactccttgttgggattcaccttcatatttgtgttggatcctgcaagcaaatcattaaccctaaaccatctagcctatatttatgcttcggccttcgccacagcatgcattcgtgtgcactatacaactcgcatgatccaagttgtggttacaaatatgacaggatgacatgactgtgacttagaatgtcccgttgagatccaatccccagctgttaccccatcacagtcaaccttacacggtcactttacgataaaagagatggttctccatttcgaggacctttggagggggaatatactgaagagcgatcccatgggaccaatctccagtattcagatgcaaactgtacctccgttgtacagatcatttttcagataagaaaagcaggatgccatggaaatttatatctgaatagcatggttttcttagctacagcgtacatgacatgattcagccacatgattaatcaaacaattgcctgcttttatttttgctagggaaaaaaatgcctacattgacctatgtatacaagagagttcttatcaatggtgacggtctctctttttttttttatctttatttcgtagtggaattggattctcgaaactatgtcttatgtcttaaatatgtagttttgtgatactttatattaatgtgtactccatccatctctaaaacaataaccttttagctatggccactgtccaagttcatagctgaaaatacacttttttagagacgaaacaggtagtttcgtaataaatttggtgttaaatttatagttatgttatacactgtcttgaatttataaatttacaatagtttaatcaaatggtttttctgtttcacttgcgatagctttttttggctcctatctttcattttttcatccacaggatcttgcatcaagatttgttacactcacaccgaaaaatttatagttacatgtttgtttttttatttgtttatttcatttaatacgggccctattcattggttaaaaattctataatatttgaagctataaatctgacgaaagattaataggttagtcccatcatttgaatgtacctttgtaaaatgtacatactcaataccgaagactaattttgatgcatctaaacaacttggaattggacacagtaccgataaatagatgaatttcccaactaaagctggcgactttactgttatgtatcttaaatcgaagcccctaacacattccaaaattggagattctcagctgaaaggctatctagcgggcatccgcatggctgcccccacaagcatacatgctggagtggaccactcacatgtactgtcagcatatcctacgttctctcctgtatcctcccgtgcatcggacctcggttgacaagcagttcgtttgcacaaaaaatcgcaaagaagtttaagaaatcaatgaaagacttaacaagaggttaaggaagaacaaactgtatgtatccctccatagtctaaccatgggccagagttgccctggttgacccggaaaccggctacggctccccacatttcgtccccacctcgcatcggttcaagcgcgcgtcatcacgactcgcgagagctcgtctcaaaccaataattaaactcacaaatcgccatctcggcgcggctattaaacgcccatcacaacgtagctagccggccacttcgcgttccatcgctcgctcgctctctcgctttgcttcgagctgagaatgcacctaaggatggcgtcgccgccgcagcccgggccgtacatgccggacctgccggcggtgccggcgtggctgaacaagggcgacaccgcgtggcagctggtggcggcgacgttcgtcggcatccagtcgatgcctgggctggtggtgatctacggcagcatcgtgaagaagaagtgggccgtcaactccgccttcatggcgctgtacgcctacgcgtccacgcttatcgtgtgggtgctcgtcggcttccgcatggcgttcggcgaccggctgctcccgttctgggccaaggccgggccggcgctgacgcaggacttcctggtgcaacgcgcggtgttcccggcgacggcgcactacggcagcgacggcacgctcgagacgccgcgcaccgagccgttctacgcggaggcggcgctggtgctgttcgagttcgagttcgcggccatcacgctggtgctgctcgccgggtcgctcctggggcggatgaacatcaaggcgtggatggcgtt

SEQ ID NO: 12671 - DNA, 2555 bp, Oryza sativa
acctcacgccggcgtggcgcttcttggccgaaacaccaggactcatcataccctatgatctcgtcactcactagctaagctgcatgtgcaaactgtgcgtgcgttgcaagctcaaaagagacttccggtttctctcgtgggctcgcgcgctgcaagcatataaagcaacggagatggcatcattgccatttgccatggcaagcgtgcacaagtgcgtggtccacgtcgccgccgccaccgccgacttctcctcccactgcctcaccgccgccgccgcggtgagttcttcctcgtcgtttcgctgctccctccgcggccactccgccgcggtcttccgcctgtaaaattaaaggtgtttttggttattattctgtgacgaacaattggacattggagattattggttttgttatttggaatttattcacgaagtggttttggagatgattggatttacaggtgaatcgcaggatcgttatttcatgtgaccggtcagaccgggcagtgtgtgccggtcagactggtgtgtaatgcgcggtcagactggcgcagcccgcggtctgactggccgacactgtgtcggtttcggtttcgggttgtttatttggatatccgagtttatttcatgattatggcttctagatggatactatacgtatgtaatactattgtttgctgctaatgagtcaagttggagatagcttggtatcggaatatggtttctttgtttgtttcatgtgtaggtgactcgatgtcttgggagagtatttgcggtgatggaccgggagtcggcttggggataagacgacgtccgtgatggtcagagatcatgcgggatacttaggctagagttgatgcacgtggttgatggagattttatatggcatacgatggaggtgttgtgtgcgtatgggatgcggagtcgaatttggaaggagtccaaatttggtacgattggttatgtaaagtttctttcttgtactagagggtttcctaaggtgtttaggactcttagtatgagtttggttcgtggctttaggctgcctacctcatgtataaatagagggggagcgtgaggcttcccggtatcgctttagagagcaattgagttgagtttagagttagggtttcgagtttagtcgaaatttttgtaaggagtgctgttggtgcactttgtaaacacagagagaatcaataaagtcgtcatctactttaagagttcttcaatttgtgtttcaccgggtttcggcggtctaaccggcgatctaccggcggtcagaccggcggcaagcggcggtcagaccggcgggtgcacggcggtcagaccggaggtgacgacaggcgcggcaagcagcttcagcggtcagaccggttgatctataccggtcagaccgacgacatccgagcggtcagactggcaaggcaacttcggtcagaccgatctccgtcgattttgagggtaacttttatttccgctaaaagttttcggtttttgggtataccaaccattcaccccccctctggttggcttagttcttgtgattcggggatcctacaccgtcgcccgctccgcgcgcgaccaggcgcacgtcaccgcccgcctcgccgtcctcggccactgccaccacgccgccatcgcgcgcctcctcggcgtctccgcgtcgcccaacggctcgctcttcctcgcctacgagctcctcctcgacgcgtcgccgctcttcgcgctccaccgcaacccgaacaacccgtccttcaccctgctcgcgtcgtggcagtctcgcctcaaggttgccgccgacgtcaccgacgtgctccactacgtccacctccaggccgacaccgtccacctccacaaccgcctccggtgcgtggccaaggacgcggcagcgcgcgccggagatgtcgtgggtcgccgacaagttccacatccccaccaacaactccatctccatctccatcgctccatcaatttgggtttccgccaccttgggcagagtgaagaggacggggcgagcacggcggcctcagcccaaagcgaagagggcgggggagaccggaggccgccgccgccgccgccgcctttctcccctgctcccgccgccgctgccgccttgctcccttgcccagagagccacagagacaagagtgagtgagagagagaggaggaagggagagaagagggggagagggatgaggctgacgtggccagctgacatgtggggcccatgtgggtcccatgctgactcagccgccacgtcagacaaaaccgggttgaaaaccacctagggacctcggatgaccggttttgtatagttgagggaccccgcatatctggttttgtggtcggaggacgttttttatctcgatgacaagttggggaccttcggtgcactttttcctacagcgagcagcagtagctggccttgggccatatagccgcaagcaacagcagcaagcagtgtttagcagcagcagcaagctaaccggcaagcaagaggagccaatattaagggcttgttcactttgctaccattttcaaccttattaagttttgg

SEQ ID NO: 12672 - DNA, 1043 bp, Oryza sativa
tagggtgccagtgtggtaataatcttctctaaatgaattattgtcagttagagttggaaacttatctggtagtctctgattgctggtgtgtccagaaccgaaatccacagagtcttgtttctgtgtcacaagaatggaccaactgaacctgccggttctaaattttgcgatggactccagatatctgatgcttgtctaatctaaaatgagttagtaattatctgctagttggaggccaatgacaggacccatattcctacttttgttagggtgcagaaataacaaggacattctttcgaaaacaactcaatatgttgtagcactaaagaaagtccaacaatctagttggtctgccaagtttggtggtcgtccctctttccataacttctgataagtgtctttcttttttagaggaacttttgtatacatgtcaattagtagcatatatttatcatcatctttttgggatgtgcagttatgttactacaacatgtcattgctaccatcagacttatgttcaatttttatttgacaaactgccatttctatctcgaagttaaacttttccttttcccccttgtgaacctttgaaaagggcagggagttcctgcaattcacctcgaagttaaactgagcatatggtgtttgtttcagtcataatacttttgcttatttcttttcagattgtcgaccacactacgcacgatttcaagaaagacgacggggtaacttttgtgattgaggactgagacacatttcacaacctaaggctgggtaatgaatatgctagactgtttgcatgtcttgtctgtttcctgagtttttaatgaacaatcgatatgcaaatgtgatgtacaatatgcacatatgagctgcttgttcaagtcattgtaaaaaacaaattaagaaaaaagaggcaaggggagtctctagtgggtacacccaaaagggcaaaaagccgtccagtatgaaatgatgttgctcttttctgaaaacaatatgaatgatttgagtcaataagtgatgtatttccagagagagaa

SEQ ID NO: 12673 - DNA, 1903 bp, Oryza sativa
tttaaaaggacacaagttgctcaaatcgaattgttgacgactaatgtatttggatttcggagttttgaaacacatgctataatgaacttaaccattgtagtagtactatagtactagtacttctttatgttcaacatggtacttagaaattcttacttcttactagggtgcaatttaggtctgtttagaacggggaaaaataactttctcctgcaaaaactgaactggctgtggcaaattaatgtgaatccttgattttttaagattgttttttaatcttttaaaatttaaaaataaagccctaaaagcttatgaaatttgaacatttttccacgcaacttaaactagtgtgcaatgacaatattgtcacaccagtaaaaagtgatggcatgacaaaaattttaacgtggcagataatgttatcacaccaacggctcatggtgtggtaatattgtcttgccatgccattctaacttgtcatttagtaagttttggatgtatcttccttttttttctactcatagaataggcaaatcaatgggctgatatgcatctctgactactgatggcgtgataatattgttctgccacaccattataacttgtcatttcaataagttttggatgaaccctccttttttctatgatcagaatatataaagagtgggattcatggcatgacaatattgcccggtcacaccaatctaacttgacaataacttcttgtttcggcaagttttggatgaacctttccttgtctctgcgagcgaaatagataaccaaggagctaatatgtgtctttaccaatagttcatgacgtgataatattatctgccacaccaatttaagtcgccttaccttctctctctcttttttctctacaagcggaatagggcaaaccgaggagctaatatacataaccatttttgttttttttttccacgggcagaataggataaccgagggctggtatgcatgttttgccccctaatataacatgtacgccgtgttaaggtctgtggcccttggggagctagggatgtgcctcccttttggggttttttggctccagaaggagggaaaaagcgcgaggagccgtgggtcctctcccggtgggcctctcgctgtaacctgcagaccgaggcagggcagagagcaaagccaactgatgtggagacccctcccggacgccacatggcggggccgccccccatcctcggagccgctgcccgtgttgcttgcaccgctctcctcgcctcgctgccgtcgcttcccgcgccgtgccggtgctccgatctcatccaccaccacaacggcatcacccctcctgctcgcgtccaccgtggtcgggcggatggcgcgaaaattattaaccggctcggtgtccaccccaccccattcaccgctcgccagtgaaggctggacccgggagcccgtccgagcccacatctgccgcccgttgcaccgaaccaccaacccaccccacccaacccaacccggggcgcgtcgcctcgccaccttttccgcgatttgctcgcggtggccatcgagaaatcgcgtgccaccccgcgcgcgcgcggaaccgcggggtgggctgatgcatgcatggcgtgagcgccccgcgcgacgggtttggactttggactgtgacgcggccgatggcgagtgggacggggaatcgccaggtcggtactcggtaggtaggtgagccgggtgcagcattggtttctgctgccaccgcgcgcacctagcccaggccgtggggatgtccccgtcccctttgtcttcaaggccgtgactgccggctccggttgcctggttggtaggagtaaacgagcactccgtaccgtgcactactgcgctgcatgtatgcttcctgctggttttatatacaagttgctcc

SEQ ID NO: 12674 - DNA, 1890 bp, Oryza sativa
cacgaattagcacttaaccctagctttgttttcctctacaaatagctttgtacatcctaaaaaataattgggttttgtttagttgaattttgccaagtgccattcaccttgtctctagtcctcgctcgattagtcggcaactattgattcagagcccccaatagttggtgtgttgatttgccgggtcgattagatctaccacttcaatcgcaactattcctttgtgcttaattacctattcgcaatatttagattgcatcttatcttgttcttgcagtgttctctcatttgcattgcagggatcatcaaccactcgtcacggttggtacgacatcgtttgtggtgtagcgattgcatggcgtcctggacttgttctggttggtagccacgtcgcaaacgtcgcactcgatcaaagcgagagttatctcctcaccagaagatcgggccacgagagagagcgtcatcagttggtatcagagcttcagttgcctggtgaggattttagttttgtaattttttcccatcattcactatacagccgcaccactttttcctttaccaaacattagttttgagccttgcaattttcattcaattttgctttattgagttttggtccactgtcgtgcgagaaggctaatctctttatgcgaatcaaataacaaaagtaaaaacaaagtatattgcaactcaatttactgatgaatgattaagatatcaaagttggtattttacaattaaactgaactataggagaaactgcaatggcagaagtaatctaagctaaacccaacactaaattaacgatgactactgaatatataggttttagggtcgacattagacccctggacgcgtccctattgaactctgacacaatacacggctcaacgggcccaaagccagtgacgcaacatctagacagaatttgaacgccttcttgtttcaactattcctgtcaacttggaaggaattttgacgtggaccagatccattggaaatgtggttccgttagctttacatacgtatgtagaacgttgaaatcgaagtccaaatgcaatctgaccgatgattttagtgtgggctactcatagagtccaaggtgaactcgaaattgatatatgaattgggcctacattttggcttgaaggctcatgacaatcttgttcatctccttgcctcttttcaagtgctctatggttctttccatagtttctaatcataattaaattattaggtagcaatatatcctcaaaatcatataaagaaatacttagaaacaaactcacttgtaaatttaattgccggacgcgaactctagtgattggatcttgcatagtaatttgagtattatgtgtgtgcaaagaagagcgatatgttctcatcaaaattgctagcttaaatatatgtaaagactagaaaaaatatccgtgcgttgcaatgggtgaagtctattttaatcttactattgttatatggtttagttatgatgaaattcactatgggagttcgattagatatatatatttttagaaaatcatgggctacagttaggagtccgatcgtctcaagttagcatgcgagtttttttaaacagatttcttatatgattcattctgtattaccaaaactgaacgatcttaaaagccgactcaaatacagatatatatttccaaaagcaaacgaacttaaaaacagactcatacacggataacgtactaaaataccggcaaaacatcttcaattttataatagtagagtagtggattcagtgtttacttagtactgtaccaattaaactagtacacttagcatagagttgaccatgaacagaatcaatctatatatcttagcgtattagtgtatgttgcagtgtagctaacaaacagg

SEQ ID NO: 12675 - DNA, 3419 bp, Oryza sativa
gtacacacactcatgcatgtgttattccgattcagatcatacatgggataattaatgctgactgctagctagctagcttgctagttcgatccatggattagcatgccgtcgctgttggatcgatcggtgtagcttaattagttaattaattactaattatttattattcgttgttttgggtgattgactggcccttgagagcctcaagctgtgccttgcccttggggccattcttcctgacgtacaccctgtactcgtcgaaggtcatcggacggtagtagagcgacggccgctccggcgtcaccagctccggcgccggcgccaccgggacgtcgcctctcgggttgtagaagagtgcgagcgagatgcgctcctcctcggcgttcacgatcacgcggtgctccacgctcttgtacatcgagttgctcaagatctgtacgtcgtccgtccatgaattccatccatgcacagtacaagaagatattagttcctgagaaattaaaatagaagaacagcttgaaacattattgatgcaactagctagctagctagagtactatagcaacgcaagctgtatatatgtgtgtattttgtacgtagctagctagctagccagatacatacgaccatattcatgcttatgctcatatatcaatgcacatgcatcatggaatattgatatatactcgtatatggattcgttggccatgcattgagtgcagttgggtacttgggcggttcgtggtatgattcgccgtaacatgcacatgtctgtccgaggtagagagtagtaagcttcaaaccgacgcacagaaaactcgtatgcatttatggagctagcgatcgatcacaatccgcgcattttctgcatggttggggctcatcaccgtccatgcatgtgtgctctcatgccgcgtaacctgcgcgaaagatcgccgcatagatcgatcgagctagccggccgccactagctagtcaactctaatttattcctgatcatcatttgactcgaacttaactaattaatcatgagtaattcttaatcccaggtcatggaaaagccacgatagtgattattgctctttgattaattaattatataagtcctacatatatgtgtacctcaatctggtcgccgacgttgacgatgaaggcgtcggggaggggctgcacggtgacccagtggccgtcacggcggcgtacctggaggccgcgaacgtggtcgtcggcgaggaggacggtgaggatgccgggatcggagtgggcggagaggcccagcgtgaggtccggctgcgggcaccgcgggtagtagttggcgcgcaggcccgcgccgcagtccgccccaccgaacgcctcctggaaccgcgtctcgtccagccccaggctcgctgacagcaacctcatcagccgctcgcacagcttgatcacctctctcccgtactcctcggacacctccctgcacgcagtaataattagttgattaataagctgcttaggttaatttcagttggcatacttataatgcgctaaacctaatatggcacgtactacgtactcagtagacacgactaccaatataatataatcttttagtttgtccataaatataaaagttttatcatcctaagacatatatagctacttagtttatttttcccctatgaacttttgcactagtttatttattcatatcacattttatactatagtttgttctttcgttactcgtttatgtgttttttctttaaaaaaatattatccattatatttatgaacggaggtagtaagttgagaagataataaaaaaatatgaggcaacatctacataatggttgtgcgacggttctatattgtggttgtacaaccatagcagctgcagctgccatcaatatagatcttctttatatttttactgtatcagtgggctgcaaattagcgatattgaacatatccataaactacaaggaagaaagaaaaggtggtagtggatatgttgagaagaaatgtataaaataataattgtgattgtgaacgtttagctgataatatatgttgtggagaaaataaaagaaagtcgtcaccctattaattgaactatctctaaaccacacaaaatggaaagtgactatagtactagaaattttacagtgcccgccctagtaagctgggaaattttgttttagcggtgaagtgagactgggccggtcaagagtgaggactaggacattttacatatgtacagtggatgcattcttgtgtcttgcatgctttggactagtatgcatcacactcttgctagctggatggaacttttgcatgaaagcacccttcacctacttttcgttgcatgcacgtgttggatttcatgaactgagaaattaaggtgagtcagatgaacgtacccctgtcccttttctacaacaattttcatgctgctaataagttttagatcggcctactctacctatatgtatgtattacgtctacccatgccaaacacagtcaagacacacctatataaatagcaagtactgcatcttctactacagtgcaagtagagaaaaaggtacaacaatcatagaacgaaaaggaaatcaacggatgctccaggcagttaagttactctgttcatgacaatcagtacactgttctcaggtaaaagctgaccgaatggatgttgatttatgtatgcagtacgatagtaaattaaatatgtactgtaccgttagttttttagcgtgtgaactgttcaattttgtcatatttttaattaatgaatgccatgcttctaattaattttggcgtgtggagtagtacttattattagtacatcactaatcaaagatgccattattaatgttctaatagataaataaatgaataatatctaaaccctaatgaaactaaaggtatgtttggtttgtcgaaaaaaaagtgacggaattttggccaaacaagctcctatatatatatatatatatatcatcacgaccacaccggtataaaaagttgatagggttgatctggtaagatttattagcaaaaaataaatgtgccctaaattttgttagaatcagtgtataatgaacgtatacacagaacatatatatatggagcaaaatgaacgttctcgccttaccaaacaatttaaattacggcaggccgtacactaatttaaataattctgagatgcacattatggaaatttataaattcagtgtaacagtcaaatatatatgcacgatttgatcagtactcccacccttttgaaaaagaaattcgacgtaccaagaacgcacaagaacctctgcaggtaaaacatgcatgcacatgggcaaagctaaatgagaaatatctctcgaaggaaaaaaggcgaatatgcaggtacagtacttgcaaagagatcgaggtgatctaag

SEQ ID NO: 12676 - DNA, 9191 bp, Oryza sativa
  unsure (1)..(9191): unsure at all n locations
nnnnnnnnnnnnnnnnnnnnnnnnnnnnnnnnnnnnnnnnnnnnnnnnnnncaagcaaaagctagcgggcctatgcaacaagataagtataacaacaagatagagcaaaacgtagtggcttgactactgatataatgcaggcgcggtacctgcccggaacgcctgcgcgtacacatgcacatgcatgcacgacgcgcgcgctccggtgcgctccgcgcctcaaaaacacgggaacgtgaaatcgatcgggaacgcggagatctagcacgagatggccgggcgggattaatggcagagtacgacgactcgtccaagcatggacgcgcgcgcacatcggcacacgccgtcacgccccacgctagtgtacgtactataccagtgttcacccatcaattaggcgctattgaaccacgcgggcgcacgtacgagaacacgagcagcacgcacgcacaagacaagagctatagctagaacatacacgtactacgtttgcagcgcgcacagagtataaatggaggaaatgaattaaacataaacatacgtgctgggagagataacccggggagtgtactgtgtactgctcactgagctagctctctggctgggttcggagtatgcctcagctcttcctccttgccttgttggagttggagactttgttgcagagatgggggtatatatagagccagataaggtcggggagaccaagagagagaggagatatacaaaaagggtcaagtgaattaattctatttggaaggtcgttgatgttgttgcttagcttaattttgtctcttccagaggacaataacaattcgtcattcagatggtcgatcgatctggggtttggccgtgggcaggataccatgctgggccatacaaaagctagtagtacgtgtagctactgaattaaaacaaaacgtgttttttggtgagataaatcgatcgggatcttttgtgtgtgtgctttgacgctgaacagtggggagacagcgaagctggactgggctgtgagacgtactggcactaccacgaagaagagccgtctctctccggcgctcgagaattccacgaatcgatggatcggatgtggcgagcacatacggatactacaacatgagtgaattggggttagtgggaaggtccaccgtccacgggagctgtgtagtggtcagatgttgttttacaggtcggggcatcatgaagcgattgatttgatatacgtgctcctatcatttttcagctactccctccatcccattttaaatgcaaccataagtttctatacccaactttaattgttcgtcttatttaaatttttttaattaatatttttgttattatgagatgataaaacatgaatagtactttatacgtgacttatgtttttaaatttttttaaaagtttcaaataagacggatgatcaaagttaggcacggaaactcagtagcttactatagttccttaaaaaaaaaattcccagctcaaatcataggccgtgtttagtttttagccaaaaattttttaagtatacatgcacacgtttaaagtattaaacgtagactaataacaaaacaaattacagattccatctgtaaactgcgagataaatttattaagcctaattaatccgttattaagaaatttttactatagcatcacattgttaaatcatagcgtaattagctcaaaagatttgtctcacaatttacatgcaaactgtgcaattggtttttttcgtccacatttaatgctctatgcatgtgtctaaatatttgatgtgatatttttagccaatttttttttatctaaacacacccatagtgtcgtgcgaggcaaacatttctgccgccatctttttattagtttaagaagtgaagtcaaacggtgtagcaattaattagtttcctgatgaatatgtgcacgatgcacaggactgcgttgaatatatgtacgcgtttttggttttaaagagtcgtgtcgcacaattattcagcacaaacaacattttcaaagtctatatatatggataaaaccatgtagtaatctatgcttgtggccggtggccggcggccggcaggaattggaaaatattttgtgtttctaaataaagagagaatggtaacacaaaaaatgcatggagtaaaattaacaacttcgataaaactacacattaagtgacaatatcataaaactactaatatatcacaatctacatatttaagcgtaaatattccattgaaaaataaaccctaaatagtgtactccatctatcccaaaatatacgtatttctagagttcaaattatcctaaaatatacatatctcattgttgacggactatacccgcctatgttatttgtagagtataggaatagttgatataatggtatacgcgagattgaggtaaagagatgagagacggcgatttttatgcagattcggaccctttaaccctttaactaacaggtaatagccttactcctgttgaccgaatccgatgttgcctttatatatcaatatcgcatgagcacaatatttgggacaacctaatatagtctttgtcggtttagcggcatggagctctcacatgtaatcgacggctagcgtagtcagcttccacgaatatgaactcggcgatatttggaggcagcgctaggttcctcttgtcggtatctgtggctccatagtgggtttgtctaggctttccctcgcatatgttgttggcctgtcttgatctgtcctagcctatatatccgctctcctcctaaggagtcttgtatttatactctcagatgtcccttgtccaagtagatctagggaaccaaatatggatacgatccaaatagtccttgtcttgctcaagtaggagtttgcttctctttccttatctgaaacactttccgtatatgtggcttgattccgtataagacttcatatacggtaggttctgtcgagcctaatacgggtatgttatgtaggtcttatccatggcactgacactctaaacctccccccatctcaaccaatcaaaccatctcatgtttaatttctcgactaatcacaatcttctactatttaatttaattattttctttatttttaaaatacttttaaaaaatacttacatttgaggacggagggagtggacatcaaattaaccgtggagacttccacaaagccattataagtatttaagagtagtttcctagtgcttcttttctaatggaacatttcaggcaaattctaaattttgacattgataagcgaccagttcttaaaactgccatcaatgaacacaagttcaataaaataccattgtacaagcattcttttctttttgcaactaccatccatagatctttgttaggtcgtctaagaggatcgttttacccctagaatttggtaaattccataataataaattcccaaattacccttaagaatatcataaataattgaatagcaaaaatatgtgcatattttcatatggagattctacataattatcttaatggaggcctttaaaagggcaaaaagatcttttggggagacataacgtagatctatggatgaaaacctaaaggtagtgccaaaaggggataacaacacttgtatggtaatattttgtagaacttgcattcgtctaagacaatttgtagaatcatttatttgttggtagcaatgtgtagaatttcttaacatttaatcatgtagttccataaaattggtactatatttgtggtcatacactcacttcaagtatatctagagttttctgatatatttgaagcaagatgtgtagtattatgataatataatttatctttgttgttttcatgataattttataaaaaaatatcttaagttttgtaacatatactaaaaaaataaggggaataaattttaagaaaagttgcattatgctcactctcgatgtatccaaatcaccatatttacctgtgaaaaatatatactcaactgtgaagctcatgtgtggcatgcatctggcaatagggggacccaatttgaaaaaaaaatatcaactaatttactatagttatgagtaaatttcggaaagtttgtactgtttacccttttattagatattatccatgtgatttgggaagataaggacttggatatgaaagatcagtagtaatgcaagtgttggctggtttgtggcaagatttgaccctaaatagttaggactaaggaggtgtgcgaattgatggatgataaaggattgaggggtaagtcacacactgtatcaacagaatgagggagctcgacatgttatctcagtcgtggagttcagaactgtgtgttcggaaccctggttcccaacactaagtgcccgcacagaaaacggagtagcgattagagggtgattaattaagtatttgctttttttcaaaaatagattaatttaatttttttaaagcaactttcgtatagaaactttttgtaaaaaatggaccgtttagcagtttaaaaagcgtgcgcgcggaaaacgaggaagatgggttgggaagaggggctaccaaacgcatgtggattgtacacatgtgtgtgtgtgttttcaattagggaatgcatgcacgcctgatattttgaaagtagttcatcttgattcgcttttagcataaggtattattcgtccttttgttgtagaaagatcaaaatattgcaacaagacaaggtcattgtagaacaattgttgtggatggggcgcgcggaccattgtctaggtcaccatcattgtttagattgtatttgtgctagtatggtggaaatttacatagactcaatgctcctttagtctcggaccatgcttgggtctgcccatggctatgaatgcagagtactccttaaactatctcattaatttaggggcatttcttcatttcttttgaactaacggattatggattattgtgggaacatttttcatattcctaaattatactccatcctttccatatcgcatatcgtaaggtgttttagttttatcagaagttaaactttttaaaagataattaacatataatatcaaataaatacactatcaagacatctttaatagtatatttaaaactaatcagataatgtatatgttgcttttttatataaatatggtcaaagataaaaaaataattctgaaaaaaaaaacaaaacactttacactataaaatggtgggagtacaatgtatgcgaagactttcttcaccgatatttcttagaaaaaaatgttaaaattaacttgtccaagttttaatatttaattcatttgttcgtgtcctcgatatttttcatcaattcacagtttcatctataatctactagaacactttaaaatcgggctagtcgtcgcacatgccctatattgggacatcacgtacatggtttcctaataagggtggttttatgaaataagtatttttctagttttaattaggattttaaaacttgctagaaataatatacgtcctcgatagagatattactctcttggtgataaataaatgttctgacttttctcccttcaaacttttaaaactctaatcactaaaaatttaaaaattaaaacaattaatttgaaaacataaacacggcatacatagatatgtcttgacaaataatgtgattttattacaccatatactactgtttatcagatttggtaaacttgttttaataaaagaaattgtgatcagtcacactctgaagacgaaagtcaaatgacgtacatttactctgaagaaaagagtaaacgtttctgtgcaaagaacatactccaggtgtctgattcacttgtgtgtcacagtgtcagtgtgtgtgattgattgcccattgatgcatggtcatgccagtaaacattgtcattgttacacagcagtagtacgttttagtcctactccctcccatcacaaatatgactcttaagataataatcagttttgacaattaatttatatttgaatgagtttaattaataaatttaataactacatgataaatctatatattgttttctttgttttgaataaactagggtatttgagaaatattgttaatttttagataaatattgttctaaacgttagatattttatagccggaggagcacttgctgaggatatgcatgcggcgcccttaatctaagcccatttgctacctccaatctgttaaaatgatgattagctagttcggctcgtgtcgtgttctttgtcggtcgtcgtctatatcacatccccgcatgggacaagtgaaagttacattaattaattgatgtggtgtagctttccgtcgctgatggtgatgtgtacatgtgtggtagggagcttaatttggacagccaactgcaagtgccaagtgccgacttatattatatggtggtcactgcatggggcaacttcatatgcatgcatgatgcatggccgcaatgaggtgtgggctcttaatgaacgatgatgagaaggacaaaaggtttgggggataaagcgtgaaacagaaaagcagcggcaggcaatgtgtgaggcaggcagcagctggagaagaatgcttgtcgtacttttggtacgtacgagtgtattgttgtgtttagtggcagatctataaatttttgggccaattgcatatttgccactgatttgaatcggtattgtgaatttgccattataaaaaacgtaattgcatgcttgccataaaaaacgattggaacccatgatacttgccattagattcacggctgggaataacaccgttaaaagatgggttctcacaaaaaataggacaaggatgcccctccctgctgctgccgtctctgggcgcccgccattgttgctgctcttgctgcagccctaccaccttgctggcttgctgctgctatcgtagggagttgttgcagctgctgctctcgctgcaggcctgtagtgagctgctgctgccgcgtgctcgtgctgcagccgcgagcgttgctgcttccgttgcaacgtgctgctgctgctattgcggcggctgccgtcgacttcctcgcacctccggcaagattacccaaaaaaggtgagattttccctaccccgttgcccgtcgtcgcaaggactccaaccaccgccgacatgcacgctggtcgccgtccgctgtccgcctggccacatgtcctcccgtcgtccgccgacacgccgcccgtcagcgcgccctcccatcgattgtccatccccattcgcccacatgcctgcaagtgagagggcggcgagccagcgaggatcttttccggttaggggcaagatggtcttgtcatgcttcttatcttttaagttagttttatgaattatttttggccttttaattgtaccaattcaggtggcgatggcaaacgaaagtaacgggaactaactttggtggctaatttgcagtttgggtatttataatggcttttccgagttaggggttgaaatcagtggcatatttgcaattatccctaaatttttctaacctgagcaaatctaataatagagaaaaactacaattaaattcatacaaacacgtgcacgatttagcatagatcgaattctaatttatgaagaagataacaaatgtgcgaaattatatcgatgaaatgaaactcgttaattgttaatgttgaatacttcctccattccacatccacccaaaatccattatattatgggacggagggagtactagacattatatgtacttatagctagtcattttgctagtaaatgtgctgatccactgatctcacatccattagaactacttcatagtacggctacatcctgcggagcccgggcacctgccgaggctagctagccgggccctggctccgccgctaaattgtgttcctacgaagaaagattgttgcatagtggcataccatcgaatagatcttggcaatcctacggtcggaaatcaatctcgtggtgatatccattggacactcagaccaaaggctactaacttaaggattgtgctactttgtatttgcggtaagcacgattccgatccgaactgtcgaacgatgtatttcgtataaattttttttatacataagtttctttataaaataaataaatctatcttttaagctaatatttaattaatcactagataatgatcgcctccttttgcgtgtccaggtcagccaaacctattgagcaagtcgaacgccgcctaagctggtctcgcttactttgtttttttttggtaaggttgctacttgatattaaaaatatgtgtaattggctggagaataccgcaagaacgtgtcaatattgaaggacacttaaaaaaaatatgtgattgattgaagaaaatgaagatattattgtatcgttttgggtaaaaaggggggagaatttaaaaaggagagtaaactacagtttgtgtcaccttttattgtcaaagtttcgctttggatcaaccttaaaccaatctttttactttagaccggataactttgttatttttttcagtttggatcatctaactctctttactattcacacataccctttattctggtgaagatatggcctgcatattgacaggaagtttactagtgtatcaaaaccgatttgattgaggatgctgatgaatgttgaagttgtttggagtggtccaaaccaaaaacaaaattacaaagttatccaatccaaagtgaaaagattgattcaagggtgatccaaagtgaaaattggacgataaaatatagtccaaattacatttcactctaaataaagtaatattgcctctggtgccagttgcatctaccccgtttgagtctggtttgaattggacctagccacactatctcccctggatccgcatccaaagtgctaagcctagctataggaggtgacaacggcggtttcgatggtactgagcacaatcgacagtgcaagagggtggattcaagtacacgagtttaataaaaagcatcgattgagccattgtggagtgaaggtgaatggatcttcttcctcatagattgtgcatcgcctcgctggtgagctgcgcttgggaaatgagggttagatgcggctcacactatcggtaatcttgttgtttcaaaatttctctttccctttttcttagaaataataaaataatgtctcgattacaattttttttcttcggtagtgaacggttttactgtatctaac

SEQ ID NO: 12677 - DNA, 1361 bp, Oryza sativa
  unsure (1)..(1361): unsure at all n locations
catcctacgttttctcaataattatatgatttaaaggggggtagccagcgacggtggtcttggcttaccacgtttcaactgcgtgtcccccatcaatcaatacgtaaatgtagtattcggatagacacccgcccgggcaaaaacaccgcccggccgcttgcacatcgcacaggggaggatcaggccggcccggccgtgccgccacatggtgtccaatcgaaaccgctcgttgtcggcatgcatgcccacgggttaacctccaccacggctttccaccacggagtacgccttcgttttatcacgtcacatccggaggccgtcagacgtccgcctccgccgcagctcgaccagagcgaaacgcgccgaaacgtaatcagatataatattccccccggtactagtaccgatcgagcgaaacgccgaaacgtgtattagatattcgctgcgccccgtggctttggctttggctttggcctttttggcttcacgggtggtgcagagcacaccgaggggcagcagggtgtgcggcggcacggcgcgattgcggcgcagccagccgcgggtgggaacggaaatgcgcacgagcgcgatatctgccgacaggtatagtatgctagtactcctagctgcgtgcaacggacagatttgacggcccgccgcatggacggctgtcgatctctcggcctcctctcctcgcgtgtcggtctcggcgccacccgcttccgcgcttgcgttgttgggccacggccgaggccccggtcgtgctacgtgcacgtcgcgggctcccgctttcccgctgatgattcgaccgtgacatcggcccgcgctgctcggcggagtggagtgcagtggagtgactgtgacagtggcccgcgtgtgggactgtgggttcgtcgtgatgggggctgaccgtgccactgctacagcctacagcgaccgaattgacggcttcgcggccgcttttctgacgacggcgtatgtgctgcgcgggcattccacgatacttggcatgggatgcggtgcgactgtgcaattaggcggcggaaccagcgccacaaggcaatgcaggcagttgatttgatttcgcttttgtttgggagaagcgaaaacgaagacacgttatgccctggtggaaaggaagggccacccgcgcacgaggattttgcgtttttattccggcggatggagcagcaagagatcgaattgggaatttgggatcgatgcgtcatcacctgttgctaggtttgaccgtggggtttagagggtgcctattaaaataatagagccgtgttcgtcctggtttannnnnnnnnnnnnnnnnnnnnnnnnnnnnnnnnnnnnnnnnnnnnnnnnnnnnnnnn

SEQ ID NO: 12678 - DNA, 1032 bp, Oryza sativa
gcatatatagtatacatgaagttgctccagcacatatttaatgccggagcattgttatcagtaccagttttctcttttaggtgagaatcattatagtggtaccatatatctcttcttgcacatgataccctcgtttgtgcatgacatttctctttttagccctcattttggcctttaagcattgccaaatatttgggtgtaaaggaagcatctttttatgtctttttacgtgcatcagaattaggatcttatgactacttgtaccgcggtccacattttgattccttgcactgcttggttttgatgattgtctaaactgaatgtgctgaaaatatttgttttataacctgttgagtcgcagtaacttgtttagcatccaatggagagttcataccatgttgtcaattgatttgatctttgcatggacaaaatattgctgctatatagtctaatgttatgtattctgtattttttcatggtcagtttagaagggcttggattaaaacaacttagtaatttagtatagacttaagcttccccacaaaaaggaatctctgtgaaattaatcttaaattattctaaagataagtttaggaaccatctgtattaactccttaggtttagcgaagtttaggcataactgcagttcctccggcaagtccctaaactcttgttagatgaagttctgtttgagttattctgctgctactatagaatatttattttctcatcagtcacggtattaacgtttcaatatttctgagtagctgatttgttcattcatctttgtcagatttttgtaactaatcttctttaaatccagttagtatatcgcatagttcatcaaactcttcctttattacacttgcaatactgaatttggcttctgatttcactctgcaggtcaagttctgcatgggatacagtatatggatttcttgtgcttcatttttttattatacattcgaagagtctgcttccttgttgtgaagctttttatagaaacttattctttgcacaaggctggagcac

SEQ ID NO: 12679 - DNA, 663 bp, Oryza sativa
  unsure (1)..(663): unsure at all n locations
nnnnnnnnnnnnnnnnnnnnnnnnnnnnnnnnnnnnnnnnacttgcatatgtaattagtatgtaattttcgaatttacatatgtaattttagtacttacatatgtaattttgagacttacattgtaaatacactaaaattacatatgtaatttagggacttaaaatgtaaatacatgccgactatttttcgatgaaaaatatggcgccataaatatagctacactaaaaaattttgcctaaaaacgtcacatcgaattttttgacacatatatggagcattaaatatagataaaaaaactaattgcacagtttgcacggaaatcacgagacgaatcttttgagcctaattagtccatgattagccataagtgctacaataacccacatgtgctaatgacggattaattaggcttaataaattcgtctcgcggtttccaggcgagttatgaaattagtttttttccgaaaaccccttccgacatccggtcaaacatccgatgtgacacacaaaaattttcatttcgtgaactaaacacacccttaatttatgcccgggcatgattttcaacagctcaaattaatctataataatttatgcccggacatgattctcaacagctctaattaatttatgcccatttagtttcactcaaaaggcatgg

SEQ ID NO: 12680 - DNA, 723 bp, Oryza sativa
  unsure (1)..(723): unsure at all n locations
nnnnnnnnnnnnnnnnnnnnnnnnnnnnnnnnnnnnnnnncttccagtggacaaatctgacctcaagaccttcttcccaaagtactgaaaacttcacaattccgtcatcattcagatttaacagacatggttcagaaattctgagatgatagtatctgtttttgcagggcatggtgcgatgaacacggagacaacgtgatcaacgtggcgaagaaagagttcaaggagcacgtcgaagagatggagaagcagagggacatcaccggcggcggtgatggctgggttgcattcggagacagccatgacgaaaatttcaacccgagagcattctctcagcatcaggctgcagtgaagggtaacgtccatgacagtcttagcagcagtcaacatttcacaaaccctttctatgacgagaagaatcctttcttgactccaagctacgattgatactgcgagtgaatgtaattggtcttttgtgttggaaatttctgtgatagttttacctccaagttactgatgttgtactttaaggttcaattgttatattggacctaggttgtgtatgaattttctatgaattatgagcttgttccatgagcacaattcccagtacctacgacaacaatgtcccgggaaatcaacgagttacgggttctatcaaggtcagtggccttcttcagcagccgcaagtagcttcccattttgctgccgagcacgggagag

SEQ ID NO: 12681 - DNA, 814 bp, Oryza sativa
  unsure (1)..(814): unsure at all n locations
nnnnnnnnnnnnnnnnnnnnnnnnnnnnnnnnnnnnnnnnnnnnnnnnnnnnnnnnnnnnnnnnnnnaataggtccgaatccggaagttttcctaatagcacgccgttgttcatagtgttaagcctaaggccttgtttagttttcaaataaatttgccaaaaaaacgtcacttcgaatctttggacatatgcatggagcattaaatatagattaaaaaaactaattgcacagtttacataaatcgcgagacgaatcttttgaacttaattagtctataattagtcataagtactataataacccacatgtgattagccataagtgctatagtaacctatatgtgctaatggcgaattaattaggtttaataaatacgtttcgcaattttcagaggagttatgaaaaatttagatacctcaggaacttaaaattccctcaacatgatgtggtaagttgaggatgagctagtggagaatttcggttcagagatgactgtcagaccctgggacaaatcaagggacctctagtgaacttattctattccacaaaggagaatcgggccgcaatgttaggcagcccaggtcaggtcgccgccgccgccgcgtcgtcgtatccttccttcaaccaaccctcgcctctaggcagacgcttcgcagaggcaaaagctcgaacacatggcgcgcgccctagtccgccgggctctctccctcgccggcgcggccttcttcccggcgaaaccatccttctccaccgtcgtcgcgccgctgcgctccccgatggacgaccgcctcctccgcctcctgcgctccgaga

SEQ ID NO: 12682 - DNA, 2180 bp, Oryza sativa
ggttgctacctgcgagatcggttcttccacactcctgagaattttcagacaattttatcgcttatcaggcccgttcatggttggtggaagctcttcagtcaccggtctagttgattagaatccatactgatcaaattaaggttcccaatttggtcaattttagcagagcacgtgcgagctcaaagtgcgacgtggtgtgtaaggcgtcaatcgcagctaacgcgttggttgcaacattcggggaagaaggggttaaagcggtcaaggtattgaatctttaatttccaattacgttggcatgcgttctttaatttcttggtctagtggtggtctgtccaggccgtctggaaaaattactcgcggtcaagagagtgaaatggtcaggaatttacagcagctatttctgcttgacgggggcatgcacgcacacattcaagtaaaaagttaaaagaggagattactcgtccacgtagaaacgtcacatgtaattatactttttttaagagcaggtacaatagcaaactataagccagctataaacatattttaaaaagataaaggaaaagagagaaaaacagcgggctacagatatgtagccaggtacagcacgaacttcaatacgtaatgttacgtaatgtgtgtatgacaggtatgaccagatattaataatgtagtaaacaactattgtatgaattggctattttattagctatagatgatttaaagctaatagttagctatactgttaaacttgcttttactgattctgaactggaagaataacatgaaacgatatcaatttgttactgcaaatgtatagcacttttgggccttttggaccttatttacaaacgaagaggaatgtatgggccgggcctacctcctcgatctgtacgtgggctgtatctgtaattgatggcaactaaaaaaccgagttcgaattggagtacgtgacagtgccaactgaattaatataaggtgacggaaaccgctctcagctcaacgcgccgccacaatggctagggccgcgaaccgccgccggcgacgtggtggggtcgtctatgcggtggtgctcgacgacaaggaaggcagcctggtcttccgcttccgccgcaaggatctcttctccgacgacgacgacccgccaccggcggggcggcgccgctttccgcgccccgtggcgcacttccctcgcggctactaccactacgtgtttcactccttcaccgtctccggcaagcagatcctcggggtgagccccttcggcgccaccgtcgtcatcgaagacgacggccgccccggtggcagcggcgctatgcgggccggcccggagctgggcaccaccacgtgccagcctatcctgctccctatccgggaagacatggtgctcgtcatggcctatcttccacagccggccggccggagtaacttcgccgtgatgcggcggctcccagacggcggcggtggtggcggcgggtggcgtgtcgtccctgttccggagccgccgctcgggggccccggagactactactgccgcaagccagcgcccgtcgtgacggcctacatgaccatcggccggagagcgtgtgtctccatagccggcgaaggcaccttctccctggacgccggcggcgcggcggcgtggcggaaagagggaagctgggagctgccgctccacgggcaggcgatgtacgtgcgggagctcggcgccgccatcggcttgggacgcgggccgggcccctacggcggggtggtgctgtggctgtgcgcctgcgacgtcgaggccaggccgccggtgatccgccggtcgtggaacgagaccttccccagggagctggtggccgcgcactcgcagtatgactgtcctggtaacctggtgtatgtcggcgacggaaggttctgcatctgctgggtcgccggcgtcgagcacgaccgccccgagacaaacgacatggtcgcgcgcaccgccgtcgtcaccatggcagtgcggctgaggcgctccgccggcggcgagctccagctcaccaagctccgctaccacctcatgtcgccgcaaggcagacgcgcctacttcgtccagccccacattccttaaatcgaaggagtgaccttggaaagatcgaagaaaacagacaatatgtcagtcactctatacgtgggcgatgaaataccactcaaag

SEQ ID NO: 12683 - DNA, 2792 bp, Oryza sativa
gatacagagaaattaatatcatatttgttgaagtaaaatatcaagtattccatttagtcataaggtgcatcaaagaaactataaaatatatgctcttttttggctcacccatgggttcaaaatttttaaaaagggccttatagtgtattaaatttgagttatttcagatcgacgttaggcaggttaggacattgcagtagcatacagcggagctcccaaaataaatcatcacaactgatgatggaaaggatggaagttgatttgactaaccccaaggcatgtgtttgtgaactgtacccaataagcactgagaactgcttggtctacccttaaagagtggttatggttaataaacctagataggagcagtgggaaataatctatccacttagcccctaaagcatggtttggatcaggatccttgtgattaaacagagcaataagaatgtgagaaactagtggtgataacataataatgatgcgtggtgaggcaaaatcatcgtggttctatgcttccagagtgacaacacacccactagtgatctctgtggacattttgtttcccgtacagaagaaagccatgtaaatatttgaagatagtagacaacagagcatcgaaaaataatcatcaatagactcacttgattcaaggcattttgtggagtctcatattcagctgcgacaaaaacaaagacctacaaacatccaaggaagtatcattaagaaagcagcagcaggaaaaacttctttagtatcgaaaagagtttagatggcatgtccatatgaacttcagagcatgacaacataaaactacattaaaacttatagaaaacaaaccaccgctcaaaatgcattgaggtcattctgcacaccagaatcactaaacaaattacactcccctggaaaacatagcaacaaacttccattttgtttcactctttcacccacaagatatgtgttggagaacttgccttcctttagttgagcctatttcacaattgccataagcccataactcataaactaatttacttgatccttttgtcagaatcctgccttgatgcattatagggagatctaagaagctcataaggtatcaataataatgcaatactagtacagtttacctgttttgtgttccacgtgaacagagacgagaggtcagccgaaatgttcagcgtcatgctgacctaccagaggaaacataattgtgtgagttcatggcatatcttaatgttgtttgaacaaaacttttagagtttcaggagagagaaaaaatgatatgaatcacctcgtcgttgccgttggcttccttctgaaaccagtttatgttcaagatctgcgcaattaaaacgacacagaataattagcagaacgaaagggctcgcgagagagagatcggacgagctaatcaagcagggagagcacgcagatcgagcagccggcggcgaattaagttggccgagatcggtacagacgaggcgaggcgaggagggggttgagagagatagagcggcggggcgcggcgcgggcgcgggctccggcgaggtttaccttgacagaggcggtgggggaaggggagttgaagtggtcggagaaggaggcggcgaagcacatggcggccaggatggtcaccgcgaacgtcgccaccgcgttggcgcggtgcccgaacgaatgcatcctccccctctcctccccgacgagctgctccctctccacggtcgggtagatcgccgggcttcgcttctccgcggcggcgccggcgacttcagttcagctctcctccctctctctctctctctctctcttttttctttttctcagaagatttgtttatttttagcgttggggaagacgaactgaagtcgcgtgacgggttggggacccacgtgtcggagagcgtgggccggctgagttggcagccgctgattggtcgcagcacgtcacagaggagcacggctgtacgcctgcaggtgggctagcgcattgaacggcccgtgatgagaacagtttgggcctgcaggtccatggtaggcggaagaacttccaattgggcctgtcactcacacggctcatctggcttttcaccctatggtaagcaacggcttgccaaaatttaaattttaaaacttgatttttgatgtttttttaacaatggcttttactactaagtcgcaaagaactcatattaaaagttttacctataaattattttgttatcagtaataagtcgttgcggcatataatcagccgtgagcaactgatggggacctcttttcggatgcgtggagaatggagatgtgccagtttaagatgcactttgtttaacaatgtatgacgagaaaaaaacatcgaaataaaatgatatctcgaatctgtaagttaagccaccagatatattactcaaatataatataagataaaaagaaaatttaacgacacaaaaaaggttcatacaaactatggaactatacaaacgtgccatctagatggccaagcttgcatgcatacagttacatcgatcataacgtactaaaaatctagctgcaaaatcacacacaatgacacaaaatcatagtacaaatacttggattaattccgtatagaagtcgtcgtacgttatcctgtggcggcgagaaaggccgcgcagtcgagcggctggaacgagacgacattcttggcgaggtcgtagagcacgagcgtgtccagcagcgcccagctacccagcaccgggacgccgttcgacgagcttggcgtcatcgtcaggcagatcaacccgcccgccgagtcct

SEQ ID NO: 12684 - DNA, 11643 bp, Oryza sativa
  unsure (1)..(11643): unsure at all n locations
nnnnnnnnnnnnnnnnnnnnnnnnnnnnnnnnnnnnnnnnnnnnnnnnnnnnnnnnnnnnnnnnnnnnnnattaactccttaggtttagcgaagtttaggcataactgcagttcctccggcaagtccctaaactcttgttagatgaagttctgtttgagttattctgctgctactatagaatatttattttctcatcagtcacggtattaacgtttcaatatttctgagtagctgatttgttcattcatctttgtcagatttttgtaactaatcttctttaaatccagttagtatatcgcatagttcatcaaactcttcctttattacacttgcaatactgaatttggcttctgatttcactctgcaggtcaagttctgcatgggatacagtatatggatttcttgtgcttcatttttttattatacattcgaagagtctgcttcctggttgtgaagcttttcatagaaacttattctttgcacagggctggagcacctttgcaatttggataccttagttcttgtttttgtctgctttgtcatgcacaggaagctgtgctttgttactggattaggggctacatgtttctgtggcctcgtaatccattgctggaggattggtggcatcctccttttgttttgtgggtattttgtgactacatgcctgttttgcaaactcaaattaggcttgtaatacgattacatttattgttattgaaagggaaaagaaaaaggtcagaaaaaaacatcatatctcagtcagctgacaacttgaaccatttttgcttcagtatattttgcatgctctatcaggagtatccgaaaacagatcagagctagacatcaagacagtagtacctgctgcacatgcatgacaggctagttgattgtgagagaacatgcatgtgttctctgtcctgcaagaaattttcttcagtggctgctgtaagggcaagttttataataggggtggttaccacatctaattttatccatgtaagataaaagatgatatatagaatacatcacatctacactacctctagcatactaattcaaatgtttttattttatttgtttgtccaatccactctttcttttatcttctttttcttggggtttgtgtgaaggttatcccttatataaggggtggctcaccttctctttcctcacttatttcttccaccttatcatacaatcttacgtggcatgtttaggggcaacacatctagcattatagtacttgccctaagtgaaccaattactccatgattgctccttcattattactgtacatttggaggtacaatgtgtcaggattgggcatgttacttgcaaccgagttttgcaactgctccatatatttgctgcatgatcagaccaagaggccatgggtggttctaccttaagttcagagttctgtgaactgaagaagacgagatgagtgtatcttacaacacatttcgattccactgatagcatgaaaaagatggaacatccatcaagaaatgaaaataaatatcttagtccatgtaatttgagtatataaggcctgggaagcatcggaaatttccacctcagtcaaaccacgtttcgaggtggatgatcaacaagtgtatggaaacattttccttcatgcgaggaaaaagtgtacccacagttccatcgctttcatgggtagcaaaaatgaactactttttgggtgaaacatgaaaatgaccaatgctcggcattgtttggttttgtggggacgggatgattgagtcacttaacagatcgtttgtttgaagaatgctaaactattgggaaaaaaaatagtgtcattcttcaaattttgtaggttgatcttacgatgatcacccattctaaagggttgtttaatccctcgcccaaaagagattagcaagaattaggctatgtttgatagtagtgatcggtaacctttctcctctgcacataatactttagcacatgactaattacatattagcttaaaaactttaaaaattagttaatataatttttatagcaacttttttataggaaaattgtaaaaaatacatcctttatcagttcaataaacatgtgtccgaaaaatgtgggagtagaagttggtaactggtactaaatataaaaatgtgggagtaatatataacacaccctcaggccgcgttattttcagcggttgggtttggatgattagctacacgtaaaacgagaaacgcggttagcatttaattagttaagtattaattattaaaaatttgaaaaataaatttatttgatttcttaaagcatcgtttttatagaaaattttttgtacgaaatacaccgtttaataatttgaaaaacgtgctaacgggaatagctaagctgcattagctgtttagaacgcggagaggggataagttcacatctactgtgggcttagggcatactccctccatcccataaaaaaccaacctaaaaccggatgtgacatatctactacgaatctggacatacatctgttcagattcatcgtactagaatatatcacatatggtcatagatttgttgtttatgggatggatggagtactcttaacaggtccctgccatgtggaccctacctgcagcagcctgagggaaataaaaaaatatccaaagacaaaaacaattcgatccagtagcttgacacccccacccactagtcgacgccctcctctccccgtgcacgaatcacgagactcacgaccaccaccctcgtttcggtttttgaatcgtcctccaccattggaggaaggtgacgcgtcgagggcccccttcccggtgggccccacatggcagcctcacgcccccaaaaccctagcgcacgaggcgagccgccgagccgagccgcgccgcgcgccacccaaacaccgagcccaaaaaccctaaccccccctctattaaagcctccgcgtgaagagaccaaaacaccaccaccaccgcgagacgacgcgagcgcacgcacgcctgcacgcgcggccgcatcggcatctctccctgtccactcctcgcgcacggtctcgaggtagggtttcgagctcagatttgggtgtttctctctctgaatcctcgtctgttcgcgacaaagttttggggggttttgagaattttttttttaaaattgtttgttgcagagatggcggcggcggcggcagtgtgtggaaccgagagggtcgccgaggtgtccgcgtcggcgtcggcggcggcctttgtggccttctctgccgccgcggcggagagattcctggctgtgctcgcgctcgcggttagtgttttcctcttcgcctaacgctgcgattagcttgcgatttttgttgctagtggcgctaattgttgataaatcatgttgtgttatgtgtttcatcgagggtttgacctgaaaatttcaagtaattaagcccgcagatctggagatatgtatacatgccttctctgcagaatttttggatttcgagggggtaattttggtgttctattgcctatctgcggggtagatctaagtagcagatctgagtagttgaaccgagtaagtttctggttggaagtacaaagacagcctagtccatttgtaacaagcttgctagttatgtatttctatgagagcgaaaactgtgtagttgaatggttggaggtacaaagacagggtagtgcatttggaaccatgcttgctagttatagtatgtattactatgaggaaccaaaaactaggagcacctggatgcctgacagcctgagcattcaacacattgttggtgacaattgtaattctaagctgcaatagggacaccatagctaatttcttctaaatagatgtttagttggcatacttgctatatcggtcattctgtagaatatactggaattctattaagagggatactagaaggtatacagggctatttatgctgtatattctactagttgggtgacttaatgggtatgattttagctgtatattctacagtcgggtgactgaatggatatgattttagctgcatattctactagtctggtgacttaaagatacaattttagcgtttccattcatcatgtcagtatgtgatgtttttcctgaagtatcagtatgcatcagtgtgttttgatgctacagaacgttttgactgacgttggcatataggtaagatgctgattggttgcgaactatctgttcaatttgcatctctttcaaaacactaattgtttctaatctagctctgtaaatgaagtttttgaagtaccttattatcaaatcccataagctattctctacagatttctaattcgtagaaagtttatgctgtaatattaaagaacagcttattagggaagcccctcaaaccagcttagtagaagcttccatactgtggcttttggactaactgtggtatatactcacacagatcgttggataatattttgtcgcattgcctgagataattccaattttataattgaacattttggcttttttggactaattatggtatatactcacgcagaccgttggataatatcttgtcatgttgcctgagatcattccaagtttataattgaacgcaatgatgtaatataatattaatgcatttctttctttttggcactttctgacgtaacgggtatctttcttagatggaagcggtaaatggtggagcagatatatttaatgaggaccaacatgcaatctacaagtaagttccctgtcttattatgtaataataatgttttctatgtaatataagatgttctttgttgctgattagtttactttgtaattaaaggctactcggcagaatcaaatctgaatctacccctgagaacaaggatgggtcagatgatgacgacgacgatgatgaagatgacgacgaggatgatgaaggtggtgatgatgatgatgccgaggaggacttctctggcgatgaagggggtgaggatgaagatgatgatgatgatgaccctgaggcaaatggtgacggaggcagcgatgatgaagatgatgatgacgacgatggtggtgacgaagatggtgaggatgatgatgatgaggatgatgatgatgaggaagatgatgatgacgaggaccagccgccttccaagaagaagaaatgagctagcctccttcatcctgcatctgcctcctcaacttgtttcagtctgttgtgctgtttagatgatggaacaggttatgggacctatgtagcttatggtttgggttgtttgggtctctcataggagtaggaaaacatttgacatctgatgttaagccgttctcttgtgttttgcctttgtgcatgtagacgtaaaatgctgcggtgtgttatttattggagatctgattctgtcatgcattcaagtctgattcttgttactttacctttaagtgtgacctctgtgcattgtcatgttgatcttcgaagccgcctccattcagctatggtttggtttgtacaggtccgtaatgttattttgtgcaactggtgaagctgaatttgacgtcactctttggcggcggaaaaaggcttcaactggacaaaaaggaataacagaatcctgcagacttttggcagagcaatgaaaagaacactcaaataagcaaggcactaagccactaaccaccgcaaaagaaaaaaaacgaaaacactaactttatccataatatcgaactggcaagaattcactaaatacatggtcaaggatcacgtcgtaatgaactccatcaatcatcacatatacccaaagatgtcatatgatacaacaaatttacttcttctaccgttacctgggatactactgcagaaaacaacgcaactccccgtaatggaaaaggaaatcgtgtcagaacgtgaaatgacactcgctacacaaaagcctaaactaaaattggccaaaaatttgccaatatccaatgagctgtattctcctgtccaatgtccaaaaatccaacgctttgccagggaaactacatctgacaaaattcttcctgaactgatcccctctgggaactgtatatactatttgccatccaagtcatgactcacgacgactccggttctgacttcgaaaactcctgaggctcactgctggcaaatgctagccagacagcagtacccgtcaggtaaaaaaatatcgaaggtgcgaaaagtgatatctgcacataaaagagaactatgagattagaacagttcataatgaaaaactataggttatgaagatggattagactgtgatgatgacatacactccaagaatgagttgtatcaagaagatagcctgttagtgcaacgccaactattccaggtacagcacctacagtgtttgtgatgccctgaaacacaagaaacaagttagagcagccatctgagactaagtacagtgctgcagctaatatcaagtacaaataaaagaactaaaacaaatgaatctgtcgagctttaagcacacacactgtgaaggattgctcttatttttcaattccttttcaagaatacaaatgaagaaaaaatgagaggacagactgatgctgccttaccagcagaatgcttgcatactcacgagaaatatcttgatgggtgcaataaagacctgtttatcaaccagaatatttagctttagatcttgcaaacacagaaaatggtatgctcatgggaagcttaacaacatgacctgacaatgcgaagctggagagtgccagaccacttgtaagaaaagcaacaatttcccacggtggcacaccaagatccacagaggaaagcatcatgaaagttgcaggtgacagaaatgcaattgtttgacatatctttcgtacctatagaaaaaatttaacagatatagatactttaatttcccgcaatagatagctcactttccagttctccacaagaaaacagaacatcctgtcaggatacagaatataacacaggcacccctgacaagtttactattctggcctttacaaatgattcctagaattatttacagaaccacttcctatttcctaaagtaaatataaataaaataaagagaaaaatcattttatcatcagcacaaaattaagaaagtaaaggcctgacctttgtggtgtctactccatttgatatcaagttgtctgcaaaaggtgcagcaatagatgtaatgatcattgagcccaaaggaggaaggactgacacctacagcaaatatgtaaaaccataagctctcatgacagaaattgcattcatcaatgaaaaataagggaaaacagactttccctagtgaggaggaaatgaagcattgaatagaagaatctcactacaattttaaggaagcatgtacatacccatgctgcttcagtcaaattcaggtccagctcctcactgcatatcatttgaacagtaatgaattgcaagaacaaaaacatgttatcggcataaacttggcattatgtattgtacaaatagcaaatgatcagaccatgatctttaaaaaccagtttttttttttggaaaaatcaaatgcaaaattctaaaccatctattttttgtttggtcctattttcgtagtcaaaccattttcataaaactgaatcccaaaacaacatgtatggacatttaagaaaatgactgaaatgaaagagaaaacatggtcaatgaaactaagcacttcactctccacagcagcactaagttgatagctgctatccaactatgcactactcatttaaacaaaatagagacaattaatctacactgagccaaaaagtaagagaaacaaaatgtcaagacctgtgtaaaacaccaaagaccatacctaaagaatgttggtagccaagacaagcaagtatagtgcccccagcttccacaaaagtgagcatatatcattgcccacactgccttgcttttgaaaaattctctccaaggaacatcctaaagaaaaagaaagttgcaatgttggccgcataatcacatgtataaagaactctacttcaagatttgtctagagataataatgcactaaaaaattttcctggtcatattgcaaaccatatttgtttatttgggaatgatcacatctgcaacaggtgaggtgaatagaatctcgaaccattcgaactagtagttattcagtttggtatattttatgaacaatagagcatcaaatcacatagtccccatgccatgattttgatactttgacttcacaaatgacccaacttgagaacagtcttgtaacttaatccatcaatatacttctaggtcataacagagattatggcagaactatttcatctggtgaaaaatagaacctttagtgaattcatcagctctcccaatgatgactccgatgattttggagacacagaggacgagatgaggtcacttgatccagaaggactctgccccaaatcttgtattacttgtatatcttcattgccccttaactgttgttctttaagagattgaaaccctagacacctatgaaaaaaatgaatgggaagttaaacagaataaataatatttcatctgcttattagagatgtttcctcaccaaataattccaagaagtccaaatatgtaaaagacagattcccagccaaggttctgaataataggtggggcgaacaatagtctgtaatgccaaacaatgtatatggaattaactatctggcagaattgtgaacaagcgtgcatatgtaccacaaaatacctgaaaacacataccctaatacgcttccaaagctcaaaccaccaaacacaacagcaactgctcttgatcgttcttgaacagggatggacctgtatgggcagccataacagttaaaagttatgaaacaatagtccatgaggatccaaaaggtcataacagtttggtgtttttgttctatttttatttttcagttagggatcaggcacaattgtacttactacattatgtttaatataattaacatctcagcaggaagaagagtcaaatttctatgggattcctgttatgcatacaagtaatacaaagttccttaataaaaatctcaaatatagaaagccaatgacaactggactactattgtgaaatgtacgtacgaatcactgtgagaaatccataagaactaagaagcaggaaatattatttttatgtatcattcaacagctgaaagtaaaaaaaaaatgtaaccaccacttgctattctgcacagttagctacaaaataattcatctgaacaactaaaatttcaaacaatagtcatgaaaaatgaagacacattagttggttacatcagattttacaaaccacaaaatttaccatcatacaaaaaacacagggcggcactctaataaaaaatctaataagcatatgtccagatgattagatattttagatggctaccaaattagcactaagaaaatgaaaatggtaaggatgtttttaaggaaaaatgtttactcaatcttgccttgcaatcaaatctgtagcagctgatggtgatacaccttctccaatacctacctagcagaacaacacaatttaaatagaatatatgttatataatgcaaacataagaaatacattgtattttttttattacgagtcaggaacactcctatggtactgaactgaaaacgtggcaaaaaaactagttaatctcatctatatggagtgacatattgcactggctgttttattttggtttgctctgcaccacaactgtttatatccattattctagttcatcagcaatccgccacctcgaagttttcattgtctgataatatagtcagtagtcacatgcatgtttatgaatttattttttcatagagaacccaatttctcctaattgcatgatgagtggcttctcaaactagcagccctcactgtcttgcatatgctttcctcagacatggacaaattataatgtatcacaacttttcagatcaacaaattataggatagagagattaattaataagtagaggtataccagaatccttgacaacacaagccctggcataaaccctgctacagcagggataatggcagttgccaaagaccaagccacaactccaatctcaagtactctcctacagttagcacatgagataacaataattaattattacaagaaaacaatacatagatgaacactaagaacctttggagtgagataagataatgagaaagaacaagggataaaattataggaagtgcctctgagctatgcaagataggcagaatgattctcctgaagtttaaaattgctatatggttcttctagtttatttgaattgattactgctgctattaaatcattgtaactaggaatttactcaaatttatagttaaaataaacaattgggagtaaggaaaagggtaaaataaatgaagatatgtaccatccaaaaaaaattatgacctcgtactgctatttgcaattttgcttactaccaacttaacggatcattctttcccataaaggtacacaaaaaaatccgtaagatatcctaattcctaacaagatgggttgcagaaagaaatagccattatcatcatttgcatttattattggaaacatgcttatcccggaagcaacagcaaccaccaaaaaaaagcattgctaagatattaaaacacccatgcagatggagaatcataggtagcttttgtatttgtctatgcacaaggggggttttgttaccgcaaacaaaccttccgccaaacaattttgctagccatccacctggcagttgactcaaagcataaccccaaaagaatgacgattggactaatccagcagtcgatgagttccaaccatactggtgtgacattggtataattgcaacactcaagttaacctgaaaactggagtgtttgcaattagcaaatattcctaaggaaagaaaaatgaactgtccatatggactaatgcagaagtgaagtgtatatcaagaccaactaaaaacttcaagagatcatgtaactacgagtgagaaaatgacatcggcctagttagtagtacaaacgactgctagaatgaatcttgccaaatgtattgtcatgtttaatacaacagttatcacctgtcactaagcaagtaagaagactgttttcagctgaggtgcaccatgcatactaataagttctctgcttgcatatggcacatttaacataccgatggacaacttctaagtggtaatagcaatacatgctgaagatccactgtcacgctttcttcattatttatgatgcctagttgcctactaactgcctaccaccaaatggtgctgttctattttgttttctcttatgagtataacttagtaaaacaagactagaagcctagaacaacaacccagcggtctcactccaattcgagtctccatattccttttcctgaaaacagagctacactctcactctcaagtagcaaatttacaacgttgtgccatgctcagattatggacttattgttttctgcttcgaggatgactcacatattcattactactacagtgagagcagacatcacctacggaaaattaagcacagaatttcaaacaaggttggagactgggggagtacgaccacgcgcaccttgtccatgttacaaatgacgaaagcgagcgaggtggcgccgatgagcttgta

SEQ ID NO: 12685 - DNA, 2186 bp, Oryza sativa
caaattccaatttaatatttgggaattggatgttctctgtacacggatcctaatatgcattaccaatgaaagaaaccaacccattatcaggtatcgatttaatggtgtgtgatgaatcatctctttctagatagtagtagtcaaaataaggaactttcactgcctattacacgaaatggtggatttaataggagaacaacagaaagaactgcataataataaaaattaagcaccataggaaaaacaccaatgatccatactgcatgcatattttacctgtttaatcatgtttataatctgatcaatgtggtctgaaacgcgaggctccacagatggtggtaaacaatgaagattagccatgtctgataggaagtcatcagagtaccttttgcttaagctaaaaggatcttctcccaattgatttgctcttgcaattatctacagaattccagaagtgcaactcaggtatcctgtgcagattagcaattggcatataaattttctttctaggtttcaagcaaaatagcttaatataatgagggaggtaaatatattgaaacaaatttgaagttaaattcaggtattaatctgaaacaaacacaacattggttgcaatatgaatcaaacatgaccttggtctactctacttcaactggtcaacatgacacgttttctccatattaaaggtatggatataatgacttctaactatagaagatgaacaggtagaataactgtagcataaataaatacaatacgattccttgtttacattaaatttagctttcagataatgaggaccagcatcacttgtttgaaaataaatttgacccataaatcaccttgtcatcaatgtcagtaaaattccgaacatagcgcactttatggtccaaataacgcaagtacctgccagatatcatgatacatgagataagcatatgaccgtatggtactttctagcaggagaggaaaataagacaagacaacatggtaagagtgtgctgaatgtgaataaaaagaccataaaggaatacggccggattcagggtgtgaaattgttcctgggtatgatggttgagttgctccgttatgcttagctaattgagatgcaacagtgaattggcttgttttcctaacgtcataacaaattaacaaccattcccagagtaccttttctgtttccggcagatctgttgctaagggaagagttaggatcatttcgcacgcaactaccataacagtttgccgtagttctaatgtcagaacatcctaaaccgagctatttagagcgcaaaatgtttctcacagtgtgtccacaaacaaattgtgaatgtacataatacattgtgtaattttgcaatgcacttactgctataaacatgtctcctcatttctccatgtatagaatactgctattaagtcggtgtaaatttgttaacacatccatataactaattaagtacataacgcctcattgggtgagtcaattgcacagcacagtcaacatcactatcactagagcacgcaattcaccaacgggaccaaatccggagaagaatgaagctagggggaacctgtagaggacgtcgaaggcgacgtaggcgcgggcgtggccgatgtggctgtcgtcgtagggggtgacgccgcagacgtacatgccgacctccccgccgggcacccggggctggaagagctccttcctccgcgacttggtgttgtagaggtgcagctcccgggctctccccgcaggcgcgccattcgaggcggaggcgaaggcggaaaacgcggcggacgacgagggcttgggggagtgggagtagaggcggtgggggcgaagcagaggaggggtcagggcaagcgcttggcggtgcggtaggcgagctcgcgacggcgaggagaggaggagagggaggaggccagcggcgcgcctcgccgccgccatggtcggtcctcgaggcacaggaagcgcgacggcgcgaggggttagcggatagcgtttccctcttttcccattttttttgggttttccgccccacgatttaatttcgttccactgaacagtggaattatgaaaaataaaagggaaatacaagtacctcttgatgggcttatttgaattccttattttgttactaaatttatatatagtatgtacctgaagttttagagagagaaaaaagtctagt

SEQ ID NO: 12686 - DNA, 3741 bp, Oryza sativa
aaatacaagtacctcttgatgggcttatttgaattccttattttgttactaaatttatatatagtatgtacctgaagttttagagagagaaaaaagtctagttcaaaatgtgaatccgaagagtatatgacaacagttttattggagacaaatatagcatattaagggtctgtttagatcctccaaaatagtgaaagttttgtcgttttggaccactttttggcaaaatagatctaaacactactagcaaaagtagacaagttggcatttatcatttgggagtccaaagcagcaagttttgctaaaaagagcgttgggagccatgtgggacgcacactgcccctgctcgctctctcgcatcccttaccctcgcacgctctctctcatccgctcccccaaaatttccccatctcgtatgcctcctcctctgccgatctcgctcaccgccaccgctcacgcccgcctccgccgatctcacccaccgcattagtccgaggcggagacggacggctccagcacgagggacttcatgtcgtagtccgattcactttcccccgccggcgggcacgaccccttcaccgactccctgtaccacttcactggatccggcagtggcagtgcttctaggataggcatggccgccttcgacctcaactccggcagtgatgggtggccaggaatggaaagctacgagggcctccttcactccggctcgcaaggacgcgacatcggcggatttgggagccacctttgggctggctcgcaaggaggcgacataggtagatctgagagccatctttgctctggcttggtatatgatacatttgtgtagtatcaatttgtggcttgcaagaagttgagcaacaacagcagcactcgagcaagccgctgcatggaatgcccgcataggagagagagcaatcaataaggtgcaattaatacgggcaaatcaatctataatggtaaaatgcaaaactctaccatgcctctaaacatctattccctccgtccaaaaatataacggattttggacggatgtgacacttcctaatacagtgaatgcagatatactctctgtcatattcatcatactcagaagtgtcacatgcatctaaaatcccttatattttgggacggatggagtaatatatgtcgtgaagtttcggtggttttaataatcgcatgctttgtgttagcttctcgcaggttagttggatgcttttaagcacgcaaatagaaatatctgaaatgaaaatttgaaaagaggatatgtatgaagccaaaacacaaaggctctgatgaggacatcctccactattacccgctggcaaagacgccaaagtcgggcggcgaccgtgtgagcttttgaataatcccaccttgctaagcttgggaggaggaagccaccttaaaagggagagccacccttcccctattggactagtcttttagggagattaggccttttcctgaatgggtgtgcctatgaactgttggggtccgagcaaccttaggttatttgttaaaggggtgggaatgatgaggacatcctccactattacccgttgttaaaccttgctaagcttgggaggagaaagccaccttaaaagggagagccacccacaagtcataaatatttaacgtgtatgatatgatcgaactcaatggattttttaatgattaattcagaaaatggtatgaatagatttgttttgaaaagtgcccataatatcataaacttattctgatagtacaaattttatgtttacctttttaaagtttggttaaatctttttctaaacttcgaaatattaaagacaagagggaatactgttttattattatggccaaatcttccaaccccaatgttgctactaacaactgcctctatcactttcgtggcacgtagatattctggcatgatttgattgacgagtttgaattttatccagttgtctcttgccagtaaggtttcgagtatatatattccggattatcggtccttggtggctgataccggaatttacctgataaacatttaaattcatttttttatggaggataaaaatcagtttgttttcttttcatggacctacctggttacctggcccatctggacccagctaatacttaatgggctcgacaaacgctggaataggtccacgagggtacagacgtccagcccataaaccacatcacgaaccatcagtgagttagctttacggcccatctaatggcccagaactaccttcacttgtccagtgccgcagccaggcccagcccaccgttcactgcgttgcaccgtaggtggggtccgcatcttggttcatgcggcacatgaagaaccaggtctacggagggtcctttaccacaggtgggcccccgtgttccacgccttgcactgttcacgggccccacgctcctcgtgattggcttttgcaccaaaagtggtcgatgcaccaggtctttatggaccgttgctgcaaaaatggtcagcataaaaagtcaattgaaaaaggaaaaaaaagaaagagagaaaaagttactagtagtgacagtcttgcagtcagccaaacacctctttgtttcaacctcacacttgataaggcacagtactcctatagacactgtttttcgatgttaatatcagtggatgattgatgatcaatgtattactactacgacatgattggtaagcattggatagataatattgtactacccagcagctcatgtaagccacaaccaaatctagattttgaattttttactctaggtgttatttcatcatttcatataacacattactttcaaaatctaccttattagctttaaatattacttactaaaatcataggaccgagattcaaatcctaccaattttatggtggaattgtatggaaataagatatactgtaagattagtattgttccgtcttactatgattgtagtagtattgtaaacctttgtcacggctattaatcgccatgcaaaagtatgtttcatatggttttgtttgaagaactcgagattctatgaaaccagctagggattttttttttgaaaaatgtgtctcccaactttagacttgtaaattataatctgaattttataaatactaaatacattacataatataagtcacaaccacttttttagatgttctatgcatgcatgcatgccattaactataacatattcttcattaaattactactttcttaaaaccttcactctcacactctctaactctattggatgtactccatatgcattatacatttattaagataattcaaagtacaatatgataataattatttcttgatctttccatattaagagtggctgtgtattatatagactagagggagtacgatactcgtaattttcgagttaagaatatggactagaatcccaacatttcgagtaaagctgctgccactcattaatcagagccaaagcaggaacatttatcgtctgcaacaacggcagcagagtggttaatgattaaatggacgaggtccatccagggagacaggcgtgccaatcctatcgtctcagcgtctgaccctgcctgaccagacctgaccagaccagacccgagtgactcatcaccagcagcaaaaggcaaaaaaaagccggcccgcccgaccgagccaaagcgcgcctcgtccccaccccctcacctcgccacagttttcgtctacagtatccccccccccccggccataactacg

SEQ ID NO: 12687 - DNA, 475 bp, Oryza sativa
tcctccacctccttgacaggctccaccaccttcgcctcctcctcctcctccacagccgcggccgccgccttgggggccgccttccgccccttcttcttgcgcggcttctgcttcggcgcggcggccaccacctcctccggcgatggcatggcctccttgtcgtccatcacgatccccttctcgtccatggccttcttgacacggtcacccacgtcgatcgcggtgaggttgttgggctcgacggcgagcaccttggcgacgtcgcggtaggcgaggtcgagcctgccgagcgcctcgaagcagcgcgcccgcttgagcagcgccttgctgtacctgggcgaggcgtcgagggcgaggttgcactcgttgatggcgcggtagtgggcgggggggctcatctgcatgtagcaggccgcgaggttgctgtggaggtaggcgacgtcggggtgcccccgggggaggagcttgatggcct

SEQ ID NO: 12688 - DNA, 806 bp, Oryza sativa
  unsure (1)..(806): unsure at all n locations
cacttgcacatcaacattttgagcaagcaaaactgtcatggtattatgcaattggtagtagcgtagacctggacacatggccatcatctgaagtcctggaactcttcaataaagctgaagataacatggagaggggtacagagatgtgggaggaaatggaagagcaacgcctgaagaatcggtcaaaacctagccaggagaatgtggtgctggagaagatgggcttggatgaatatatcaaagatgtatccactgatgacgcagctgaacaagcttctaatatgaggtctcagataaacattttatggggtatgctactttatgaacgttcagttgtggagtttaaattaggccttccaatgtgggaggattgcttgatggcagctattgaaaagttcaaacttggaggggcttcagctacagacattgctgtgttggttaaaaaccactgtgccaacgaaactgcccaagatggtaaggcaattttaacttactttatctcatcatgttctcctgggaatagtatatacagtgttgattttgctagaaaataccagaactagaaaattatagcaactctagtgtcattaatattgcggaacaatgaattgcaaatttctcatataccttatgtaccacccagaatatttttttcaacttcttatgtttcaaatatatatatcatttaattctcaaaagcatacgcaacttgtttctaagtttgcatcttttcttcataggtttgnnnnnnnnnnnnnnnnnnnnnnnnnnnnnnnnnnnnnnnnnnnnnnnnnnnnnnnnnnnnn

SEQ ID NO: 12689 - DNA, 414 bp, Oryza sativa
tttggagattccggcgttaggttgactaggcagcaaatgtggcaggcagtccccatttattaaaggctcttgactatttgcatgaagtacatcttgatgaacatatcccttggaagccactggaactggaagagacctgctatctgatatccttttcgtgtgaataatggcaggggccaacttcaactgattatcatttgcccttgtctcaacttgtgtacttgcagtttttaaacgatcggatctatatgcaacatctggagccttaagaaggtaatgctcataactggtgagaacatcatcaatggactcagatgtactatttctctaaagatgtgaaagaaataatgaaataaatgaattctttgctgcatcatctgtaatctcagtgagttcagaatgtctgggtccatt

SEQ ID NO: 12690 - DNA, 1116 bp, Oryza sativa
  unsure (1)..(1116): unsure at all n locations
nnnnnnnnnnnnnnnnnnnnnnnnnnnnnnnnnnnnnnnnnnnnnnnnnnnnnnnnnnnnnnnnnnntctttgatatattcatccaagcccatcttctccagcaccacattctcctggctaggttttgaccgattcttcaggcgttgctcttccatttcctcccacatctctgtacccctctccatgttatcttcagctttattgaagagttccaggacttcagatgatggccatgtgtccaggtctacgctactaccaattgcataataccatgacagttttgcttgctcaaaatgttgatgtgcaagtgcaagaaaaccttcgaaaaagtttggctttgccttcacggcttcttcatatctcctcccagccttattgtactcttcttttgcccattcatacgcttccttcacttgttcaagtaccgattcctgtggagagtctcctggcagtaacaacctcttcctggcccgagacatatgaacattaccccaatggaaaaacgcaagcgctgccatctcctggaagttgctttcagcaagttgaaacacctcctgggcttcctcagtagtaattgtgtcctcgatagcctcggtgtacagcttcatgctgacctcatggaggtccaaatactcatcagagctgaccccgacatggttcttgaaaagccgagcaaactgcacaatccagtcgtcaatgcaagtcaccgtgctcctatcctcatcctgcctattgcttctggtacttccattgtcggaattcacgtttctctccaacggcccgctgttggtgtcatcaagataaggttcatgctccggattggcctcggtgacatagagcctaagcgagctccctggctcggccaaatcctcagcccatttgagctcatcctgattggtgattgtcaccaggtcaccctctttgtccttgtacttgacaagaacagccttgagccccggaaacttgctccggacagcctcgcgaagctgtgccatgctgcagctcgccggcacctgcgcccacctgatgtcctcaccaaacacaagcttcacctgccttggtggctcctccacctccttgacaggctccaccaccttcgcctcctcctcctcctc

SEQ ID NO: 12691 - DNA, 2042 bp, Oryza sativa
cacaaatccccttcaaaattctcgcaaaaatcggtacaaccgaggtggaatcgggtagaaatcccaccttcccgcggagaaattattggaaaaaacgaagccgcgcgaggctctgctcaaaacccaagaaggcttgaagaatcccccaagaagaggtcaaaggaaggaggggacaggaagggaacaaacacgggtggtcggaacgacggaacaggtggtggaagaatctctcgggacgctgcgtgcgatgcgtggaaccaaatcaacgaacaaaccgcaaggccaaatcagccagccaaagaaactcaaaattcttgagacgagacgcgaacgtgaagaagaggaaagcgtggggggattattttggaatttgatgatgcgtgcgtgcgctgggttttccgggtatacggcatcgggtcggcgggcgcgtgtggtggcagcggcgggagggggcgccgatgcgtgagctggagtgacgccgtggaccgtggtgggggtcgttggttggcgccgattatgacctgccaaaactggtctttccgcgtagtaatgacctggtaaaaaccgcacttgcttagcttctgctaatactactttccttcttcattaggttagggtttcgtggctgctttcggtgaccagacaccgtgagagaccacctctggtggcctggcccacctcatggaatcatgggccgctctagtaccggcctgcatatcatcaggcaggctactgggcctcttaccaggctaccggttccggcccattgcttcccttcggccggttctgaacgcaacccagtcccagtgattcgtgttcaaataggctttaattatgctgctgtcaatttcaaactcatcgtgcagagtgtgatagagtttttcttgtactacgtacacagccaagaagcacatagagttttcactccatcgatctgacttgtgtaaagtgtctgcgatagaaaatgcgtacccatgagcagaagaaaactgaaagaaatcgtaaactatttctacctacgtaactgcaagccttccttgatgaggtatcaagtagcagttagcagaacgacttcgattccaaacactgacaggctctcaactctccgtgtggtacaagcccgacgcttggtttacgaacaacccaggtgccacgcttatactgattaactacccagtgcagctataaatccatatgaacaacgcgaacgtcattttgacatggggatcgagtgctagcaaacaagttgcgatgaactttgcaacgcttgtttttatctcagttaactttaaatactctcagtatggagtagttggaacaagtgcaggcagtatctgtttaatgcatggttcattcctataaatatcagtaatctcctgttccggacgaagcaatttaattaagctcgatctcagattctcagagtgccaattaagctgaccacaggttcagatcgaggcgatgatttccgctaagttgcctctcattttcgctctactatcttctgctactctcatctccgttgcaccttctgttcgtgcagctcgcctaccatcttcagtccttgtgagaggcgccggtgaattcttggagcacatagggaaggaaatcgcgaatcagttgagtgggagcagagattatccgaacgaaggtgatcagtccaacagcacccggcggggcttgtcgtcgacacccggcggggtgcaggagaaacatgtcgagcctcatgtgttcctgggcattggcacgccggcgatgaacgtcacgctagtgttcgacaccaccagcgacctcctctggacacagtgccagccatgcctgagctgcgtcgcccaggcaggcgacatgtacgacccgaacaaaaccgaaacctacgcaaacctgaccagtagtagctacaattacacatacagtaaacaatccttcacctcgggttacttcgccacggagacgttcgccctgggaaacgttaccgtggcaaacatcacgttcggttgcggcacgcgcaaccagggctactacgacaacgtggccggcgtctt

SEQ ID NO: 12692 - DNA, 597 bp, Oryza sativa
actttttatgctgaccatttttgcagcaacggtccataaagacctggtgcatcgaccacttttggtgcaaaagccaatcacgaggagcgtggggcccgtgaacagtgcaaggcgtggaacacgggggcccacctgtggtaaaggaccctccgtagacctggttcttcatgtgccgcatgaaccaagatgcggaccccacctacggtgcaacgcagtgaacggtgggctgggcctggctgcggcactggacaagtgaaggtagttctgggccattagatgggccgtaaagctaactcactgatggttcgtgatgtggtttatgggctggacgtctgtaccctcgtggacctattccagcgtttgtcgagcccattaagtattagctgggtccagatgggccaggtaaccaggtaggtccatgaaaagaaaacaaactgatttttatcctccataaaaaaatgaatttaaatgtttatcaggtaaattccggtatcagccaccaaggaccgataatccggaatatatatactcgaaaccttactggcaagagacaactggataaaattcaaactcgtcaatcaaatcatgccagaatat

SEQ ID NO: 12693 - DNA, 429 bp, Oryza sativa
  unsure (1)..(429): unsure at all n locations
gtacagtctgtctgatgcaacattaagctgttctatggtatagttgattggggacctgtagtgtgtaccaagtaaaaacatcctcaaagcaagtgggtggtacagttccgtaacctgagaaagttggaaatctttgagaaagataaagcgcaacgattagacaaaaaatgaaagttatatagtcttactttgcgtatagtgacaaagttgcccagcgattttgacattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12694 - DNA, 1337 bp, Oryza sativa
  unsure (1)..(1337): unsure at all n locations
nnnnnnnnnnnnnnnnnnnnnnnnnnnnnnnnnnnnnnnnnnnnnnnnnnnnnnnnntactccggtgtactggcccttgacaccaacatgatagccaccttggtaagcaatgttcttatcttgccttaacacagaaacaactagcgggagattgtcaagaatcctgcaaaacaaatcatgtcactttggaagatactgtgacttgaagtgcaacattacctatatatcccttacatgttcacacgatattcatcctctatcttttccttgagctcctttgcttctttctcaccaacagttaatttgcagacaatctggcacatcttgggctctctcatttgaaactgtagctcaaacaaaaagaatgatggcaaacagagattaaggcatattacttcaaggacataaacttcaaaatatgagttacccggtactaaccacatatggagagttctcaatgcgatcaccacgaagaacctcaccgagattttcagcactgtcaacgatagtttctggcttgcagaaaggaagggagtaatatgcatagggtagttgagtttttactgatgtcagcttattcaccttcacgggaagtgaatcaccctgtagataaacaggaaaggcaattataagggaaatcctggccacaaataaaatgttatgatgccctaaactattccttgttaaaggtaacatttatttggacttaacatatcaagatgcggcatggcatgtgtacacatgaaactacaagtgcaaagaaacaggaagatgagccaaaccagtctgatctaacaaatgaatcttctttggaaaagaactaagcagaacaatagttataattatgatcgatgaagcagtgaaccaatgcattattgggtgactcaccaacccaatttcagaaaccagtgcccatgcattgttctatgttaactttgtgatcatctaattccataggcaaaatcagataagctggaataaccactggacctagatacaccagaggaaaagaaggcaagcaaagaattacagttcagatcatttaagcgatggccttcttttagtgtaatggcaatggatttttaatgagtaacccttcagaagatgatcttgtggtatgcaattactgtgagttgagttttttccgagacggaacttctgcttggctcggatggccagtgcacatccgtttattgagcttaactttggttcaaaccaatggattttctcagaatcacctattccaatacaatacttgttggaaacacacacgtttaacgagaggtagtttaatgttactactcagaacaaccaaaatctgatgtcaaagtttatac

SEQ ID NO: 12695 - DNA, 1787 bp, Oryza sativa
  unsure (1)..(1787): unsure at all n locations
nnnnnnnnnnnnnnnnnnnnnnnnnnnnnnnnnnnnnnnnnnnnnnnnnnnnnnnnnnnnnnnnnnnttccaatacaatacttgttggaaacacacacgtttaacgagaggtagtttaatgttactactcagaacaaccaaaatctgatgtcaaagtttatacaaaatcaaccaaactagctatttttggcttaaatccaccattactacaagagtttgatgatgcatgcaacctacacactccaaatggaccaaatggaagtatttggaacaagcgaattgttggtgcaaccgtgtgaatcccaagctcagatatatatcccaccaccaataatcgaatcaggagtacctaacacccaaagccagatctacgagatcccatcccatcccagccatggaaccgaacccccaccccgttgaccaacgacccagatccaaacccgagcacgcgcgcagcaattcctagctcgacgaagagggggatgggatcagagcagcgattcgaaccttcccgaagtcggtgggggcgacgccgggcaggtagaacccggcggccggcgcggcggcgagcagagccacgagcgccgccgccgcggcgagccaccggagcatctccggcgctcgcatcgctcggcgagagaccatgtctcaggggtctggatctgagcgcggcggcggcgatgcggcgggggcggcggcgacggcgacgacccgcgcgcggaggaggaagaaagcttggggcgtcgggtggatctttcccggggtttttatcggatagaagtttattttttttgcgttttggaccttcaagtttcgtgtaattatgtttacagtgtcggcttcgtcgtttgaccacgtggctctgcacatgcgggcggcgtcgtttgacccggcgaggcagccgatgctggtaaattcaaattttctttttttgaaaactttggtaaatgcaaatattcaaacggtagattgtgtgaagcttctgggtctaaattaaggacttttctattttattgaaaaatcaaccacaccgaaattcggcaatatcaaattttgatatgatactaaattttggtagcattggataagttggtttagagctaaggctctgttcgctatccggcacgtaaaacgatgttcgcattaacgtgtgattaattaaatattagctattttttaaagaatagattaatatgattttttaaacaacttttgtatagaaactttttgcaaaaaaacacaccgtttagtagtttgaaaagcgtacgcacgaaaatgagggtggggagttggaaaccctggggaacgaacgtagccttaaatttcggtggaatttttggggcactcctaccgatcggttgcccgatcgaatttgagaaaaatcgggcgctgacatcagcgcccgatttacgtgcaaaaactactttaaactgatttctcttaaattacttatccaaatcatgatccgattgcaccattaaattcgttgcaattaaatcttcaaaataagaccacacatgaatatattccgatgaatttttttagcttattattgaattatttttaaatgttgcatgatgttccaacaaatatatcagaattgtttcactaagtagatcgaaaatgtttcactcatttaaatcgggtgttatttcaccctatataaaaataatgtttcagtaaatagcgaaagaatgtttcagttcactgtaacattagatctatacataagtgaaacattatgagtacactaggtgcaacatttttcggtggaaaaaaaaataaac

SEQ ID NO: 12696 - DNA, 3779 bp, Oryza sativa
caactccacctttcgcaacgccaccctcctgctccccttctccgccccgctcccgcccctcctcgcgctcttcgaccccgacacttcctccgacctcggccacgtcttcctccccgtctccgcctccgcctccgcctccaacgccaccgatgattccggcgtcgcctcgccctcgccgtcgccggagcctgttcccaccatgttcgacaactgcctccctctcgccgagaacaagtaccgtctccgttggacgctcaatgcctccgccggcacagtcgagatcggcctcgaggccgccgtgggctccgagtactacatggcgttcgggtgggctgatcccaaggccaattctcccgccatgatccattccgatgttgccgtcgccggattcaccgaggaaggtatgccattcgccgaggactactacataaccgactacagcgagtgcacgctggggaccgatgaatcgccggtattctggtgtgtgccctgacaaggtttatgatgaggggaagaatgattcattgctggtgtacggtcaccggcgggatggagtgtctttcgtgaggtatcagaggaagcttgacactggggataccaagtatgatgtgctggtgagtgccacggaggagatggcggttgtctgggccattgggaagctgcggccgccggatactctgaggccacactacctcccgcagaaccatggggggccgagggacacaacctatgggtttgcaagggtgaatttgtcggaaacggtggacagctgcaacggaccattggatgctgacaacaaggaggatcaggagaggatcatcgcggatgcaaagacacccctggtggtgacatctgctccagccgtccgctacccaaacccaccaaaccctgacaaggtgatttacatcaacaagaaggaggctcctctgctgaaggttgagagaggtgtgccagtgaagttctcagtgcaggctgggcatgatgttgcactttacatcacgtcggatccaattggggggaatgctacactgcggaataaaacagaggtcatatatgctggcagccgggatgctcatggtgtaccagcaactcctacagagctgctttggctgcctgatcggaatacacctgatctagtctactaccagtcattgtatgaaccgaagatgggttggaaagttcaagttgttgatggaggccttagtgacatgtataatagcagcgtccttttggatgatcagcaggttactctgttctggactctgtcccatgattctatatctatagcagctcgaggtgagaagaaaagtgggtaccttgctgttgggttcgggagtggcatgctgaacagttatgcttatgttggctgggttggcaatgatggagttgggcgagtcaagagttactggattgatggaaagagtgcagcgggcatccacccaacatctgagaacttaacctacgtcaggtgtaggtcagaaaatggcattattacatttgagtttactcgtcctcttaagcctttctgtagtggaagggtagagtgtaagaacattattgatccaaccacgccccttaaggtcgtttgggctatgggtgcaagctggtcaggtaacagtcttacagatagtaacatgcatttctatcacaagcagtcgccccatacgtgtgcttttgttgagaggttctgctgaggcagaacaggacttgcgtcctgttctggctgttcatgggtttatgatgtttgttgcctggggcatcttgcttcctggtggaatactggctgcccggtatttgaagaacttgaaaggtgacgggtggtaccaaatacatgtctatctgcaatactcaggaattgctataatgttccttggtgtccttttcgctgcagctgaactcagaggtttttatgtcagctcagtgcatgttaaatttggtgtcacggctctgctgttggcaggtcttcagccactaaatgcctacttccggcccaagagaccagctaatggggaggcttcatcctggaatcgtgtcctctgggaataccttcatgttatcacaggcaggtcggcaatcatagtcggaattgtggcacttttcactggaatgaagcatttaggccataggtatgatagcgagaatgtagaggagctcacttgggccttgatgctgtgggtgctttctgctatagttataacactttacttggagtataaagaggtcaaacggaggagcggcgacacaagctctagagggcactgggtgttaggtaacaccgaggaagacgattcagttgatcttttgcatcctgacagtacagacaggaattcagaatcaagtccttctggtgtgatggaggtccagcttgaacctcttgctagatgacatatatcaacatatatttatcccccagagtcagatacaaatacaccaattcctattttcacatatatgggtgagatccacaggtcgtgataatttgctgcttcacaagaatctagtatttatatggcaggatgatgccaggcaacacaagatctccaaactgtcttaaatttcctatttacattgtatagtgtacatttttgacaaatagacaggcacaatttattacattacccaagtgattctttttcagtcagtttagagataagagagggatgctagttgaggtgtttatttgcacattcgcagcatcattagctgagctgtgtattgaagagaatgctagaaaccatgtatcatatccactctgaagtcggatactattcattttgagaagaggcaaagcgattttacactattatggttgtctgtctgtgtcctgtgctctctagatacagtacatctgtcaaatacttcattctctccatatttgttgggaaatcctaattttgttgttgctgttttgtccatcctgtttctgatatgattttatatagtgggcttgttgcctgactgtttttaattaatgtttgatttcccaaataatatgactgtttactccagtttttccaaagcttcgtcacctgccaactcctgatcattaaccagctcaatgaaacgaaaacaacgcacctccagaagcaatgaagcctttgtgagttgcagcttgtaattatattatattattttgtttaccaggcgtcacacaaagaacgtgatattccttatataagatgatgataattaaagttgtaggtggtatgaccttaattagttaactagtactacttggttttaaatcgctttttgtgagattcagagatgtaacatttttttcagttgtttcgcgtgttctttgtggagtgggcagcttcccaacccggacaccacacacgcccaaaaaaaagcgctccctttcttcacgctgaaacgcgccgtatcggtcaacacttcagtggaaacgggggtaataaagtactaattctccttccataattaaatatacttccgtactttgatgaaaaatttgtgccactacgaccaccagattatttatagataaacaaaattcgtccgagcgagcgagcgacgtgcacgaaccagaccagagttcaggttggttttcgtagacgtatcaccaggaggctgtctgttggcttggctgttccagcaagtcatcaataatcatatcgtcgtcttctctgggagacccggagagtgtagcttcctccctagctgtccgcgactccgcgaccgacggcggcggcggcagatggagaggaaccagcaccgcgacggcgacggcgaccgtgagggacgccatcattatgtcg

SEQ ID NO: 12697 - DNA, 13718 bp, Oryza sativa
  unsure (1)..(13718): unsure at all n locations
nnnnnnnnnnnnnnnnnnnnnnnnnnnnnnnnnnnnnntttgagattcagagatgtaacatttttttcagttgtttcgcgtgttctttgtggagtgggcagcttcccaacccggacaccacacacgcccaaaaaaaagcgctccctttcttcacgctgaaacgcgccgtatcggtcaacacttcagtggaaacgggggtaataaagtactaattctccttccataattaaatatacttccgtactttgatgaaaaatttgtgccactacgaccaccagattatttatagataaacaaaattcgtccgagcgagcgagcgacgtgcacgaaccagaccagagttcaggttggttttcgtagacgtatcaccaggaggctgtctgttggcttggctgttccagcaagtcatcaataatcatatcgtcgtcttctctgggagacccggagagtgtagcttcctccctagctgtccgcgactccgcgaccgacggcggcggcggcagatggagaggaaccagcaccgcgacggcgacggcgacggtgagggacgccatcatcatgtcgtccaggtcccagcgtcaggtctgtccttcttcttttcttctctgttttttttcctaattgccgagcaaaacctagtgagcttcctcccttgattctaccaattctcatcgtcggtgtgaataattcgtgctcatctgcgtagttttaggacaaaagaaggccatggcactacgttttgtgtgtaccttcaattgggaaggattttctgagttatttgggagtagagtattactgcttcttgagcttggtagctactgtaaaaattaacaacccttcaaaaaaaaggcttcttttttttcacttgaagctgactccctttgcaaagttgatgtcgcagtcctaattcaactcttctatttttgtttcttgattttggagactctgatgtgccatgagaattgttgaggttgttgcggggccatgacaattgtgtgcgtgtttttcctgtagcagattttcgcgtatttttttttcttatttgtctcctgcatgccgaaagttttggatttttttttacataatacgattttaatggaaaattgcaaaaatataggtcggttaggcgaaatcgcaagtttagtaccctgttgaacaaccacgattcgacaggagaacctatcgaacatctgcatatcgacgggtatttgtcgaactgtggcaatttaacaaggtagttggtcaagaaaaaaaaatttaaaaagtacgcagagacatatcaagcaagcaaagaacgataggaggacatatcgaacaggcagtgttcgacagggatgatgctacagtgatgctacaatgtttttttctctttttttaaattattttattacctgtcgaactgataggtgtcctatcgaactacggttgttcgatagggtgctcgatttcacctaatcgacatatattttttacgatttttcattaaaatcgtattatttccaaaaaaaaattcaaaagttttgcagacctggaaacaaacacaaaagaaggtttgtttggttatacaataatgttattatgcatggtacaattgtcatgaagaattaataaatatggtgggaaaacattaataagtatggtacaattgtaatattatattttgtttttttaaaataattttggatttgtgggatccaaacaacatcattgttatttagcaataatgaaatttattttgttggatcatactagtattgcagaaatctctaggcactcaaccattcactctgttttatttctggagttactaccaatctaaccatgttttcaaatgttaacacaacgttattgttcagaaaatactcctcttcaccaagctggagctgtagacagaatccgaaatcttctgaattttattcagataatgatgaaatcttctgaatatttgtccctgtcatgaacagcagtagaagttgcagcaatggaggagacctcatcagaggcagcagatcgctctctgcgtcagaaggcagcagcgatggttgcctcctccatggagacgtaccggagcaagcccatgtccttctggctgctgctcgtcctcagcgccggcgcgatgctcacagcgttcccggcgtcgagcctcctgtcgcggctgtactacaacaacggcgggcagagcaagtggatcctgtcgtggtccgccgtcgccggctggccgctgccggcgctcctcctgctgccgtgctacctcgccggcaaggcggcgccgacgccgctgtcgccgaagctgtgcgcctggtacgcgctgctcggcccctgagcgccgacgacaacctcatgtacgcctgggcctacgcctacctcccggcgtccacggcgtcgctcgtcgccgcgtcgtcgctagcgttctcggcgctgttcggctgcgccatcgcgaagaacaggctgcggctgtcgtcgctgaacgccgtcgtcgtcataaccgccggcgtggtgatcatcgcgctggactccgggtcggacaggtaccccgggatcacgggcaggcagtacgcgctggggctcgtctgggacgtgctcgggtcggcgctccacggcctcatcttcgcgctgtcggagctggtgttcgtccgggtcctcggccggaggtcgttccacgtcgtgctggagcagcaggcgatggtgtcgctctgcgccttcgcgttcaccaccgtcgggctcgccgtgagcggcggcggcttcccggcgatgcggcgggaggcggcggcgttcaggcacggcgaggcgtcgtacgcgatggtgatggtgtggtcggcggtgacgttccagctcggggtgctggggggcaccggcgtgctgttcctggcgtcgaccgtcctcgccggcgtgctcaacgccgtgagggtgccggtgacgagcatcgcggcggtgatctggttccatgaccccatgagcggcttcaagatcctgtctctgctcatcaccgtatgggggttcggctcctacatggttggccactcctctaccaagaaagcatccacaaattgatgtactcttattgttcttctcctggaacatgaaaaatatgtgaactgagtatgttcttgtattgaccaatgctgctgtgctctcattctcctgaaaacatccagtgcgttctgcttctgcgccaaatattcgatcatcgtccagcaaggacacggagagggatgagtagcgagagatggacgttgcaggtgaagaggttggggttggggcattgcgtcgaacagctggcgggctgttgggcgcaaggtgaccagactgcctcccatatgcggcatagcacgtaggagtgaaaacggtacggaaacggacggaaaccatctttatcgttttcgttttcatattttttttcagagtcgaaatcggaaaccccggatacgaaaacggaatcgaatattatcgaaaccgaaaacggagcgaaaatgaaccggcgcgaatacggtaacgaaaatttatcgaaataaaaaacccatcaaagtgataaatccaattgaaagagtaatgttgttgataaattccaatgtaggacaaaaaatattcttatgtaattttagatttgcataacacatattttttataaaaataacagccaaacaccatggtattcactatttagtgcttaaaaaaagaatccagggtattttagtcacaaaatttctagtacttctgagaaaattttcggaaagtttcggaccgattccgagttccgacggaaactgcccttatcatttccgattcagtttccaagaaaatatttccgaattcgtttccgttttcgaaaaaattccgaccgacagattccattttcgaaaataggtccgaatccggaagttttcctaatagcacgccgttgttcatagtgttaagcctaaggccttgtttagttttcaaataaatttgccaaaaaaacgtcacttcgaatctttggacatatgcatggagcattaaatatagattaaaaaaactaattgcacagtttacataaatcgcgagacgaatcttttgaacttaattagtctataattagtcatagtactataataacccacatgtgattagccataagtgctatagtaacctatatgtgctaatggcgaattaattaggtttaataaatacgtttcgcaattttcagaggagttatgaaaaatttagatacctcaggaacttaaaattccctcaacatgatgtggtaagttgaggatgagctagtggagaatttcggttcagagatgactgtcagaccctgggacaaatcaagggacctctagtgaacttattctattccacaaaggagaatcgggccgcaatgttaggcagcccaggtcaggtcgccgccgccgccgcgtcgtcgtatccttccttcaaccaaccctcgcctctaggcagacgcttcgcagaggcaaaagctcgaacacatggcgcgcgccctagtccgccgggctctctccctcgccgcggcggcctcctccccggcgaaaccatccttctccaccgtcgtcgcgccgctgcgctccccgatggacgaccgcctcctccgcctcctgcgctccgagatcaactacatctccgaacgccgccctccctacccggtatcctctcatcctaacgtgcctatcccccatcttagctctctctctctctctctctctctgtgtgtgtgtgtcttctctgattcgccgagaaacgaatgcgttgcagccgccgaaggccttcaaatcgttcggggtggaggaccgcccgggggagcagtgggtgcgcctccgcgccacccgcggcgcccaggacgaggaggtcaaggtcgacgccaccatgttcgacggcgccgccgccccgcccccagacgcgcccctcttccgccgcgtcgagtcgctcgagcgcggcccgcgcctccacctcagcctcatcgtcgaggtctcccgggcggaccgcgtcctcggcttcatctgctccgcctggcacgacgaactcgtcgtccgccacgtcctcactctccgggacgccgatggctccagcaccagcagcggaggccgcgacttcgtgtacggaagcttttgtgattttgctctctggtttatgtggtctgtgatgatgttcctcttctgtgaatgattcgcagcaagctggaggctagggagagggagtcggtgaggaaattcttgcaggagagggaggtggatgacgagcttgccgagttcttgcacgactacatggcgaacaaggaaaagatggagcttctccggtggttgaagactgtcgaatcattcgtcgagaagtaggcacaggagaagcagataaatcaggtgagattgttaattcgtcgtagatacatttagaactatgagattaaagacacagcatagttttacagttaataacttggaagggatgggcagggaatccaatcccttggttggcttggcttggcttggctccacgctttcgagaagaagcacacagacaaaatcacagatactagttcttaactctttgagtgaccgagctcgagctaaaaccctactacagttaatgactgaacctgttttcctccgcaatgcttgttgtagtaaagaaatggtgaggaggtaagaaatagttgctgatcactagtaaggaaaaatacagtaatttcataggtagggattttgaaactttaattttattgatgtctatgatgagtttaatccaactagtctaaatggagaaagagattatagatcaataaagttatggctgtcaattttgcagtcaccagaaaatttggagaccctgaacattttgtcttggcttccttttctgttagttgagtcatacgacctgtagactgtagaacaagtggtactagagtaggcaggacattcaattatcaagattctaaaaggtggcaagggctattgtgttgtcacctgcattgcagtgcttacagccttacatggcatagctggcctattgtgtggcttaagcagtacaaggttaggatcccgttccttgtgcggccctgtaaatcttgttttagaacattgttattgatgcactgagggtactgagttacagccagatgttggttctgaagtttcttcctatcaatcatacagagtatggaacaggcagtttctttctggtttttggtggatgaacatgcagtttcttaggtagtgtatctgtcagagtaacccttctacacaggccagtaggttaccattggtaatttctggcaaggctaataatctataagtgaccttcatatataagttcccaatagtttctagtaaggcgagcatggacatatttaagtgaccttcgtcaataagcagtttacatcactggcatagctggcataatgtgggcatagctggcatattgtggctcaagcagtacaaggttaggaactaggatccctttccttgtgtgcgaccttgtagaccttatgttaacattggtattgatgtactaaagatactaagttacaatcatatgttggttctgagatttcttcctatcaatattcaatcatactctagtatgcaacatgcagtttctttctagttttggtggatgaatatgcagtctcttaaataatgtatctgtcagagtgtgaaacgatattaactctttcacccaagccggtaggttagcatcgttaatttatagcaaggccaacaatccaatatgacgtccaagagcatggacatatttaagtgaccttcatcagtaagcagtttacattactggaatgagatttggtaactatatgtgcctgatcacctcatttacattttggagtgtcctatttcaaatcaagtaggagcatcaacaattagtcttgttcatcctttttatcaattaattacccctgaattaacaatcagtgttgtccatttgtcattgtaatttggtttcctgaaacctttgaagtctgaactccattttgcatttgcaggagttccttgctggtatccgcatgactctggacttatttcaaagttcaaactatgggaactgaaaacaaatagcgtctgggaagtgatgataagagctgctgtcctacacaccatgtaaattatccacctcagtggttcaatcccattgttcgtgctgtatgactctagcaatgagctgggttttcagcatattctgtggttcaattctagtcacatttgagaagatcactaggcacgctcgtctgattatattggtgctatggagcactaccatttgctgtggaatacagacaattcttatgcggttggttgtatggcaattgctcgcctattcatttttattttaaacaatataagtagatctcctactgtgcttgttttgaattgctattggttgtattatcgccggtggtgatttgcttgtgcctgacgatagcctgatgtctggtaaggccactcgagcaatctgctttcctgatcagatcaggcggtggacgtctcagatcgatctgtagcatatgaactactccctccgattctattttaattgacgttttggacaatgacatggtttacaaaatatatctctgaccttatttttctattataatatatacaataaataaatgtatgtttacttttattatagtgctttaaaaaacaaatctatatatgttgttttagttgttttaaactaaatatttttaaagttattaatggtcaaagttataaaaatttgatctcaactatgtccaaaacgtcaattaatatagaataggagggagtatgcgtattggcgaatacatttcgttggcggaggaggtcaagtcgtggcgaacgaccactctccgcaacaaactctattatctggtttcatgaaaatggagcagcgggcttcccctgctatttctgaattgtagagtaggaaaaaaatatttctgaaacagaattataaattaaatcaatatgttaacaccaggctccaaagacaactctctgaacgatcaaacagagtccaacaagagcatgaacatatccattcaaggcaaatctaaaatgtagacatgcagtcatgcacaataaccaaaatacataacgggcatgcttttcaacagctagctctaattaatttatgcccgggcattattttcaacagctcaacttaatttataataatttatgcccgggcatgattcataacagctctaattaatttatgcccgtttagtgcatgcatggctattccaagtccataggaataacgctgtcttcagtttcgtctttagttcccataccagatccagtatccagttgcaatggctcatgcaagtcaataggattatcgctcctgctgattgtttcacccagccgcttgtgaggatattgcatatgaaatttcaaaggtctcttcaggtttccctttacacctgcacccagtaaaacagcaaaacaaagggcccatgaattagtgcatatagcctacacacaaatgtacctaacccttcatcccaagccctatgagagtatgacaaaaagaaaacctacgagagcatcaaccaatttagttcaagaatgtttaaaaaatgcaagagcacctaaaatggtcttctctctctccactttgttgggggcagaaaaattgtttctgttttcatttctgacaatttcttttaaaggctcactttgtttatgtgtatgttcttgatatagcgtgcactgacaagaaaattttcatatgaaggcaatctagaatccaaaatgcagttgcatttgactgggtttgtgttccacatagcttgcatgtcatgtgctctctacatcttgtctggaactgtactctataacttgtctagaatctcaccaaaggcttccataattagagaggtaaagagtctagcgaggttcaaaataattccagcctaaactaacaagtccaactagcactatagcagcagccacacaggtttaaaatacatcagcaatcacaactttgaatcaggtttactgtcgtatgcaacacaaagttaccgaaaaaaaaagcaataagtagaaagaacagcgcaagaattaagtaatcacctgcagctgtagtgaaatattgggagatggtagactgcgtgtaggagtaatcaaagtcgttgatgatcctctcagcatcatacacagacaccatttgaagccttttgttggccatgtcaaccatcaacaccaccgccttctcgtcagaggcgtcaaccttgcccatgacgtacacaacattagcatccgtcaagctgagcgtaggaagagctacctgcagctttgccatggccgggcgaccctccagcttaggcaggagctcgacgttgcaacaagtggcgtcgaccgtgatgtcactagaatctaccatgaagcccttttgccagtccttgctgttgtccagatgagccaccggtttgctccatgtggacagatcccaggaccagcaatcagtgtctgaatcaaagaaagtacgcagtccgacaatggtgagaagaccattaacgatggcaatgtcccggcaaagaagctcattcgagagctggtgagctctggcggcagtggcaggtaacttccaggacagccatgggcgagcacgttgcagatgtggattccccgcttgagatcaatgaaggccactactccctgtccatcatcatccagagtaattaccctgctcgtattatagacgatcatttgacgcagctggggtagaaggaggctctccaggctccacttgccatcgccatggatggtggactcgtagaggcagagtttgtaagctgccgtagatggtgtgactcgatggaggtccagatccagagagcacgacggaggagggcaatgttgtggagcgaacgcaggtaatccctctgtaagctggcggcgtcgacgtcgacggggtcccggatgagcgtgagcgaagggcggccaccggcgcggtagacgaggtcgtagactacctcgctgtagaggcggaggaagacgaggtcggcgttgacgcagcctacgaggggctcattggcgaagatccgggcggggtcgccggtcgggcaccaggcgcagatgtaggagacctgcggcggtggggcggtgaagatggtgatctcgattcgatggccattgccgagatcggccgcggcggtggtggcgttccggcggtcggcgatgtaggcgcggacgtcgaggaggatccatggtagaggctggtgtgcatccagagggtccccgccatggcagggcgggcgcagagtgaggtgttcggttttattccacatatagcggtcgacggtagccatggctgaggcttctcctcccgccggcgatcgtcgtccgcccagctgggcttagcttaagtagagcagagtagaggagtcggagtcggagacgacatgcaaatcgatctcagcaatcacaggcaagttggaatcggaggacgaaacatgatttggataggaacggattgccggcgaccgacgatccgcacgatcttccgccgcgtcgggtcactcgagcatggcatggcccgcgcatccacctcagcgtcatcgtcgagttgaggtcgattgatttcgcgctctggttcatgcggtttgtgaattctgtacgctgtgaatgattcgcaggaagttggaggttgaagagatggaatcggcgaagaaattcttggaggggagggaggttgatgacgaacgagccgagttcttgaaaacaggtgagttttatacagtcttaactgactgagtttgagcttgagacgtaatgcagctaattgactgaacctatactttcctgacatttgcctgaccacctcattcacatttttggagcatcaacaattagtcttgttcatcctttttatcaattcattaaccctgaattaacaatcagtgttgtccatttgtcgttgtaatttggtttcctgaaacctttaagtctgaactcccttctgcatttgcaggagttccttgctggtatccgcatgacttgggaactgaaaacaaatatactccaggcgacggttctactccacatgtagtggtcgacggtagacatggctgcggcctctcctccagccggcgatcgtccgcccggccgggctagcttaagtagagcagagcagagtagaggagccggagaggtttaaccatgatgattttttttgacaccttaaccatgatgatttggaatcaagacaagttggaatcggcgaaagatgatttggatagaaacggattgccagcctaatcaaagacgcagcatagtttacagtcttaactctagtacagaaatggtgaggaggtaagaaataatcgctgattacaagtgagacaaaatgtgtagtattttaatatgtagagattttgaaacttaaattttcttgatgtctatgatgagtttacccctgactagtctaaatggataaagagataatagatcaataagttatggctgtcaattttgcagtcaccacaaaatttgatttttggagaccctggacattttgccttgattcccttttctgttgagttgagccatacgacctgtagactgcagaacaggtagtactaggaaattcaattcctttgatcattttttatcaagattctaaaagatgtcaagggttatgtgttgtcgcctgccttacatggcatagctggcctattgtgtggcttaagcagtacaaggttaagatccattcctttgtgcggccttgtagaccttgttttagaacattgttattgatgcactaaatgtatactgagttacacaatcagatgttggttctgaggtttcttcctatcaatcatactccagtatggaacatgcagtttcttaaataatgtatctgttagtgtgagacgttaacccttttacccaagcaggtaggttagcattgttaacttatagcaaggccaataatccaatacgaaattcaggagtatggacatgttttaagtgaccttcatctataagtttacatcactggaatgagaaattcggtaactatatgtgcctgaccaccttgttcacattttggagtgtgatatttcaaattgagtaggaatatcgacagccaatctagttcttttataattcattacccagaattagcaatcagtcttatccatttgtcattgtaatttgatttcctgaatgtttgaagtctgaatgttcgagttccttgctggtatcagcaagactttggagatagtttcaacctgtgggaactgaaaactaaggctgcaggcctctgggaagtggtgttaaaagttgctctcatacatgccatgtaaattatccacctcaacagctcaatcctattgttcaagccatgtatgactctagtaataagatgggttttagcttattcagtggctcagttctagtagaaaaactgcaattccatttgagaaaatcactaagcacgctcatctgattatattggtgctctggtgcactaccatttgttgttgaatacagacaattcgtatgcggttggttgtatcgcaattcgtatactaattaatccaactccataggattattcccatcttcagtttcatctctaattttcgaaccaggtccaccctgccgcttgtgaggatattgtatatggaacttcaaaggtcgcttcaggtttcgctttaaacctgcaaaccagtaaaacggcaaaacaaattaagtgcccatgtgttagtgcaaatagcctacagatacatgtgcctaacccttcacgccaagtcctatgaaagtatgatatgataaaaaaaaagtcctatgagagccaactttgaatcaggtttactatggtattcatcacaaggtttccccaaaagaaaaacaagatgcagaaagaaaaaaaaacaggccaggaatgaatcaataactttgtcccgtgctgatctttctttgattgtaaataacttttatttctcataatgtgaaaaatgcgtcactggcgtattcccgaaaaaaaaaaaagagaatcaatcacctgcagctgctgtagtgaaatattgggaaatggtagagtgcgtgtaggcgtaatcaaaatcgttgacaattctttcggcgtcatacacagatacctcttgtagcctcttgtttgccatgtcaacggtgagcaccagtgccttctcatcggagacgtcaaccttgcccatgatgtaaacaatgtgggcgtccatcaagctgagtgttggatgagctaactggagcgtatccgttgtcgggcaaccatcatccagcttgggcaggaggcaggcgttccgagtgctgttgtcaatcgagacgtcactggactcgatcatgaagtcctcacgccattcatcgtccaaacaagaactgactggcttgctccatgtggtcagatcccaagtgcagtaatcgtcatcgtccgaatcgtcatcatctgaatcgaggaggtaaagactcagtctgacaacggtgagacgaccattgacgatagcaatgttacggcaaacagatgaattgtaggtcctgcgggcatcgatgagctccggtggcagcggcatgtagctgcctcccactggtgtgctgttgtcgagcacgttgcagatgacgatgccccgccagagatcaacaaaggccactagtggttgttcatcatccaggatgaacaccttctccgttaaatggagaacggtatctttgtctggcgcgttgcgaagttggtcaagaagaagg

SEQ ID NO: 12698 - DNA, 1803 bp, Oryza sativa
  unsure (1)..(1803): unsure at all n locations
nnnnnnnnnnnnnnnnnnnnnnnnnnnnnnnnnnnnnnnnnnnnnnnnnnnntcaagaagaaggatggtgttgctccatttgcagtccatggaatcgtcttcgtcgtagaggcagagcttgaagtggccaagatcgaagcggcgatcccgatcgagcgagctaacgtagaagcggccgctgccatcatgatcgtcgtcatcagcgccggcagcatggcggcggcggtcggggaggacgacaacgttgtcgatacgacgaaggtaatggtatgggttgtaggggttgtatgggttgtggatgagcttgagcgatgggcgagagctggcatggtagatgaggtcgtagatttgatcactatggacgcggaggaagacgacgtcggcgtcgacgaacccgacggcgggctccttggcgaagaacacggcggggtcggtggtaggggaccaggcgcagatgtaggagacgagcggcggcggcgcgatgcagaatgtgatctggattttgcggccgttgctgaggacgatggtggcggtggtggagttccggcggtcggcgatgtaggcgcggacgtcgaggaggatccatggaagaggccggtgatcggccgcatccccgccgtggctgctgggcgggctgagagtgaggtgtttggttcttgtaaagctgtaggggaaggcggtagccatggctgcggcctctcctcccgccgacgatcgtccggccgggcttaaagtagagcagcgtggaggatcccgagtcggagtcggagaagatcgagatccaaatcgatgtcagcgatgcaagttggaatcggagggggagaagtaaatcgatttcatcgatcggaggtgcttaaaatcggatctgcttatcttgaattgctatggttgtattatcgccggtagtggcttgtgcttgacgatagcctgatttctggcaaaggccactagcaataatcttctttcctgatcagatcagcctatgggttatgcataattggcgattacatttcgttggcgaaggaggtcaagtcgtggcgaactaccaccctcaaactctattttgtggtttcaagaaaatggaaagcagtgggcttcccctgctatttctgaattgtagagtacgaaaaaatatttctgaaacagaattatagatgaaatcaatatgttaacaccacgctccaaagacaactctcgatctgaacgatcaaatacagtccaacaagagcataaacatatccattcaaggcaaatctaaaatgtagacatgcagtcatgcacaacaaccaaaatacataacggggcatgcatgattttcaaaatttcaacagctctaattaggccttgtttagttccaaaaaatttcagagttgctagaaatatggcgccatatgttacagtcgatttttttttagccacttacaccgtagttacacctcatttacaccccacttgcatatgtaattagtatgtaattttcgaatttacatatgtaattttagtacttacatatgtaattttgagacttacattgtaaatacactaaaattacatatgtaatttagggacttaaaatgtaaatacatgccgactatttttcgatgaaaaatatggcgccataaatatagctacactaaaaaattttgcctaaaaacgtcacatcgaattttttgacacatatatggagcattaaatatagataaaaaaactaattgcacagtttgcacggaaatcacgagacgaatcttttgagcctaattagtccatgattagccataagtgctacaataacccacatgtgct

SEQ ID NO: 12699 - DNA, 649 bp, Oryza sativa
acggtttggcatttcaaatggaagtaaagcaaatgtataagctattcggagcaaaatgttttcaccatcatttttctccatcgtgtgtttctgttcatacttgttaaagattcatccagtattgaaaggtatgcttgtgcttgagaactctgcttctgttgctggatctattgcttatttactggtatcggtcgtaatctatacgtaaattttccagccaattgccaccgaggttggctgacgtggcgaggacgggcccacaaatcagcgtctcgcggcctccgcttcttcgcccacctcgcgttcgaaaaaaaggaaagttcaaagcgagaaaacgaaaacagttgcacacacttgctcctctccccgtgtccgctcgtttgctccggcgtcgcgtgtccgcgtgctcctctcctcttcacgaaaaactctccgcaacaccaccacgccggaaaattcccaagtccacactcctcatctctctctctcgctcgctcgattagctcggttccaagccgagcaggagcgacgcgagcgagcatggcggcgtcggcgtcggcgtcggcgctgcaggccgagcggtgcctcctcgtcggggtcggggcggggccccggcggcaccggctccccctccgcatgcccccgccac

SEQ ID NO: 12700 - DNA, 503 bp, Oryza sativa
gagtggatatgagtttctgtctgacagaagatagccaagttttacagttttattacatcatacatattttgttctcgagtcagctgatatggtgcaacattttgcctatttttttacctgcagagtttactgcgcgatactttttagaaacatcagtacaaaatattgtgtgctgattcattttttgaatgataatacggtttggcatttcaaatggaagtaaagcaaatgtataagctattcggagcaaaatgttttcaccatcatttttctccatcgtgtgtttctgttcatacttgttaaagattcatccagtattgaaaggtatgcttgtgcttgagaactctgcttctgttgctggatctattgcttatttactggtatcggtcgtaatctatacgtaaattttccagccaattgccaccaaggttggctgacgtggcgaggacgggcccacaaatcagcgtctcgcggcctccgcttcttcgcccacctcgcgttcg

SEQ ID NO: 12701 - DNA, 1223 bp, Oryza sativa
  unsure (1)..(1223): unsure at all n locations
ggtttcaatagtaggggggcgtagaatgtccggtttttaagttcgggggtgtaattcggtcaacctcgatagtttagggggtaattcgtactttttcctattggattctagattgtctttatagataaatatttttccctgtcagtgcacactatatcaataacatgcacataaaaaaagtgagcatttaaaagaaatggtcggaaatgaaaatagaaacaagatttccgccccaacaaggtagaaagagaaaagaccattttaggtgctattgcatgcgtgaactaaattggttgatactcttttttgtttgctcgaacacattggtgatactctgataggaggacttccattttggtcaccctcgtcgcgtgaagggttaggcatattaatatattatatatgtactcctctgtttttaaatatttgacaccgttaactttttagcacatatttaaccgttcgtctttttaaaaacttccgtgtaatatgtaaaactatatgtatacatataagtatatttaacaatgaatcaaatgataggaaaagaattagtaattacttaaattttttaataaaacgaacggtcaaacatatttaaaaaaattaacggcgataaatatttagaaacggagggagtaatacgtaggctatttgcgctgacacatggggacttttgttttgctgggtgcaggtgtaaagggaagcctgaagagacctttgaagtttcatattcaatatcctcacaagcggttgggtgaaacaatcaataggagcgatcctatggacttgcatgagccattgcaactggatgctggatctgacatgggaactacagacggaactgaaggcagcgataatcctatggacttggaatagccatgccttttgagtgaaactaaatgggcataaattaattagagctgttgagaatcatgtccgggcataaattattatagattaatttgagctgttgaaaatcatgcccgggcataaattaagggtgtgtttagttcacgaaatgaaaatttttgtgtgtcacatcggatgtttgaccggatgtcggaaggggttttcggaaaaaaactaatttcataactcgcctggaaaccgcgagacgaatttattaagcctaattaaaccgtcattagcacatgtgggttattgtannnnnnnnnnnnnnnnnnnnnnnnnnnnnnnnnnnnnnnnnnnnnnnnnnnnnn

SEQ ID NO: 12702 - DNA, 1814 bp, Oryza sativa
  unsure (1)..(1814): unsure at all n locations
nnnnnnnnnnnnnnnnnnnnnnnnnnnnnnnnnnnnnnnnnnnnnnnnnnnnnnnnntgttaatcctacctgaatctcacaccagctacctagctagcattgccattgaacctccgacgacgactagctactcgaccgatctgagctttttcatggcaggccaaccggccgggcaaccccgctggcgcagccagagggatcagtatcagatactctacagtcgacgcctttatcactaacatatagagccgatgctttgttactgacatgtggacccagaactcatcgaactcacatgttagtgataaatctaattaaggtaaggtgcactcgactacagaggatctcaatcccggccagaggcagaatccattgtattgccgtcgccgccgtggtgctcgtcgatctgatacgtgcgatccaatataatccgccacccaagccgcgtacatacctttgggctttagctatggaacaaattaagctctcaaagctgctgcttatacatttccggttgcgttataaaaggccactcctaactaatgaccatctatccttcgaatataagaatgatgagggcaactcccaaacagcagaaactaaagaagaaaaattaaatgattttctgtgaaaataccacagtacatagataagtatgcatccatgtgaaataattaattagcagctctccggtaattaaagaattcttgtggcgaaatagagtcgtcggatcgatcatcaatcaaatcatttgccgtttagagacacgttccatcaatcaagcatcaaaacctaactcaaataggagtatatatatgacatatccttgtcgaccaaaagaaaaaccgacctaactcgatcaggttcaggtacatactaagtactacagtactcctacaccacttccattaccattagcgcgccgaccaaccgtacaaatatatattcccaatcaatcaatgaatatcgatcgagttcgatatataaaaaatccgatcgatatatatataaatctatcgaccggtccatctcaaaggacgacaaagattcggtccggcgagcaagaagccaacaactccatcgtccatccaccatccgtcagcatccaatcctgccctggtatatgcatcgaggcttcgctgcgcgagacccagctgcgcagcatatgcatgcgacaccgtacgtaccacacacctaatcccatatgagatcgagagtgccccatatggtcagctgcatatgccgtcttatatatgcttgccggtgcaacaagccaaccgcgcccggccaccaccaaagacaacaacaacacccccccccccccaccccaccccacatgtgtgtacccctcctagctagcatctctctacacatgcgccgctcagtgatggcgcggtgtaagtccctgtttaggagagtttctacggtttctctctgaatctctaacttattcaaatagtctatctatagattctcgttccgattctaagaactcataactgtagagaattaaaaaaatataaattaattggaagtcaaaaattctaaagatatgaaactcaactttgtaaattttgatttttgactagatgattggttttacttctgttgtttcttagaatctcgagctttccaaatagaacctcgcggccgcctccaaaccgcatacggcattgtgcagtcgagcggggggcggcactgtacaagctagccggttggcatcaatgtggcacacaggaacacacggaattcccttttttcagagaggcatgcattatatatgcaggacgcgcgcgtttatgctatgtagggat

SEQ ID NO: 12703 - DNA, 502 bp, Oryza sativa
  unsure (1)..(502): unsure at all n locations
nnnnnnnnnnnnnnnnnnnnnnnnnnnnnnnnnnnnnnnnnnnnnnnnnnnnnctgtactgttcaggtagccgataacctgtcatgactatcttgtctgcaaacatcttgccggtctttggcataatatgccagtgcattgtcaggttaaaatcctttcctttgaggttgcttccctgcaacccaaataaaaagatgagggtatgaaatcaactgtgtgaatgaataatgtgccattgcaaatatttagataaatggttgcaacctacattcagtatgtaatcagcaaagaacagaacaggatatcttcacaaaagaaaaaaaaactaaaaaggcgagactaatacagtcaaggcatatagcaggagtcaccacccaaaagctgttggtgaaaaatctgtgctcggtgcttaggaccaaccactctaccctatgttaaaacatcactaaggaaaaagtgagccttcatnnnnnnnnnnnnnnnnnnnnnnnnnnnnnnnnnn

SEQ ID NO: 12704 - DNA, 220 bp, Oryza sativa
atctctttacgttttcctttgccaggtctgtgttctgtgtggttatggaggtggagctatgacaagggcattgaaagcccagaatattctcaaaagcttgctgaggggtattgcaactgcaaaaagatcagataaatatgtttattcatcaggaaatgtgaacagtgagtgtacaagcaagttacatggggaatatgtcaggcatgattcatttaatgga

SEQ ID NO: 12705 - DNA, 2080 bp, Oryza sativa
acttccatttgaaatgccaaaccgtattatcattcaaaaaatgaatcagcacacaatattttgtactgatgtttctaaaaagtatcgcgcagtaaactctgcaggtaaaaaaataggcaaaatgttgcaccatatcagctgactcgagaacaaaatatgtatgatgtaataaaactgtaaaacttggctatcttctgtcagacagaaactcatatccactctaccgaatcatgcaggccatctgattcgtcagatgttctcttgattttctctcaaaacctggaaaacatcgcagttcctcatgaatggatcatgtggtgatgggtatttgaaatggtcactccggagcttttgttgcgcagatcatgtactggcaaccaccccttgctcagaaagaggtacagatggcctccaagttgttccgtcaggaccgtccatgagggcaattccaacagcagccaattcttttctgatttcatcggatttttcatactgttttgcctttcttgctgaagtcctttcttcaattttctgaagcacctgctcctctgtcatggaagctcttcttagtgctttttcccgcagctgctgcagagcctgagaacagagaattgttagtgatgtccggtgtgtgaaggagaaaaggtttggctaatcacagtcatgtttactagagtagaattataataaacagagtgcctatggaaagtacaacttaaataccgtgttggaatttgattgcgctagctgccctgttctgggcacggatacattaattaagcacctataacagtggttaccacagtatctctttcatttccaaaggaaacacaagttttgaagagatacatttgtcctggctattcaacagtatgacagttgaagctcaaacttgaataaggctgagtggtaaaccaaacctgaccctctattgccttttactttctggaaacaggaacttaacaaaacaggaaaagaaaatggcaggaatccagttccatttgttagcaaaaaaacaggttgtactggttggttctttaagatataaaatttgaatatcttgattttgcatatttgaggtcggatacttgagtagacattgcgtggagtttaagggggtggaatataccctagaagacaaggtttaataaaacggcctgctggtgtggttttctcaacttgtcaccggacagtaaactgtgactttctgaaccttggtttattgaataccataatgtctatgacaacaaaatacaggagatgggctatacaagtgatcgtatcaggacagacaatgcatattcacagaggaaagaaacaaagtgtgttcttcaacagacaacaaaatatattcaaactgcttgggcagagttgataaaacataggctatgttacatagcactcacctcataatagcttgatggtagtagccctaggacagaaagcaccatccttattttctcttccatagcagaaagtgattccagccgtttttcctgcttctttccctgctcaaatatcagagaaagattgaaacattaggtatgattttagtattttacttgtggcgtgcgagcagatcaaatcatagatccctgaaagtcactaactgtatctccacaaggttttcattcgatttaccttacgagtatgcagcaagtcattcataacttttaatggctcagaaatagcagccagtgctactgaagtgtgaagatcatcagacattgaagtctcaaattcatcatggagcttctggatacaatttgtagtattaacaggtaatggatctccagccttgctttggtgctgttgacaactttcttcacaatcttgtagtgtctgtaaattaaaaacaaaaaacataaactctttaattaagagttatggcattgaaatatctcctgaagaaacagcaaaaatgcagcatctccctttcagtgccaccaaaactcaaaagttctgactagtcattcaaattgaagcagcttcccagtctccaggcataaaggttaaaccagaacttaagtgatcttgctttggctagagattgagaagcagcaaaagccagggctgcctg

SEQ ID NO: 12706 - DNA, 2679 bp, Oryza sativa
ttaggtatgattttagtattttacttgtggcgtgcgagcagatcaaatcatagatccctgaaagtcactaactgtatctccacaaggttttcattcgatttaccttacgagtatgcagcaagtcattcataacttttaatggctcagaaatagcagccagtgctactgaagtgtgaagatcatcagacattgaagtctcaaattcatcatggagcttctggatacaatttgtagtattaacaggtaatggatctccagccttgctttggtgctgttgacaactttcttcacaatcttgtagtgtctgtaaattaaaaacaaaaaacataaactctttaattaagagttatggcattgaaatatctcctgaagaaacagcaaaaatgcagcatctccctttcagtgccaccaaaactcaaaagttctgactagtcattcaaattgaagcagcttcccagtctccaggcataaaggttaaaccagaacttaagtgatcttgctttggctagagattgagaagcagcaaaagccagggctgcctggtcagaccatgcgtgcaactatagctatactaagatgaattcagtgctaccctgtgattctaaatttcgggccaattcacaaccagtttttaatcagctaagacaaaaaaaaaaagttcaatggacatttcaatttaagcgaaccgacttttatttggagtactgcagcttagccaagacaagtgcagatggcaagttgtatggggttaaggaatgaatcatggtcacagactcacaggccatctgaataatgatatatttggctttcaaaagataaaaatatggttcatctaattaatatatctatagactaaatgtgtatcttaatcttgtaaatgccttggcataaacataacctacacttgttctcacaaaaaaaattaagtaatgttactaattcatgcatgccaatttaaggtccagtgtcattccctctttagtttttacagtagcatagacacttttggaatgtgaatttacagatgcttttaacaaggcaagccaaagtacaaaggcctgaataagtcctagaagccaaataggctcaggatcatctttccaccaccccaaggtccggcccgactgttttgctggtagaaataaagcataaggttagtaaaactaacatggatataagaagatataatatacctggtaagtgtagtacagtctgtctgatgcaacattaagctgttctatggtatagttgattggggacctgtagtgtgtaccaagtaaaaacatcctcaaagcaagtgggtggtacagttccgtaacctgagaaagttggaaatctttgagaaagataaagcgcaacgattagacaaaaaatgaaagttatatagtcttactttgcgtatagtgacaaagttgcccagcgattttgacattttctggctgtttacattgacaaagccattgtgtatccagtaatttatgctgctgtcacaacatgctgcacggctctgagcaatttcattttcatggtgtggaaagatcaggtcctccccaccgccatgtatgtcgaaagagtggcccaagtaatgtgcactcatagcactgcattctatgtgccatcctggccttccagggccccaagggctatcccaagatggctccccatcttttgcagcctggagaaacataaaatcagctaatttgaaactgaactctctaaagaaatcttgaaattaaaataaataatttcctcatagaacaagagtacataatagatacacaaaaaatagaagaaatctacaaattgagaacaagacataccttccaaagagcaaaatcagctgggttcttcttcctctcatcaacagcaaccctttcaccagctctattatcatctaattttcgaccagataaatccccatattcagggaaattttcaacagagaaataaacatccccgccaattgcatatgcacaatcattatcaatgatctgttccaagaaatgtcatagataaaacatcaagctgggcagcacataaaacaattatattgcacagagaattcaatagcagcacaatattgtcaatcaggtgcaactgttcgtaactgcatatatgtgataacaatcattttcatattttacatgcttaccattcttaataacaaattgcaaatttataatttggaattggatgttctctgtacacggatcctatgatgcattaacaatgaaagaaagcaacacattatcaggtatcgatttaatggtgtgtgatgaatcatctctttctagatagtagtagtcaaaataaggaactttcactgcctattacacgaaatggtggatttaataggagaacaacagaaagaactgcataataataaaaattaagcaccataggaaaaacaccaatgatccatactgcatgcatattttacctgtttaatcatgtttataatctgatcaatgtggtctgaaacgcgaggctccacagatggtggtaaacaatgaagattagccatgtctgataggaagtcatcagagtaccttttgcttaagctaaaaggatcttctcccaattgatttgctcttgcaattatctacagaattccagaagtgcaactcaggtatcctgtgcagattagcaattggcatataaattttctttctaggtttc

SEQ ID NO: 12707 - DNA, 4735 bp, Oryza sativa
  unsure (1)..(4735): unsure at all n locations
nnnnnnnnnnnnnnnnnnnnnnnnnnnnnnnnnnnnnnnnnnnnnnnnnnnnnnnnnnnnnnnnnnnnnnnnnnatcccccccacctcgcggttctcctatgggcgggtaattggctttgtggttgtagaatgcggggggtttacgaggggttttgctcgattccccgagccgaacagagtttagtttggggatgatttcgtgtagctcgattcgtaggatcggtggtgtccggcatttgtttttttttcccttgatgaaatcgaaatgcagtgtagtgtggagttgatttgattggtgttctactgttgaaacggagatgctcacatggcgtcgttctactgtgtccgtgtgcagattgacagcgccagtctgcgccacatcctccgccccttcgccgcacagggagcggcgccgccggagcagctggccgcaagccatccgagctcgcagtacggccagcccgcgagagcggcgccgagcacctcgttgcttgctcaggtggctgggaaccatccccatgccacccatgtttcggaccggaaggcgttgtttggcatgctcaatgcaggcaatgctgctaatgtcattgatcttactcgcgcttccccgctcggaggcgcggagcctctgcccaagcatccgaggcacggcttggaagccagcagcagcgttgagcagccctcctgcttggggccgttgtttcagaacacaagtgcaaatgtgcagggtagttttccaggggaatgttcagttaacaatggtattgttccagtattccaggagtctcagtgacatgatttctgtcttcctgctgcagtcttttactgttagtgcttctttggacatgcagggatatcccaaggcgccatccagtttcaggactcgagcacatgcgcagtgcagaaattgccatcccaatcaacccctcgccatcatcctgcgcttctaggggatcagatatgcgtctcctgtctgaatgttggtgggttcaacttgcaacaatatctgcaacctagatcgactaccctctgtcatggtctcatgagggaggtagtcattgaatggctagttacagtaagcatttttaccccttcagaaacctgtgtctgcaatggcctaaatagagaacccagccattgaactatgtacgatgtgtggtgtgcaatcaaaagttctacacccatggaaataaaagttttctgcctcttgcttgtactgttgtacagcatgtagtcctcaaattactgctctgtgttatagcttcataatatgggttctgttgcttaatttggtagagattttaatagtgatggagctcttattcacagttattgttaattattattagaacaattcgatattttttatggtaaaagtgttcccacctgctgcttttaaccattatgatcatatattactttttttactaaagccttctgatgtgcttttgggatatgaacaggtggtgaattctttgtcggtgaagctgggatttttggagttcgttgcttttgtcaccggctgagaatgtctgtggctaagttctgtgaggtactatacaaatttatgattgttacgctgattccccatttaggcactactacagatgttcttactgataaaaggtatgtatatacacattttgtagcattcaggaggacccgcagaaaaagctggtgaaattgtcattatggataatggcatgactattgtacaatggctcaagtactgcatgggggtgagcattttatcttgtttcggttaatctgttaacttttagttggtccaagatatgtagtttaagggtaagtatttggtaaaaatcacatactggatttgcttgtttaactctaaaaggtaggcacctagtacaataatagttgtgccagcagccagtttgatatgagtcacaaagtgaaagttggcattggttgcatttttattttacataatggaaatggattacatctctggcctctacccgtaggcacagccaagcattggttgcatattaccagatagaaataaagtaactctttttttaacacatgtaaaaacccaggctaagttctacataagtttatttctggttgtcctttactgtgtcacatatcatctggaggctgtattagcagcagaaaaaagaagaagaagaagaatgctttagtagtattttctgcattatattctggaaaatatcattaaatgtagtctgtggtaacaggtacatatataaatttttaagtttttctttgtttaagtctacaaatgaggcattgtaaactcctgtattatagccttaaggatacagagatagtttccatcagagattggtaactcacaagtcacaagtcacaactagtacatgtcatgcaatacaactgtgtatttgtattgtgttgcatcttgtaagtattttacatattttgtgaatgaacaacagaaagcttattgaaatacattttcttcacacatacacttccagcctgtcccaatcatataacagccactctatatcaatttttttccttcttgtttacatctaggttggagcatccatttctgacactaagtgggactggccagaatgggcatatatgagatattcttcagaagaatactggactaaaagtctccttacaacgaacaataacatggaaaaaacagggctattcagtggacatggaaaaagcactggacatataaacaatccagtttattccagtgatatccacaatgaggttggacgattcacttctgttgagaagctagtgaataagccagatgaaacattttatagaaagagtgtcggtttacatgaagctttctcaaagaatccagctatacagcagagttcgaaaataaacttagcaaatcatatgatccatgacatgaacatgaactctattagcaggccaagtgaacgaacatattcaacagcaaacatgggaataacttacagtagaaatcatttggcacatgattatgcaaactttctggagaaaaacttaaataacttgtctcgtagtcctggtcctagttctacaagagttttgagcaatgacagtagggcatgcatgcctgatgtacctcacaaaataattcaagatggttcaggtagagcatcaaacaccgaactgaagctggggcaatcatcttatcatcaatctatggctaccctatttccatcggtgcagtcgacaataatcgaatttcagaaacctcagcaccacctgcaattcacaactccaagtgagctttcctgttattagctgcaaatgtaattgttttgttatccacattatcatttgggtagaatttaacttgtattaactattaatatggcacatccacacatgtgtagttctgtttgctttctcgctagatatgcaagagcttgttaattgttatgctaggtgctgactgaatacacaaaacgacaaaaacaccataagaagctgctagtactagcacaatgaatgtgaacaacaacatagttctggtatgattttataacacattaacaccatagaagaaacacaattttgcttagttcttttttttagtgtaaaatgagagcatttcccctgtaatgttcatataatgccagaatcacttggtgcagatgcttatccgaagcaaactaccaaagccaacaaaactatagaaaacattgagccatcatttggtacaggtaataggaaacgatcacttgatgtttctaatggaaccagccattctgaactcaatgagattacagatgatgcagcaaagaattcatttatttcattatttctttcacatcttgagagaaatagtacatctgagtccattgatgatgttctcaacagtaatgagcattaccttcttaaggctccagatgttgcatatagttccgatcgtttaaaaactgcaagtacacaagttgagacaagggcaaatgataatcagttgaagttggcacctgccattattcacacgaaaaggatatcagatagcaggtctcttccagttccagtggcttccaagggatatgttcatcaagatgtacttcatgcaaatagtcaagagcctttaataaatggggactgcctgccacatttgctgcctagtcaacctaacgccggaatctccaaaatttgcgcagaagtttcttctccagtgaattgcaggtgttgtaatcatgttgctgacaaatcccatcttgcacattctgagactggggctccctgtttttatgatagaacggtaagttgatcttacactttctcatagcacaagtaaccactgtcaccactgccaaccaccaaaatgtcttttgattcttcaagcattatgtgcaggccaggagatatatttcttttgaatgtgctgatgacttgtgcacacataaaagtttgagagctaccaattatcagtgtggaagagccttttgttctacagctaatgagtttctacctagctttggccaaaatgatcaatcgccaataggaaaatcaatgcatagatgctgttgcaaagctcaagaagattcttccaaacttggttttagagctggcaatttctgccgatctcatttctgtaatgatggcactccagttccagcccataagtctattgttgaaggttggtttcttcacagtgcaagtgatatgatagacatcacttcttatttctgattattttcttgaatgttgtcttgttttaattcagtggcacactttctcatattt

SEQ ID NO: 12708 - DNA, 6388 bp, Oryza sativa
  unsure (1)..(6388): unsure at all n locations
acagcaagggagtcgattgcttgtccgcaaactgccaaaatatgtgtctctgaattgcattgtaaatgaaactaacagtgaagatgcctgtagtgggagtgccagtattgattctagtttgattgctacaggaataactaatgataatcggaaatctcccaaaattgttccactcaatctgattcttaaaaaggctaagagatgtcatgctatcaaacccctcagtaagacagaaaatatccatttttctgaggaaaagagttcagatggttctgcagataaatcttcctctggtgacagaagtttcagtccacaagatgaactgtggtctcccaaaaagaataggtattcatctaatgtctcgaggccacacgtcaagactgactgccaaagtccctgctgtggtataattctgaaaactgcattacagatagtatcaacatatagctaagtaacttacagtgttccttttagaaaaatggaattgacaaaagaatctttctttttcagtacttgaagaagatgagcctcttagccttgcagatatggggacaagtcagctgtcagcatcaagaagtagaggtaggagtctaggacaaggacagccataacatatttggttagatttttttggttatttattggaaaatttgattccatttttgtcaaaatgatgcactgtgtgacattacagattaactagtaacatggtcattagttgtcatctttactgaaaaactgcatcgcatgcatagcaaacttctcatttgcttaatttccacatgagatgctaaagaagttttaccaacacgatctaccaaccatatgcaggaagtaagaatcaaagagcatgcatatctcttaataggatggagaggtgtgaagaatttacaaatgaatcagcatgcagtccttgtggcgataaacacgctgcggttcaagcctgtgtaacaaaatttgaaaggttgtaactccaggtgcattctacagatttcctttgaaggatatgttccatagaaaatatttcgtttttattaatttatcttgcttttacagactgatctgacaaagttctgcataataccttatgcagatatatacaaaggcctagtttagatgcttcatgttgtgtttgtggtatctcaaacctggagccttccaatcagttgatagagtgcagcaagtgctttatcaaggtttgtcatattcccttaccagaacctagtactggagtctattcacatagagccttgcattttttttttctgtaggtgcaccaagcttgctatggtgttctaaaagttccaagaggacaatggttctgtaagccctgcaagatcaatacccaggacacagtaagaaaattcaatttcagagtagtttcatttaaggcatttaatagggcatgatgtagccatgtaggccagaacagccatctttgtgcttgcagattactgtgtgcaagcactatagaatttttcactgattcttttagggctatttgtagaatgaagcttttattgaaatcaagataattacatcaaggtgatacaaccatttagggatacactgctggtatagatgtatggacgctgcactagcatggaaaatacttcagtcaaaattaatcttactaacactaacatcctcattgttagatacatttagtagtgattaattgtatatcggtatctctttacgttttcctttgccaggtctgtgttctgtgtggttatggaggtggagctatgacaagggcattgaaagcccagaatattctcaaaagcttgctgaggggtattgcaactgcaaaaagatcagataaatatgtttattcatcaggaaatgtgaacagtgagtgtacaagcaagttacatggggaatatgtcaggcatgattcatttaatggacacagatcaagaagcttcaatgctatatcttcttttggtataaaagaagcttcaataggtagtgcacgtggggacattatcagcaagtcgtggacctctaatcgcaattccagtctacttggtccacgaacaaggcagtgggttcatgtggtctgtgggttgtggacacctggtacaaaatgcccaaatacaatcacaatgagtgcttttgatatatcaggggcttcacctgccaaaagaaataccgtgagttccctacatgcatattcttttgaacttcattgaaaatatgtttcctgtaaattgaaagtgcatccaatgccaagtgctggcattggccatgggtttcctttcatcctgcacccgattatttagtcctaatgaacttaatcttcattattgctaatgtttttgttgtcaggaatgctcaatgtgtaacagaactgggggctcatttatggggtgtcgtgatgttaattgctcagttctctttcatccttggtgtgctcatcagagggtatgatatccactcataataagctatttgacctatatattatcacattgatttactgtatgctcataagaaatattctgcaatcttggttaaaacttattgttatctcaacactgtaaatctgaatgttgctcatgatatcacaatagggtttgttgcaaagtgagccagaaggcgagcataatgaaaatgttggtttttatgggagatgcctggatcatgctatgcttgatcctaatcatgttaatcctaagaaggaatgcttgaggagcaatgactggacatgtgcacgtactgaggtaatatatttgttttacctttgtactgcttgaaaaattagaatcctaacaagtgacaacttcctttgtcattcttctgaaacaggtttttagaggccgaaagggagactcatttggtgctaatcgtagcaggaaaccagaagagaagtttggtgagtgcagtgtttcccaagaacagatcaatgcttggatacgcataaatggatcgaaatcttgcatgagaggacaggtaacttctaatccttcactgcaatgcagttggttatcttcaatatagtacattgtaatgtactctgctttagcggggtatcaaagtttgcatgtacatactggatgagctgtttacatgtcttcattctcatttttagaaggaatatgtccactacaagcagttaaagggatggaagcatttggtagtgtacaaatctagcattcatgggcttggtctctacacatcggagtttattccacgtggctctatggtaattcatcagttattctttccttagtcgataatctgacacaagaatttagcaaatgaagaaattgttaacttctgcatgaaaatatttcaggttgtacagtatgttggtgaaattgttgggcaatgcgttgctgacaaaagagagattgaataccagtccgggaaacggcagcaatataagagtgcttgttacttcttcaagattggaaaggaacatatcatcgatgccacccgcaagggtgggatcgcaagattcatcaaccactcttgccaagtaacaaataatatgctcatctgtgtcttttttcgtccatctaaaactgaatgtttctaatgcatgttttgttttcttccaatctttgctggatcagccaaactgtgtcgcaaaaataatctcagtaaggaacgagaagaaggtaccccttttctttatttcgatgttgtcgtttcaaaatattcgccccagccctctttctttcctggcaaatttatctgtttctattctaatgtgtttttatcattgtccaggtagtgttcttcgcggaacgccacataaatccgggggaggaaattacctacgattatcacttcaaccgagaagatgaagggcaaagaatcccctgcttctgtagatcgagaggctgcaggagatatctgaactaagatagtgtacttcggtcgtatgtttgtagtgctgtttaaacattgtaatgtgcgcactgtatatatgaataaactgtagggacttaatctggcactgataatttagacatccaaacttaaatttagaatggatttagaattaatttagacttcctctcccgtgctcggcagcaaaattggaagctacttgccgctgctggagaaggccactgaccttgatagaacccgtaactcgttgatttcccgggacattgttgtcgtaggtactgggaattgtgctcatggaacaagctcataattcatagaaaattcatacacaacctaggtccaatataacaattgaaccttaaagtacaacatcagtaacttggaggtaaaactatcacagaaatttccaacacaaaagaccaattacattcactcgcagtatcaatcgtagcttggagtcaagaaaggattcttctcgtcatagaaagggtttgtgaaatgttgactgctgctaagactgtcatggacgttacccttcactgcagcctgatgctgagagaatgctctcgggttgaaattttcgtcatggctgtctccgaatgcaacccagccatcaccgccgccggtgatgtccctctgcttctccatctcttcgacgtgctccttgaactctttcttcgccacgttgatcacgttgtctccgtgttcatcgcaccatgccctgcaaaaacagatactatcatctcagaatttctgaaccatgtctgttaaatctgaatgatgacggaattgtgaagttttcagtactttgggaagaaggtcttgaggtcagatttgtccactggaagccttgttgagatggcctcaatttgttgatccctacaatgatgccaggacatacattttacacacttcaaacaacagtaattgatcaaaaaattcattggcaaaacagacagattaaaacttacgaaaagttcaagtttcggttggtggatgacaactcagcctgaatccttgaaagctctttctttgtgttctccaccaaaaccttcagtaagttcagatacaaaaagctcagttcagtccagtaattctgaaactaccaagtaccaatcaatggacacctgcacaatctgtttactgaaactaaacacgatggagagatcaaccactttgcaataccttatcattcgctaaatcggaagcagaatcatcgtcgccggtggccgtattcagcttcttcttggctctctttgcatccttggcaacagccgggctcgcctcaagccggcactcactgtacgaagaccgcggcgcagcgtgctccggccgctcaccgccggccgtcgcctcatcgttgcttgccttcttccacttcttgaggccatcgaacccccacgaactcttcttcttgctctttgacgcatccttctcctgatctgtgccttccatggacgccgccgggggctccttgttctcgctgccattgccgccgttgtggaacatcgccgtcaggtgcctcctcttccccttgtcggtcttggcggtgggcatggcttccgacggcgagctctcggccatgaggacggatggggcgttcttgctgttgttctggtcgacgggggctaacggtggcctcgatgcgtccagctccttcttgcctctgctcttccatggcgggacgaaggccttgtgcttcggcttgtcggaggccgccgcggcgggcggcgggtcccggaggtcgatctccgaccactcctccatggaagacgacgaggctggtgccgccgccgaagccgcgccgccatcgccgacgtccgcgtcggggcagtcgaccacgacaccgaacgccgcgaggcgctgcacgagtgggctcttggtggagttgtactccgccgccgagatgcacttggcgtacaagagctcctgcaaaaggagaagggagaagcgttcgatcaattgctcgctcggattggagggagggaggtagaagaagaagaagaagaaggcgatgcgggtgggtagtacctgcagtaaaaggagcttgtcgcgaaggatggcggcctggtctgggtgggcggtcaagggcgggncgtcgccgagggtggcgagcatgtcggcgcggaaggcgtcgacgtcggagggcgggacgatgccctcgcggtggagcgcggagaggtggaggatgcggtggaacgattcctgctgccacttgagcgcgtcggcgtggcgcctcgccgcggcctggtcggcggtgaggcggctgccggacctgaagccgccgaaggggaggatggacttgcacagcgacgcgatggtgtcgtgcaggcccgagtagtacgtcggcgtgtacgtgtaccccatcgtcgtcggcgactcgtcggcggcgagctgctgctgctgctgctccggtggctgctcaggcgaggcgaggaggggagcgtgagagagagagagagggagatggtgnnnnnnnnnnnnnnnnnnnnnnnnnnnnnnnnnnnnnnnnnnnnnnnnnnnnnnn

SEQ ID NO: 12709 - DNA, 5789 bp, Oryza sativa
tcctcctatgatttttgcatcatgcaaaacctatacgcatgcatgcatgtattgataacagctagatagacagatatactgacatactgtagtaatgtctggctaaacaatttcattctcagaagatagataggattcacaaaccgcatgaactagacgtacgggctccgacttagggtccaaataggatttagtttggctacatctttatttttttttctctttcataatcggaaacctgactctagtatcataccttctattcatcttcacacatagatagtttttctatctaaaacgaataaacttgtgtgcagatcgccggccatggctaccgtcttcccctaccgttggactaaaaccaagcatctcaccgagcgtccacccacccacggccaccctcccgacgctcacccatggatcgtcctcgacgtccgcgcctacatcgccgaccgccagaacgccaccaccgccaccacctctctcaccagcggccgcaagctccagatcaccatctgcgccgcgccgccgccgctcgtctcctacgtctgcgcctggtcccccaacgccgaccccgccctcgtcttcgccaaggaacccgtcgtcgcctgcgtcaacgccgacctcgtcttccttcgagtccacagcgatcaagtctaccacctggtctaccacgccggcggcggtggtgacagccgccgccgccgcccttcgctcacgcttgtccggcaccccgaccgccccttccatcgctgtcattaccttagtgagctcggcagcattgccatcctctcccgccgccgtgccggtgccggtgacgaccacgacgacgactccaccggcttctatgtctgcagtcttgatcaggagctatggtatgggttacctggacaacgtggccacttcaagctctgcctctacgactccatcgatggcgaatggagccaggagacccttcgtctcgaccagctgcgcaatccgcaggacaaagacaccgttttccattacacggagaaggtgattactctgcacgatgaacaggtagtggccttcgttgatctgtggcgaggcatggtcatctgcaatgtcaacgatggcacctgcaacaacgtcgagctcctgccgaagctgaacggtctccctgccatggataagctgcggatagctcgtcctatgctcagcttgatggattcgcatgtcgtttacatcatgggcaaggtcaatctctccggcgagaaggcggtggtgctcactgttgacatggccaacaagaggctgcaaggggtatctctgcgtgacgctgaaaggatcgtctacgatgataacggttgcagctacaaacagtataccatctcccaatatttcactacatctgcaggtgattgattaatccctggcctgtttttttttcctacttattgcttttcttttggagaaatcttgtgtcgaactgacgagacctcacctgctttcaagaactcggctcgttcgtcatcaacctccctctcctccaagaatttcttcaccaattccatctccttagcctcaacttcctgcgaatctttcacagcaaacaaaccgcatgaaccagagcgcaaaatcacaaaaatgtccgtacgcgaagtttgtgtgtgtgtggtggggggtgctccgttgccggcgctggatcaggacgagttcgtcgtcgaagcgagggcgcgtcgatcggccaccggcaatccgattctatccaaaccatcttccgccgatccgatttacttctcccctccgactccaacttgcattgctgacatcgattcggatctcgatcttctccgactccgaatactccacgctgctctactttaagcccggccggacgatcgccggcgggaggagaggccgcagccatggctaccgccttcccctacagctttacaagaaccaaacacctcactctctgcccgcccagcagccacggtggggatgcggccgatcacgggccccttccatggatcctcctcgacgtccgcgcctacatcgccgaccgccggaactccaccaccgccaccatcgtcttcagcaacggccgcaaaatccagatcacattctgcatcgcgccgccgccgctcgtctcctacatctgcgcctggtcccctgccaccgaccccgccgtgttcttcgccaaggagcccgccgtcgggttcgtcaacgacaacctcgtcttcctccgcgtccatagcgatcaaatctacgatctcatctaccatgccagctctcgcccatcgctcaagctcatccacaacccatacaacccctacaacccataccattaccttcgtcgtatcgacaacgttgtcgtcctccccgaccgccgccgccatgctgccggcgctgatgacgacgatcatgatggcagcggccgcttctacgttagctcgctcgatcgggatcgccgcttcgatattggccacttcaagctctgcctctacgacgaagacgattccatggactgcaaatggagcaacaccatccttcttcttgaccaacttcgcaatgcgccagacaaagatatcgttctccatttaacagagaaggtgcttatcctggatgatgaacaaccactagtggccttcgttgatccctggcggggcatggtcatctgcaacgtgctcgacaacagcagcacacctgggggaagcagctacatgccgatgccatccgagatcttcaacatccacaacacctacacttcatccatttcccgtgacattgctatcgtcaatggccgtctcaccgttgtcaggctgtgcctttacctcgattcagatgatgattcagacgatgatgatgacgacgattgctgcgcttgggatctgaccacatggagcaagccagtcacctgtttggatgatgagtggcgtgaggacttgaagatcaagtccagtgacgtctcgattgacgacagcactcggaacgcctgcctcctgcccaagctggatgatggttgcccaacaacggagacgctccagttagctcatccaacactcagcttggtggacgctcacattgtttacatcatgggtaaggttgacgtctccgatgagaaggcgctggtgctcaccgttgacatggcaaacaagaggctacaagaggtatctatgtatgacgccgaaagaattgtaaacgattttgattatgcctacacgcactctaccatctcccagtatttcactacagcagctgcaggtgattgattaattcctagccttgttttttttttctacttttgccttttcttttggggaaaccttgtgatgaatatgatagtaaacctaattcaaagtagtgataggggaaactattttgatccctcgaggggatatcaatatctttgtcgtttgcatgttactcaaatggttattaaaaaatgtgaaaaaatttgagaagatgtattaacgtgtgatatatcacgccacaaacattcaagttaaaattcaatttttacatctcgcaaggaaaaaaaataaattaaactatacaactagttaatgtatattcacagacaaatttatttttttcgttgcgagatgtagaagctgaatttgaacttgtatgtttgtggagtgatatatcacatgttaatacatcttctcaattttttttaatttttttaaaacaatttgattaatatgcaaataatgaggggatatcctctcaaggatcaaaatccactcccgttgaccgttgtgatagctgatatattgtgtgtggctgctgctttagtgctagctagacaagttgaggccgtaattagtgtgaacctcgccaaactctttattacccatctaatcatggaagccgtcggtgagcttccaaacaagttatagagtacagttccagaaaagttgtaaatttcatgagaattaatgcaagtcatgtgggacacaaacccactcaaatacaactgcggcatattggattgaaaaaagtacgaattacctctctaactatcaaggtcgaccgaaatacacctacaaaatcgaagaccagatattctacacccccaactattgaaaccggataaataccccgtgtctcaatccggagcggtcccacatgtcagcctccacctcatcctccctctcttaagaagctagttggccccgcatgtaagctgctccctcttccttcgtctcctggccgcagagatgcctgtgccgcctccaggctccagggacccgcaccgccgccgccaggcacctgcgccgccgcactcatcttgaagcccgcctccttcagtcggtcgtcgtcgccgttgctcccatccaaccgctggagagagagcgagagaggaggggaggggaggggagaggagagagagagagagagagagagagagagagagagagagagaggagaaaagagatgccaaccggcggcggcgacaccctccagggcaggcgggtaaagcgacagactccttcacttcggccaaggacccccgccgcccgagttccgtcggagtggccccgtctccaccaccgccgacgccgaggtccagacttcgctcccccctgctacgccgtcgccagaggatggatgctgcttcaccgcctcgatttcctccgccgatcccatcgtcaggaggccaccactgaccgcgccagcaccggtctccatcgccgctaggccgccgcttcaccacgaccgccaccgctctgcctggctgccgatggcctctcctctcccttgtgccacatctccgtttttctctctgcctcccatccgcgcccgccgccgctcgccgccgaccgttcccctccccgactcgcccgctgccggccggagccgcgcccgctgccgctctcccagccgctcccgtcaacgctaacagcatcaacatagaggatgggagggcgccttccacctccgccaccggctgcccgggcgagctccgcctccgcctcagccgcccgccgctcggggagctagctctgcctccaccggcggccgcccgctctgcctccgcctccgaactcgaaaaccgaggagctccgcctcagccgcccgccgcccgaggagctccgtctccgccgccggtcgccccctccgccttcgtttcagccaccgtactagtgagatggtgaggggagggaggagagagagaggggtggggatctgacagtgggtcccactaattttttttaagagagggaggatgaggtggaggttgagcaggatgttattttgaccggtttcaatagtaggggggcgtagaatgtccggtttttaagttcgggggtgtaattcggtcaacctcgatagtttagggggtaattcgtactttttcctattggattctagattgtctttatagataaatatttttccctgtcagtgcacactatatcaataacatgcacataaaaaaagtgagcatttaaaagaaatggtcggaaatgaaaatagaaacaagatttccgccccaacaaggtagaaagagaaaagaccattttaggtgctattgcatgcgtgaactaaattggttgatactcttttttgtttgctcgaacacattggtgatactctgataggaggacttccattttggtcaccctcgtcgcgtgaagggttaggcatattaatatattatatatgtactcctctgtttttaaatatttgacaccgttaactttttagcacatatttaaccgttcgtctttttaaaaacttccgtgtaatatgtaaaactatatgtatacatataagtatatttaacaattaatcaaatgataggaaaagaatta

SEQ ID NO: 12710 - DNA, 940 bp, Oryza sativa
  unsure (1)..(940): unsure at all n locations
atgacgattcggacgatgacgattactgcacttggaatctggccacatggagcaagccagtcagttcttgtttggacgatgaatggcgtgaggacttcatgatcgagtccagtgacgtctcgattgacaacagcactcggaacgcctgcctcctgcccaagctggatgatggttgcccgacaacggatacgctccagttagctcatccaacactcagcttgatggacgcccacattgtttacatcatgggcaaggttgacgtctccgatgagaaggcactggtgctcaccgttgacatggcaaacaagaggctacaagaggtatctgtgtatgacgccgaaagaattgtcaacgattttgattacgcctacacgcactctaccatttcccaatatttcactacagcagctgcaggtgattgattctcttttttttttttcgggaatacgccagtgacgcatttttcacattatgagaaataaaagttatttacaatcaaagaaagatcagcacgggacaaagttattgattcattcctggcctgtttttttttctttctgcatcttgtttttcttttggggaaaccttgtgatgaataccatagtaaacctgattcaaagttggctctcataggactttttttttatcatatcatactttcataggacttggcgtgaagggttaggcacatgtatctgtaggctatttgcactaacacatgggcacttaatttgttttgccgttttactggtttgcaggtttaaagcgaaacctgaagcgacctttgaagttccatatacaatatcctcacaagcggcagggtggacctggttcgaaaattagagatgaaactgaagatgggaataatcctatggagttggattaattagtatacgaattnnnnnnnnnnnnnnnnnnnnnnnnnnnnnnnnnnnnnnnn

SEQ ID NO: 12711 - DNA, 1061 bp, Oryza sativa
tttgaaatgttaacatgagacgaaatcgataatcttttggcaatttataataacatttgctgatttgtgtacaacttaaagtcaagaggatgaaatcatgggctggccttattattagctaagtgatttatttgtttccagtgcaatttcaccagataataatgcatttcccccctacacagttattgaagctgattcactgcttgagacagaagtggaaacccttgctgaagctctggaaagtgccaacaacgctgttctgtcaactattagcatgatatctatcatgatgtctgtgagtcttaaatcccttattttttgtgtttgtatacaaaggatcacattttactgttttaatcctattattcttgaataccaggggttaaatcagacgttccggagttcgattaatgctcaaattatggaagtccatcctgatgaactaggacaagtaacctcatgaatatctttactgcttagttgtatgatctgcacttatctttttcctgatacatacaactgtaacagctactcagaagttatggagaagccagaattggatttggtgctggttataacatccagtctgcaattaaacaagccgtcttccactgtccgtttcttcgtggtggaatcaaggtccatatgatcatctaattttaacttttaatcttacattgatgctcacccactttttatcaaaagaaacaggaaatggaattttagtcttgtgttgatatcctcatatacaaatttacctgtgcaaaacatcacaaatgctatacatttatacctctgcaaaaatgttgttgtaaccaacaaatttcagactttagaaccatcaaatttcaagtgtgtggccacttggccagctaacctgcataagatgattgcttacatattttggtaactataagttgggctgttgatatttatttcttataattaataagtacatccaacgaaagtaagcaactacgctgcacacaagaaatagattcataatacagtggacataatttctcatgactgcactacataagagacagatccttggagat

SEQ ID NO: 12712 - DNA, 602 bp, Oryza sativa
ataaagctgaagataacatggagaggggtacagagatgtgggaggaaatggaagagcaacgcctgaagaatcggtcaaaacctagccaggagaatgtggtgctggagaagatgggcttggatgaatatatcaaagatgtatccactgatgacgcagctgaacaagcttctaatatgaggtctcagataaacattttatggggtatgctactttatgaacgttcagttgtggagtttaaattaggccttccaatgtgggaggattgcttgatggcagctattgaaaagttcaaacttggaggggcttcagctacagacattgctgtgttggttaaaaaccactgtgccaacgaaactgcccaagatggtaaggcaattttaacttactttatctcatcatgttctcctgggaatagtatatacagtgttgattttgctagaaaataccagaactagaaaattatagcaactctagtgtcattaatattgcggaacaatgaattgcaaatttctcatataccttatgtaccacccagaatatttttttcaacttcttatgtttcaatatatatatcatttaattctcaaaagcatacgcaactt

SEQ ID NO: 12713 - DNA, 983 bp, Oryza sativa
  unsure (1)..(983): unsure at all n locations
nnnnnnnnnnnnnnnnnnnnnnnnnnnnnnnnnnnnnnnnnnnnnatagtagtgatcggtaacctttctcctttgcacataatactttagcacatgactaattacatattagcttaaaaactttaaaaattagttaatataatttttatagcaacttttttataggaaaattgtaaaaaatacatcctttatcagttcaataaacatgtgtccgaaaaatgtgggagtagaagttggtaactggtactaaatataaaaatgtgggagtaatatataacacaccctcaggccgcgttattttcagcggttgggtttggatgattagctacacgtaaaacgagaaacgcggttagcatttaattagttaagtattaattattaaaaatttgaaaaataaatttatttgatttcttaaagcatcgtttttatagaaaattttttgtacgaaatacaccgtttaataatttgaaaaacgtgctaacgggaatagctaagctgcattagctgtttagaacgcggagaggggataagttcacatctactgtgggcttagggcatactccctccatcccataaaaaaccaacctaaaaccggatgtgacatatctactacgaatctggacatacatctgttcagattcatcgtactagaatatatcacatatggtcatagatttgttgtttatgggatggatggagtactcttaacaggtccctgccatgtggaccctacctgcagcagcctgagggaaataaaaaaatatccaaagacaaaaacaattcgatccagtagcttgacacccccacccactagtcgacgccctcctctcccgtgcacgaatcacgagactcacgaccaccaccctcggttcggtttttgaatcgtccttcaccattggaggaaggtgacgcgtcgagggccccctttcccggtggccccacattgcaggctcacgcccccaaaaccctagcgcacgaagcga

SEQ ID NO: 12714 - DNA, 216 bp, Oryza sativa
tacctccagtttcttgactaattctgatatgatgaaatgaaattagcagcatgatcatctccttccgtcttctattgttttttttcttctctgtgatgacttcagttcatgtttgccgggtccagtgagccgacgtggaggccggccgcgccatggcgcggcggccccattgccgccgagccgctgatgccctggacgacgccgacgccgaggaag

SEQ ID NO: 12715 - DNA, 1930 bp, Oryza sativa
  unsure (1)..(1930): unsure at all n locations
aagtccgcgtcgaagggcgcggtgtggttggcgttcgggcacacgtgggccgacgacgacgccaccagggccccgatcgcgaccgcgagtacggctaggcggagggcggcggcggccatgtccgcggccgcgggggagggatcgagatctggagaggaggcggcaacgcgtggagtggagggatctggaagcggagggggttgggttggttggatgagttgagttgagttgggctcgctcgcttgctcgcggctgcggcttcggcggagtggggcgaggcgaggcgagcgggcggggtgaaggtggggtgtccgagatccactttgggtggtggactgatggaggccgtgcgccgcgtgggaatgtgcgatgcttcgtaggaaaggtcggaaggaggcagtcgcaaaccacttgaactgttaagagaagaagaccattttatgttctctcgagaaactttgaccattttatgtcctatcaacaaaagtttggtctatctcaaaaaaaaaacaaagttttggtcaatttatttgtttgtttgtttattgttgaaactgaatatcgatatcactttttacagaatgtagaaaaacaaaaaaaaaacgaaagtgataaattcagtgagcacaaaaatcgacagtagattaccttgagctagtatgtgtaaaaaccaggaagattttaatttctatatcatcttcagtcggttattgattttgactctgaggctgccactcaatttctcttatccaagttttagaagatgactattgtaaagcaaatggggtagtattaattggaagcattagctaccgtggtacacatagtatggtaactccgaaagtattggttttgttcaacatagcaatagacgtagatcattcttttgcgagagatgttctgtggctttgcacatgtcatcgtgctatgttttgtgacactagaatgtgcgatgttagaccctggtttaaactagtgctcctatatgatattgcctgtgggatgattatttgaagggcaatgcatgtgcgatgatttgatggttaatttgtaaaccttatttgtagaatagaaacggattaatccactgaataaattctagtgctcctcttgagaaaatttgaactcatgtgtatgaaataaaaatatccctaaaacaatgtaatgtgtctcaatcatggtatcatgaacccatcattcaaattttcactcgagatcgcgatatatgaatggagggggaaaaacctggtaggctcatttggcagctcgggttaccggcccattccccggatgaaaggcccacgggctaaattacacgcgcgtttggaagcccacaacagtcgcgtccacgcctgcgtcacgccgcagccgccgcgagatgccgccgccggccgggccgccggagtaactccggtaaactcaatcgattgctttggagcaaaacttgggactgactacgtgaaagattgtctgctcaattgaaaaccggtaaactctcacccggatctccatgaattggattttattttttcaggaagtaggaacttctgtttttagattggcaaattatgtttgttcacatttattagtttttatattaatattatattttcaagatgataatgaacagattccatgtagacaagttatattgctcctttttttttttgactacagacatcctatgcttggttagagtaaatcctctgatagccctgttttgggctgggacttaatatgtgaaaattttgccaaagctacatgttacatgtatatttctgtaggccattaaaaccaactggtttgagtcagagtttcatatactggaagcaatactggatttacttgataaccaatcactggaaacaannnnnnnnnnnnnnnnnnnnnnnnnnnnnnnnnnnnnnnnnnnnnnnnnnnnnnnnnnnnn

SEQ ID NO: 12716 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnncatagaaatttgactcttcttcctgctgagatgttaattatattaaacataatgtagtaagtacaattgtgcctgatccctaactgaaaaataaaaatagaacaaaaacaccaaactgttatgaccttttggatcctcatggactattgtttcataacttttaactgttatggctgcccatacaggtccatccctgttcaagaacgatcaagagcagttgctgttgtgtttggtggtttgagctttggaagcgtattagggtatgtgttttcaggtattttgtggtacatatgcacgcttgttcacaattctgccagatagttaattccatatacattgtttggcattacagactattgttcgccccacctattattcagaaccttggctgggaatctgtcttttacatatttggacttcttggaattatttggtgaggaaacatctctaataagcagatgaaatattatttattctgtttaacttcccattcatttttttcataggtgtctagggtttcaatctcttaaagaacaacagttaaggggcaatgaagatatacaagtaatacaagatttggggcagagtccttctggatcaagtgacctcatctcgtcctctgtgtctccaaaatcatcggagtcatcattgggagagctgatg

SEQ ID NO: 12717 - DNA, 623 bp, Oryza sativa
ggtaatgggcctatcaccagctagagatttatgttctggaggcccaatttgaattggtagcaatccaattttttatgggccagatgggccgaccatttcatttagactcgactgccgatgttgggtgggcaaaaccgacggggcagagaagcgccggagctccgccggccgcgtcgtggccatcgatccgctttcgccggagctccggcggccttgagccatgatgttacgcctgatctgctgctggacactgttaatcctacctgaatctcacaccagctacctagctagcattgccattgaacctccgacgacgactagctactcgaccgatctgagctttttcatggcaggccaaccggccgggcaaccccgctggcgcagccagagggatcagtatcagatactctacagtcgacgcctttatcactaacatatagagccgatgctttgttactgacatgtggacccagaactcatcgaactcacatgttagtgataaatctaattaaggtaaggtgcactcgactacagaggatctcaatcccggccagaggcagaatccattgtattgcggttcgcccgaccgtgggtgactcgtcgatctgatacgtgcgatccaa

SEQ ID NO: 12718 - DNA, 783 bp, Oryza sativa
  unsure (1)..(783): unsure at all n locations
aatgctcaatgtgtaacagaactgggggctcatttatggggtgtcgtgatgttaattgctcagttctctttcatccttggtgtgctcatcagagggtatgatatccactcataataagctatttgacctatatattatcacattgatttactgtatgctcataagaaatattctgcaatcttggttaaaacttattgttatctcaacactgtaaatctgaatgttgctcatgatatcacaatagggtttgttgcaaagtgagccagaaggcgagcataatgaaaatgttggtttttatgggagatgcctggatcatgctatgcttgatcctaatcatgttaatcctaagaaggaatgcttgaggagcaatgactggacatgtgcacgtactgaggtaatatatttgttttacctttgtactgcttgaaaaattagaatcctaacaagtgacaacttcctttgtcattcttctgaaacaggtttttagaggccgaaagggagactcatttggtgctaatcgtagcaggaaaccagaagagaagtttggtgagtgcagtgtttcccaagaacagatcaatgcttggatacgcataaatggatcgaaatcttgcatgagaggacaggtaacttctaatccttcactgcaatgcagttggttatcttcaatatagtacattgtaatgtactctgctttagcggggtatcaaagtttgcatgtacatgnnnnnnnnnnnnnnnnnnnnnnnnnnnnnnnnnnnnnnnnnnnnnnnnnnnnnnnnntta

SEQ ID NO: 12719 - DNA, 1739 bp, Oryza sativa
tccaagatagctcccaacgaacacaagaggcactgagataccaaaccaaaggaggaccaaggcgaacatagtggtgaaagggacggcaccagatgacttctccccccaaataagagcattcaatatgaagaagataacaaaagcaatccctggaaataagaaggctgtgcgcatagttattctcttccactctgaacccttgaacatcttgtagaggcgtgaagaagcataaccagcaagcaaccccatcaagacccagacaagaagcatcgcggtcatcaatcctccccgatttgatggagaaaggaaacccagaactgcaaaaatcatcgtaaccagcagcatgccgaagaattggacaccagtaccaacataaacgcagagtaaatcagagttggttggggggcggaacacatctccatgaacaagcttccagccagtttcctcttgcgcttcttcttgagtttcaagttggttgtatctagagatatctctatatagagtgcgaagcattatcattgcgaccataccagacaggaaaagcacgatcatgagagagttgacaatagaaaaccagtgaatctgatcatcagtcatcaacagataggtgtcccaacgggaagcccacttgatgtcactctcctgcaatgagggaaaaagattcaatggaaatcattgcaataaatttaacattaagagaataggcaactatcacatgaagggggaaacagaatccaaacaaaacatgcaaaactagtacctcaaagtgaacatcataggtgaatatgatttctttgccagcttcgacctcctgaggagagtcagaacttgttacaagcttgttagcatgagggtcacatgtgctcaggcgagtgttcacgccatcccatttatcatcaagctgatgcttaatgctgccataacagtatataaataacacatgcattaggctcatttatatagagcatatgcaagtaaaacatcaaagcacaaagtagaaagaaaacctgtatggcttgacctcaaatcccactattctagaaagttctgaatcatcgtccttgtggtacttcactaaaaatgacaaatggttgtgaatgaagtacttctcttccttgctctgtgaatacatttatatatcacagtttgttaatccagagcatatatgaataaatagaaggtcaagcaagcatcaattgagtgcacaacttactccggtgtactggcccttgacaccaacatgatagccaccttggtaagcaatgttcttatcttgccttaacacagaaacaactagcgggagattgtcaagaatcctgcaaaacaaatcatgtcactttggaagatactgtgacttgaagtgcaacattacctatatatcccttacatgttcacacgatattcatcctctatcttttccttgagctcctttgcttctttctcaccaacagttaatttgcagacaatctggcacatcttgggctctctcatttgaaactgtagctcaaacaaaaagaatgatggcaaacagagattaaggcatattacttcaaggacataaacttcaaaatatgagttacccggtactaaccacatatggagagttctcaatgcgatcaccacgaaaaacctcaccgagattttcagcactgtcaacgatagtttctggcttgcagaaaggaaggggagtatatgcatagggtagttgagtttttactgatgtcagcttattcaccttt

SEQ ID NO: 12720 - DNA, 696 bp, Oryza sativa
  unsure (1)..(696): unsure at all n locations
gcttggtagttcctgtaataattaacaaccattcaaaaaaaaggcttcttttttttcacttgaagctgactccctttgcaaagttgatgtcgcagtcctaattcaactcttcgatttttgtttcttgattttggagactctgatgtgccatgagaattgttgaggttgttgcggggccatgacaattgtgtgcgtgtttttcctgtagcagattttcgcgtatttttttttcttatttgtctcctgcatgccgaaagttttggatttttttttacataatacgattttaatggaaaattgcaaaaatataggtcggttaggcgaaatcgcaagtttagtaccctgttgaacaaccacgattcgacaggagaacctatcgaacatctgcatatcgacgggtatttgtcgaactgtggcaatttaacaaggtagttggtcaagaaaaaaaaatttaaaaagtacgcagagacatatcaagcaagcaaagaacgataggaggacatatcgaacaggcagtgttcgacagggatgatgctacagtgatgctacaatgtttttttctctttttttaaattattttattacctgtcgaactgataggtgtcctatcgaactacggttgttcgatagggtgctcgatttnnnnnnnnnnnnnnnnnnnnnnnnnnnnnnnnnnnnnnnnnnnnnnnnnnnnnn

SEQ ID NO: 12721 - DNA, 460 bp, Oryza sativa
  unsure (1)..(460): unsure at all n locations
actataggccgaattcgagctcggtacccatgtccactacaagcagttaaagggatggaagcatttggtagtgtacaaatctagcattcatgggcttggtctctacacatcggagtttattccacgtggctctatggtaattcatcagttattctttccttagtcgataatctgacacaagaatttagcaaatgaagaaattgttaacttctgcatgaaaatatttcaggttgtacagtatgttggtgaaattgttgggcaatgcgttgctgacaaaagagagattgaataccagtccgggaaacggcagcaatataagagtgcttgttacttcttcaagattggaaaggaacatatcatcgatgccacccgcaagggtgggatcgcaagattcatnnnnnnnnnnnnnnnnnnnnnnnnnnnnnnnnnnnnnnnnnnnnnnnnnnnnnnnnnnnnnnnn

SEQ ID NO: 12722 - DNA, 527 bp, Oryza sativa
ggatcaaaatccactcccgttgaccgttgtgatagctgatatattggtgtggctgctgctttagtgctagctagacaagttgaggccgtaattagtgtgaacctcgccaaactctttattacccatctaatcatggaagccgtcggtgagcttccaaacaagttatagagtacagttccagaaaagttgtaaatttcatgagaattaatgcaagtcatgtgggacacaaacccactcaaatacaactgcggcatattggattgaaaaaagtacgaattacctctctaactatcaaggtcgaccgaaatacacctacaaaatcgaagaccagatattctacacccccaactattgaaaccggataaataccccgtgtctcaatccggagcggtcccacatgtcagcctccaccttatcctccctctcttaagaagctagttggccccgcatgtaagctgctcccttttccttcgtctcctggccgcaaagatgcctgtgccggcttcaggcttcagggacccggaccg

SEQ ID NO: 12723 - DNA, 1303 bp, Oryza sativa
  unsure (1)..(1303): unsure at all n locations
nnnnnnnnnnnnnnnnnnnnnnnnnnnnnnnnnnnnnnnnnnnnnnnnnnnnncaatactgttaggaggtgaaccaaatctctaaggtgttatcttagatggctaaaacaatccaaaacaataccattctcatataaagtctagaacaataatataatttgagaacttttaggtacaatacgctggtagtatatactgctatataaacaattcaatggtgaagattgatttgatcttccacttaaatagatcatagtataaaatttataagggtaaatttatcttttactttgttattccacaggtttatttatgctaaaaacaaaatagttgatctagataaaaaaatttggtaccatcatcgggattgtataaatatgtgtaaacctagctagcaagatttggaatgtgtaaggcttttcacgtatatctgctatggtacaacctaattatttgatctgtaaatggtcatttataactgacgtatgtatgtagatttttaatgatgatcagaattgatcaggaatcgtgccgttgtggcgtgtgtcattgtctctcaaaggcacacaaacgagatcgaacggaggttaactctcaaccatgaaattcatagaaacccctttcgcattttctataaaattcctgatttacccatctatatgccggcagtatattgtacagtaaaagttctctataattaattttccgttgtatatgaataaaataacccacaaggaagaagtgagggagagagatccccatctaattcatccaagcacagccaaccctgtagggatcaagtagtagtatcaataattaataagcagcaggtgaccagtggaattgatccatcgatgtgtgatgatgatgagcatgaggaggcggcatataattagcagtagctgagcagcagaggtagcgggaacaaagggaggcatcagctgctcgtgcagtttcctctcggccggccggggacaaccggaatctcgcaacatatatccgtgcacccatgcatcgcctgcacacgcatccatcgttttcaccaacaattcaagcacatacatgcatatgcaaggatcgatcgatcgactctctgatcaaccctgcacgctgcaatatatatgcttagctgctgttgcgtgattccggccgatttcggcggtcaatccgtgcatgattcagcgtgcagactacagtaggagttggtactatgcgcacgttgctttggacccactcgtacgtgcatagtatatgtgcaatgtacgtagtaacgcacggcatgtttcgctattgcccgacacgg

SEQ ID NO: 12724 - DNA, 11848 bp, Oryza sativa
gctccatcctcagaataggccggaaacaagccatccaaacccgtgtggataggttccaaactatgaatccaatcaaatgcactctaatttccataaattatacgcttagttccagttaccataccagtgccatatcaagaaactttcatgttgcctcgtggaagttgagattgaagctactacgggagaatcggatgtcggtgtgtgatgttttgatttctacggtattatataaattctaaaataattttgggaaatggctagtttaataaaaacaaaaaaaaaattattattatgaggaagccatgtatgcatgatatgtgggtctaataatctcacaatatacctatgtgaaccacctaacccctccgcctagggatccgcctaatattggtctctaatgtttcggtcttcaacgtactatctaaattctgagaaattttttcaggaaatagctagctaaaaaaaaaacttttcttctttcctttcaaaagtaagctttacatgacccatgggcccaatggtcccccccatgtggaccccccacctcccaggacccaccccgttcacacgcgcactcctctggagactgcccaatataggttgattatgattcagttatataaataaaatgattttttgttgagcaaataaaatcgcatttcacgaagaatgtcacggtaactaattccatgctccttagagacgatgtgcgggattcctatcaaggcaatactacaatatagtaccatatttatttcttctatcttgttcttgttcctctctctttctcgtctgagccatttctccgtgacctcttcttttcatggcttggcactatgctagcttctcctcctccctcttctaatttcttcttaccctctcgctgttgtttgtgtatttgtttgcttgagtgcaacttatttgtttgtcatatccctcttgcgttaaccgcgtaccgttcttttgcatgcacgcatgagggttttggttttgtggtttgccctgtgcttacatatttgctagctagcttaatgctaaatttggttataatatttatgtgtttcctctcttgtttgctctgtcctattgtcttccggatcagaagaggcctgaagcgaggcaccaaaaaatccaagtggtcaagttccaccacagtaaacctaaccaaccgaggcacgcttagtttgtgtatgcatattatagcttagttccaatgaattgttccggtgctatatatgttgagaaaaattccatgttacctccctgtggaagtggggattgaggctactatctacactctaaaacattatttttttgaaatggctagattaaaaaaaacaaacattttcttccttttttatgaggaagccatgtgtacgtgatatgtgggtccaatagtccccatacacctgtgtgaagcgcacaaccccaccatatcggtctccaatgttttgatctcaccgtactatcagaattgagataatttataaggaaatatctagcttaaaaacattttcttatttcctttcatgaggaagctaggtatacatgatctatgggcccacgttcccccataatacacacccatgtggattgcgcacaacccctctccccccccccttccctaacatgcacgtttggaggtccgcctatattgattgatgatgtttctcttgagtaaataaaattgcatgtcatagtaacaaattacatgaagacactgcgtgggagaccatattaattggtcaaggtgatcagatttgagagtgtaatatatgtatcatccaaattccggctacaacctgcaaaatgttaagtacactatcatctttgtgttgtgtacataattccccttattgtgcatgtgctacatacatccatttatggtataccataatttttgagggggggaggtggcaacaagggtgaaaccctgattaacttggcctagagcaaccaaattgatcaagatacgtgtaatagtgttgctgttgtggattatgttttgagccgtgtagtttttggtatgtcagaataatttcattgaatttgattaaatgtatgattgaaaaacataggaatgtatcttagagatatatgttaattctaattaagtgctaaatataacatagatttgtctttcttatcttctggtgtgaaaggttatatgtgtggaccccgtagtccgcacaaccccacgtaagcatcatggtcccactagtcaatttttgtccctctcacgtgaatagcgcagctatttagaataaaagaggtgtcacaactccaataagatttatcatcggcaccgttcgagcagacttccatcgtgccacggaccaccgctatgggtggccgtcgatcaagacctacttagtaggggagaaacggatgctagaaagtttcaatctcgaccatcggattatttatctaaatttggatacaaaagctttaggaagatagagatcaatttaatatatcaaattctcattatcttaaaaaaaatactagattaacatcaactctttttttttcatttccatgaataacgaggtacacgcatgggggcgacctgtgggcccaacccagtggtccccacagtcctgcgtgggcattgtgacccggcctccacccccaggtttgctgtctccctttctctggtaaaatagcatcacctgctctgtgctgtggatggcgaaggcaaagctagcttgcatatattggcgagatatatatcagcttgcaaccactcccaccaccaccaccaccacaatagtgtactattccccggcgagagatatcctaaactccaaagcaggtagagttcagagaagtgagtgattgggaaagaaacaagcggtagggttcattcccctcctcggttcctgtgtgtttgtgtgtgtgccacacataattcctctctccttgatgaatcatctggccactatatttttaatctctctttgctcgtttggtgtgtttctcctgttgtttttaagggtttggttggctcagcatagctttcccaaatctttgtttttcttctaaccttgttcctctctctttctcgcccgagccatttctccgcgacctcttcttctccctcgcttggcacggtgtgctagcttccatatctcttcctcttttgattagttccttcttctgccgtctcgcggttgcttctgtgtttgtttgcgtgagtgcaacttgttcgtttgtcatctctctcttgcgttaattgttgttttgcatgcaaacatgagtgttttttttttgttttgtggtttgtcctgtggcaggaaccacacatatttgttatctaggtgaatgctaaatttggttacaagtatttatgtgttgctcacttctttcacttgtcttttagatcagaagcggccggaggagaggcagatagataaacagtgccagccatgtcgcctcctctgtgacttaaattggactgaattgatcaggtggctgcgcctcacctgaagccaacaaagtaagcagcgagaggacgcgccgccagggtagggagagcaagctatatatctagctgtgctgtgctgtagtgatcgatctctccctgttgttttgcggggatggcggccgcctcgtccgcacccttctttgggctcggcgacacgcagatgccgccgccgcagaatcccaccaatccagcccttcaccaccaccccaaccccttccccgctcccgtcgacgccgccgcgcccgcgccgaaaaagaagaggaaccagcctggaaacccaagcaagtgttctttcttgatcgattgatttcccctttcttcttcgttcgattgtatcgtgttaaaattaatcagttgtcgattcttctcgtgcagatccagatgcgaaggtgatagcgctgtcgccgcggacgctgatggcgaccaacaggttcgtgtgcgaggtgtgcaacaaggggttccagcgggagcagaacctgcagctgcaccggggagggcacaacctgccgtggaagctgaagcagaagaaccccaaggaggctcgccggcgcgtgtacctgtgcccgaagccgtcgtgcgtccaccacgacccgtcgcgggccctcggcgacctcaccgggatcaagaagcactactgccgcaagcacggcgagaagaagtggcgctgcgacaagtgctccaagcgctacgccgtgcagtccgactggaaggcccactccaagacctgcggcacccgcgagtaccgctgcgactgcggcaccctcttctccaggtccgtatgcttcgatcttgatcttcctcgtctcgtccatggattgattcgttcacgatctaagttaattaattcgagtaattgatccatatctttgcaattaattctttcgcgaattgaattgacagcaaaatcggctggctaggatagtagctagatagatatattcctttcgaattcaatggggtattattatcttcctgttttgttcgttcgcatgattgggtcatgatgaactcgatcgcgggaaagtgatcgatcgatttgatgggtggtggtggtagtacgcctttgttagggttagctagggttgtcgtcgttcgttcgttgctatagctcgttgctccgccatggaagagattggattccttcgagagagaaggaacggtagggacgacgacgatctccatagacgcgccgcgcgcgcgtgcgctgcgtgcagtggatcgagcatgaaatgcgacgagagggcatgagcgctgctgctcccacgtgaaccgttcttgtcgggaggagacgggagagatatgcatcctgacatgggcgacggctcaaaaaggagccatctcctccttttttccacctcggaaaccacgctcctctcctctcctctctcttcccccacctgttcacgtggtgagacatacgcgcccccgtcgttcgtctgcaagctgctacaagccacggcatccaatccaaacatgcctcgcagcgcggcggctggctagcttgtttctcatgtgatcgtgtagctgcattccgtggtgggcaactggccggcaagcagtgtactgtactactgctgttgctgtgcttgcttgacccatgcgtccggtaaaaatcttagcttcttctctctctctctctctctctctctctctacctccatctatctatatctctggcatactgcactgtcattggttttaattactagctagctgcatgacaattattagccacaagcctgcatgcagccggatgcatggattggccgctagctggtgttttcttgtgatttatgcttgctactctctgttgatagtagcagcagatatggtgctagtgctacagctaagatgatttattttcgttattaatattggaggtttttatgcgagaatttcatttctgtagctgttgcatgcgtacgtttactcattcattaattatttggttttatttgccagcctgcaactaatctgtacgcaatcaatctacagctagtagtgaccaagtatttttggcagtgaaataaattgatgattaattgaaatactatccttgcatgccattaattcttcagttttcttcacctctgtattgctggtgatatgcactagtcattaatagtacacttaagattgttgccagagcagtgacaataatctactgctatgtatagattccatgttttaattactacccacaactgagacaccagtaattaatcagcacatttaaaattcccgccatgtgtgattttcaatatattgcaaatcaatgatgaatatataagcttaattgattgtaaaaatgaactgcccatttttctttttgcgaggaaaaaaatgacctgcccattatattacaatggaatattgatcaactggcacttaggctcagtttgaggctcagtttgaaattaatctcgttaagctttttgcaactttttttaaaccactatgtgtgtattcttttaaaaaaagttaattatatacaagtttcttttaaaaaataaaaaatacttatttttatgtttataatagttaatacggaattaatcatacgctaatatatttcttattttacttgcctgcacccaaactaagccaaaccattcgaaagaacgtagccttagttatgcatgtgtacacgcttatatcatatgctagccagctttggttgcggacccgatcacagaatatgttgagaaaaaattcactataattttgtagcaaaaaaatataatttcactctaacttgactaaagaggctgatcagggaactgccgtgcgcgccgcatcgtgcgtacccacctgtgttcgaatcccattcgacatgtgtgttcacattcttttcattctttatcaatgcataccataccaagttactctttggtatccaaaatttaaaggctgctttttttagcgaaaaatatagtttcactctaagttgactaaagaggctgatcagggcgttgtcgcgtcacgcgtgcgttcccacccgtgttcaaatcccattcgacacgcgtgttcacatttttttcattctctatcaatgcataccataccatgttactccttggtatccaaaatttaaaggctgctttttttagcgaaaaatatagtttccctctaagttgactaaagaggttgatcagggcgttgtcgcgtcacgcatgcgtgcccacccgtgttcgaatcccattagacgcgcgtgttcatattttttttcattctctatcaatgtataccataccaagttactccttggtgttcaaaatttaagggctgctttttttagcgaaaaatatagtttccctctaagttgactaaagaggctgatcaggacgctgtcgcgtcacgcatgcgtgcccacccatgttcgaatcacatttggcatgcgtattcacatttttttccttctctatcaattaatacataccaaattcctccaccatggtatccaaaattttaaattaaggctgcgcttgcatacccacccgtgttcgaatcccattcggcacgcgtgttcacattttttcccttctctatcaataattagccaattaatcccctaaccattccatttttctcccttttttttaaattttttttggctcactgtctgatttacacgtcgctgctctctcctcctggctcctcgcgcgcgcccaaatgaccgctcgtaagcagtaaccggtcaaacaaaattttgggcgccgtgggagactgcatacgcgccggtatccaatacgagttagagccggttgtattacaaggctattttgcaaaaaatacataccaagtttctccaccatggtatccaaaaatttaaaggctgattatcctggctataatttagtgttcatgttcaccgcaatagtaaatgctatagctcctagctagctccaatagtgatgctccagaatttcaaaaacgaatttcattattgcccgcagtgattgaaaagtagttgtactactcactgtaaatatactatagcgccatatgtgatcatgtatagtggtacaacgaatttttactgagattatttcacgcatgcacaatgcattccatgaaataatttgatacatttgtgttcttcacatattggatcaaaatatgcaggagggacagcttcatcacccaccgcgccttctgcgacgcgctggcgcaggagaacgcgcgcatgccgcccatcggcgccggcgtatacggcggcgccggcaacatgacacttgggctcaccggcatggccgccccgcaacttcccgccggcttccctgatcaggccggccagccgtcggcgtcggccggcgatgtcctccgcctcggcggcggcagcaatggcgcctctcagtttgatcacctcatggcctcgtcgtcgggctcctccatgttccgctcgcagggatcgtcgtcctcctcgttctacctcgccaatggcgccgcccatcatgctcccgctcaggacttcggcccggaggacggccagtctcaggccggccagggctcgctgctccacggcaagccggcggcgttccatgacctgatgcagctccccgtgcagcaccagcaaagcggcaatggtaacctcctcaaccttggcttcttctccggcagcaatggcggcgtcgaccagttcaacggcggcgctggaaacggcgggcagggcagcatcgttacttctagcggcctcgccggcaaccacggcggcggcggcggcggcttcccttctctgtacaactcgtccgaaccggccggtacactgccgcagatgtcggcgacggcgctcttgcagaaggctgcccagatgggtgcaacgacgagcagctacaacgccggcggcgccggtggcgcgagctcgctgctccgtggagctagctcccacgggatcagcgtcggtgaagggccggccaacgagaggtcgtcgtaccagaatctcatcatgggctccatggcgagcggcggcggtggcgcgggtttcgccggtagcttctccggcgcgtctggattcggtggcgccgtcgacgacggcaagctgagcacgagggacttcctcggcgtcggcgtcgtccagggcatcagcggctcggcggcaatggggccgccgcgccatggcgcggccggcctccacgtcggctcactggacccggcaaacatgaactgaagtcatcacagagaagaaaaaaaacaatagaagacggaaggagatgatcatgctgctaatttcatttcatcatatcagaattagtcaagaaactggaggtaattaattaagaagagaaaagcgatttcaatccatgcaagatggatgtttctggggaaatctggagctgttaatggtgagtcgtagttgctagctagctagccagagctgggaggaataataataatacctggattaagtggccagaacttaattttgtaccggtacatttcgtttgtttttcatgtacttttggcagggaaatgggtctcttttgatgtgaagtcatcatgtgaaggcctgaccccagactagaatcaattcaagcgcgcgctgtgcctggattaattaatcttggagttttattgcttgttttggtgcacatatatgcaggtacagtggcttgatcatctgtgcactagctagtctcgttactgtcttactgattactcatcagtgtaaggcttagctataatatttcatgttggtttcttctctgggtgtgctgctttcaaagttgaaagggaggagcaaaagcaagcatcattaaatgtgggctttggcgtagtgtcagtatacactgtcactgtttgatctgaacagcaagcaagcagcagcagcataagactgaagaagaaggttacaaacagatcgaccaaagaaggcacgcatcccactgtcctaataacacggctgtgttgctttgctcgatcgcttccgtaattattccctgcttggcttcttccttcttcacttcactgtccaggtccagctgaaacattgcattgctgcaatgcttgctactagcaaattaagctactatgctgcgaccacagtgcatgcaattgcacactcgacatgtactacagggagagctcagctcacatagggcaggattattattattattattgatatgtatgcatatgtagagacacacacagaaaggtactactacgtagctaccgaacatttggaagtagctaaatgctacagaacaagagttttggatgaagtttgtccacgtgaagagagagatagaaactttgagagagaaagatggatgcatgcaagtctgtgcaggtcagaggtagccaggtctctctctgtgagtactgtgcactgtaacacactggggtgagcggctgctttcacaggagagtgttgcgtatttggggtatatatctacttgacatttttgttcaacacggttacggtaaaagtgtgttttacatttttctgaggagtttaagttttgactcttgtctagctacttccgctaaccattacaaagatcaacccttgctttttttgttcgtattaagaattcgccccctggcaactggtttggcgatcaatatttttcacaataaaattgaagtcgttgtgcaattactttctaccttttccccaattacaaggaaattcacccctggccactggttgggtgatcaacggttttcgcagtacccatagtgtcaatatgcatggatgcataacttcaaatgcaaaataatcctactagtagtattcgttagagaataaatacatatgttaaaattggccatatgatttaggaaggagatgtgcttgctggtacagtggcaaacgcacacagtgccatatgatttagtaccagttacgcttgttggtgcagtggcaaacgcgcacagttttaaccccatcgagctgcgctcgactccaggacgctcgcaatttcatatgaattaatatttgataccaagctccttcttggtcgtctagtctacatatcgatatcgatatgatttagtaccagttacgcttgttggtgcagtggcaaacgcacacaattttaatcccatcgagccgcgttcgactccaggacgctcgcaatttcctatgaattaatatttgataccaagctccttcttgtcgtctagtactacatatcgatatgatttagtactagttaatttatttcctatcaagcttaaatttctatatataaacaaaagatatatggtaatatgtttgcattttccacgtcgatccggttcgactctttctgtgttcgcaacaagagaaatagatgggtgcgcttggtctctgaatttggaagagtagtgaataaaatggagggagaagaaattaagaagcgtacaaattaaacctacaaagttattaatttgagtcgtttagttgagaaagtttgtttcacgatagttaggcctaaaacaaaactcgcaactcccctttcattgattattgtatggtagtttaatttaaaaaagtccaacaccatcgatcttcaccaacaactaatcaaattacaaatgcatcggtgcgtaaagattatacacggactgacggacactcctatttcaaaattgttcacatgcactatcaatatatggcctgtatagctctaattagctatagcatcaatatattttatgataaatcaacggccaaattagtcgaagaccttttcaatataccatgtaaattaaaatgaacagagatatcattaatttgatttgcacatataagtgtatttgtctgatattctgaaccaaattaaacaagaccccatatacatgcatgaattgaaaactgatttcatgtgtgcagtcgatcgatcgtccataaatatcctacggattatatatacgtacatttttgtggatgacgtgcattctgtgatgacagtactccagtgcataataatgacgtttgtggtcctttgttcgttacatgtactgatggcgacaaagtaattcgtcctatctctatatacacgcagtcgtcctgaatactttgccgctagcttagctgtcggcgtcatgcgataagtgtccaggttcctgactcttctctgtgtggcttcgttgatagtgtatatagtactatccccaccatttcttatcgtacatgtggtctcgaacatttacatttaattcgttttgagcggtaaacaatatgttaattttaacaataaattaccagttagttttttttactgggaactgtatagtactccctccgtcccataatataatggattttgagtttttatttgtattgtttgaccactcgtattattcaaaaaatttgtgcaaatataaaaaacgagaatttgtgctaaggataataaagtaaataaaaaaaat

SEQ ID NO: 12725 - DNA, 1805 bp, Oryza sativa
  unsure (1)..(1805): unsure at all n locations
taggagaagtcgtgatctgtataatgcccctaaacaggagcaatgtggattcccatcactgaaaattttcacttgtggattgcgtttttctcctgagagtcgcacgcccacagtcctgcacctgtggaaaatcatttcagtggactatatcatttgcgatatacttcatcgtttggtcatagcgagtagatggggttgattttctagctcaagcacctgaaaagtttgtcactgtactcactgtttccataaaggagtatagtgtacgcgtttattggacccttgtgtttgtatcatgctcctactatttaagttgttttgtggagggagtgaaagcttcacctgaaaagtatgtaataggaggttgaaatcgaccaaggcttttgttcccacagagctaagcaacgtacttgcaattgatgctacatggttttcttccgaggaaatttgaatgctaggataaatcccccttatctttgaggggggggggggggataaatccttttgtataaatcctaaactaaaatctaacaaatgaaactcctgttagacattttccacctttagccctttaattctcttctttagcacccctgatgattgcagaatctgttttcaggaccatgcatgtggtggataattgtactgtacagttaatacaaaaaagccatggagaaggtaggtgctaaaaccttttaagtgttctcttctttgacactatgttattacatgcttctttggctttgtgctctctgttcttttctttgcatgaagctaacagctctgtaatttcagatgttgtagtcagagacttggaaactccgttatctcttcagccctgcccaccagcggttattcttgtctgtacacttctcatctctgtttggtactatttttgttttcatattgtctgacagtaggataccatgtagttgtcagctataaggctatatgactaactgtcatggtcaagtaatgtccttagtttttgagggtggtcatttatcagaaagatcaacttgtgtgaagtgtcaagggttttgaccaaagtttttacaaccactgtcatctgagtctgactgatgctaacatagaactatgcaattttaacatgctatcgattttgttagccaaactgagctcatgtatattacttacatgattcccttctttaggttgcaagtgcaggacaggatgctgaccatattactgcgatggagctccttagtgaagtgaaatctgctggtaagctggctgcatcaatatttttgaagcccttttgttttgagggacagagacgacaattagaggtgggatacttctgttgtaaaagttgagtttattttcttggtctatgagttacttcctgtcacctacttaaaaaacgtatgactgtatattaagtttaagatgtctatttgtttttttggatttgcttcttacaaacaattatggttctgcaggcaactgatttaattgacaaacttcaaatgtgctcaaactttcacattggtaatgcgtgttatcttaaatttttaacttcaaatatatagcttatttttccattagagcataaataaaatatatatactttgaagaagtaagcttttcacttcttccagtatgaaccgtatgctctttgcttcattttggatcttggttgagtgaatcattacaccttttgctgatttcctcctaggtagaaccagtgtaaaattaggaagatcaaattttattgtacatatgctatnnnnnnnnnnnnnnnnnnnnnnnnnnnnnnnnnnnnnnnnnnnnnnnnnnnnnnn

SEQ ID NO: 12726 - DNA, 1594 bp, Oryza sativa
  unsure (1)..(1594): unsure at all n locations
nnnnnnnnnnnnnnnnnnnnnnnnnnnnnnnnnnnnnnnnnnnnnnnnnnnnnnntctaaactgaccatgaaaaaatacagaatacatatcattagactatatagcagcaatattttgtccatgcaaagatcaaatcaattgacaacatggtatgaactctccattggatgctaaacaagttactgcgactcaacaggttataaaacaaatattttcagcacattcagtttagacaatcatcaaaaccaagcagtgcaaggaatcaaaatgtggaccgcggtacaagtagtcataagatcctaattctgatgcacgtaaaaagacataaaaagatgcttcctttacacccaaatatttggcaatgcttaaaggccaaaatgagggctaaaaagagaaatgtcatgcacaaacgagggtatcatgtgcaagaagagatatatggtaccactataatgattctcacctaaaagagaaaactggtactgataacaatgctccggcattaaatatgtgctggagcaacttcatgtatactatatatgctccagtgcagtatgcaattgtggaactctccgcctaaatagtggctcaagacggaaggatggaacaccacgcagccaccgtttaatgtcatacatttcattccaggcttgcacaatttcatcaatcttgaagcccaaacctatgaagaaaagatgcaaacttagaaacaagttgcgtatgcttttgagaattaaatgatatatatatttgaaacataagaagttgaaaaaaatattctgggtggtacataaggtatatgagaaatttgcaattcattgttccgcaatattaatgacactagagttgctataattttctagttctggtattttctagcaaaatcaacactgtatatactattcccaggagaacatgatgagataaagtaagttaaaattgccttaccatcttgggcagtttcgttggcacagtggtttttaaccaacacagcaatgtctgtagctgaagcccctccaagtttgaacttttcaatagctgccatcaagcaatcctcccacattggaaggcctaatttaaactccacaactgaacgttcataaagtagcataccccataaaatgtttatctgagacctcatattagaagcttgttcagctgcgtcatcagtggatacatctttgatatattcatccaagcccatcttctccagcaccacattctcctggctaggttttgaccgattcttcaggcgttgctcttccatttcctcccacatctctgtacccctctccatgttatcttcagctttattgaagagttccaggacttcagatgatggccatgtgtccaggtctacgctactaccaattgcataataccatgacagttttgcttgctcaaaatgttgatgtgcaagtgcaagaaaaccttcgaaaaagtttggctttgccttcacggcttcttcatatctcctcccagccttattgtactcttcttttgcccattcatacgcttccttcacttgttcaagtaccgattcctgtggagagtctcctggcagtaacaacctcttctggcccgagacatatg

SEQ ID NO: 12727 - DNA, 1972 bp, Oryza sativa
  unsure (1)..(1972): unsure at all n locations
tgtttaattacaaggatcttgatccaaaccatgtttaggggctaagtggatagattatttcccactgctcctatctaggtttattaaccataaccactctttaagggtagaccaagcagttctcagtgcttattgggtacagttcacaaacacatgctttggggttagtcaaatcaacttccatcctttccatcatcagttgtgatgatttattttgggagctccgctgtatgctactgcaatgtcctaacctgcctaacgtcgatctgaaataactcaaatttaatacactataaggccctttttaaaaattttgaacccatgggtgagccaaaaaagagcatatattttatagtttctttgatgcaccttatgactaaatggaatacttgatattttacttcaacaaatatgatattaatttctctgtatcagtagttggagtcatttttcttgcctgcagccattatcttttgtatttctgaaggcctatgttttattcaggttatcctcttcaaattatagttgtaatgttcatattggattcacatcacaggtttccctctgggatggcattataccatcaaaagagcacgccaagtttttgatccatacaacaaacaagtacagatttattgaccaggttagcacatttctttgattgcatgttaatttagtgaaattcatctaacataattagtttgattgtggttgttgtttagcatttcaaagtagagggattattccttccatgaaaaagataagggtcattttgtgttgagtagattgtttaaaatatgtctacttgatgattgaggtgtgcttgttctgaaatatttatgaatgagaacattttctctttttcgcatattgtgttttggatgggctatgtcaattggtcctaaactcgtatatattgttttgtacttgaaaaaaattctgaatgcatgaaggctcactttttccttagtgatgttttaacatagggtagagtggttggtcctaagcaccgagcacagatttttcaccaacagcttttgggtggtgactcctgctatatgccttgactgtattagtctcgcctttttagtttttttttcttttgtgaagatatcctgttctgttctttgctgattacatactgaatgtaggttgcaaccatttatctaaatatttgcaatggcacattattcattcacacagttgatttcataccctcatctttttatttgggttgcagggaagcaacctcaaaggaaaggattttaacctgacaatgcactggcatattatgccaaagaccggcaagatgtttgcagacaagatagtcatgacaggttatcggctacctgaacagtacagatagaagaacctgagttagctcaatggatgctttgctatacaaatgcagtggttattgcggggagcagacattgcctatgctaagttttttgttctaatcgtagcaaaacatgtaatcttttgtgcttgtgttctaactgaaaccaggcgatacatatgttgtttgactcgtcatccagaagttgagaaagatgtaacagtgtagtgcccttttgatcgagaacccaggcgttgcaaacttgcaatcacgttaatttcaatgtttatgtagcaaatcctagtatttgcagagtcgacgtttgaaggaagagtgcattggttttttctttcccgtttggaatgagagagctttgcttttggtttggatgtccacctcgaattgaaatggcatcttctcatcgatctttctgagaaaacggagaatataccactctatacgtggggttttgatgaaatgacacttaataagatgcaccggataaaatatcactaagtacgttgccaaccggatgaaatgccactttgaggaatttttaaccatttttatgcccgannnnnnnnnnnnnnnnnnnnnnnnnnnnnnnnnnnnnnnnnnnnnnnnnnnnnnnnn

SEQ ID NO: 12728 - DNA, 8862 bp, Oryza sativa
  unsure (1)..(8862): unsure at all n locations
cgcgagtaatttttccagacggcctggacagaccaccactagaccaagaaattaaagaacgcatgccaacgtaattggaaattaaagattcaataccttgaccgctttaaccccttcttccccgaatgttgcaaccaacgcgttagctgcgattgacgccttacacaccacgtcgcactttgagctcgcacgtgctctgctaaaattgaccaaattgggaaccttaatttgatcagtatggattctaatcaactagaccggtgactgaagagcttccaccaaccatgaacgggcctgataagcgataaaattgtctgaaaattctcaggagtgtggaagaaccgatctcgcaggtagcaaccggcaacagttaattggctggggaagttaatttaagtacatgtaagattagtaacggtcgccatgctgcttgcagtgatgtgtgcttgtcagtttgtcagcaaaccaaattttgattaaaacgcccgtacttactaaaagagtactagttggtatactcggtattattagcagcaaattgagacggacatgccgctgaaaattcgtgtctacaactctagctgaccaaacagttgggtgatactgtttaatttatacagtaattttgccacgtttgaaacagtttattgattgaattatggctcatttctatttgattacaggaatatataaaatattttggcaaataaacttaatagttttaaaacaagtggtctaaagtctgaacaatgaaaatgtatacagtacacacaagctttccatacatgcgaactaataactatcatcaaaagttttagaaaaatacacatgttttccaatattattatatctatgtgcaaagtttcatctttaattttattatatttaaatcgtaaaaaagataaatttctgacacattaattcgtacatttaaaacggttagatttttcatctttttttttgttgtcatggtcaaaatgtaatgaatttaaagttcatactacatatatgtataatattattaaaagtacgtacatgtacattttttaaaagatttttcagttatacttattacttcctccatattttaatgtatgacgccgttgacttttcaaccaacatttgaccattcgttttattcaaatttatggcatgcttaaacatttgatgacgaatcaagtcacaataaaataaatgataattacataactttcttgaataagacaaatagtcaaacattggataaagtcaacgacgtcatacattaaaatatggaggtagtagtttgtttacacggaatacaggtgtaacgtaagtacgtctacagtatatgttcgcttaagcagtacaagaaaaaaaggtttttaacaccccaaatatatttttgaaaacgtagagcaaataatccgtttcaatgatccaataaataaataatctaattaagctttagccggtcagatcatcgtcgttgaatcggccatcggtgatcggttgatcgaatgccgcgctaggtagcaatagcatagctacatgctgggttggttggtggcgccgtgcgtggcggtggccgatcgcgatcatcgatggccggcgtcagtacgtcttgacgactagtgaagaattcgatcagggtattgctacgaccagctgctggttctctgaattccggcgagatatatatcgatcgatcgtacatagtactccctccatctcaaagatatattattttgaccgttcgtcttatttaaaaaaattaagtaattattaattcttttcctatcatttgatttattgttaaatatacttttatgtatacatataattttacacatttcacgaaagtttttgaatacgatgaacggatcaaatatgtttaaaaaattcaacgacgtcaaacatttaagaaaggagggagtacgtacatacatggtgccggtggcaacggcggccgaagcacgagctagcaacaagtctcttctccggccggcgctcgcttgctttgacgctggaattaattgaagcgaattagcgcgaccgatcgacggccaagtggctagctatagctttcatttcatatatactgttataatccatgcatgcatgctagtacaaattaagtcgtagttacgtaatgaaacgtcgttacttcaggcccaggagcacgtactagctagcaatcgcaatttccatgcagtttctttgatttcattcgatcttgcactgcatgacgaatttcaaaagacaatgatatattggtcgcgatcgtcgatcggaaacacacatgaatcaattaaccgatcgatctagctagctatcgagagagctgctcatgattatatatcacagtgacgggagttgccagattagaattaagctggtcgagaaatgtaattaatcggtccaagtccgcgttgaattatcttcccggtcttgctacgcatatactatctgctactcaaatgctatacgtggcacaatttttatggtggttaatttctctaagaagaagggggaaaaaagggatataattggatgttgtcaaatgcctgagtactgatcagcatattagttatgagcagtcaaaagatatttaccaaggcaccaacttaatttatttatgcacaaggtgaagatgcgtgtgttgaacgtatggatcgatatatgctacacgtgtggatacaaacattgcctctactgcatgcccctcgaatctctctagtttgtaattatatgccatgaattttgtactcttccccggaaaatgttttgacctctcgatggatcgttgtaccacgtttatttagaaaccatcgaaatagttataattttttaatttaaaaaattatattattcatacaatatatgtatatccctttataaaatttttatgtccaaacttaactcatacattgagatataaaaaaagaaaaattcaaccatataaaagtagtagtgtactatttatatctgaatttattttttccctctcaatgtagagtggtatatttcaatatttccctataccgtatattatcattttttaaaaaagaatacaactattctacttttttttaaaaaaataactattttgcaatgaatttggaagaaaatgtgtacgatgggacattgtaaacccttaaggaggtacatgatggaacatttacttgagatattaaaattcatttcacctcttttcctttgtaaaatggaaactgtcgacgggctatacccgactacggtatttgtaaagtatgaagatcgtacgtaccagaatatacgcgggattgtatcaagaagataagaggcaatgatttatattggttcgggctcttaagataagtaataaccctactacagtttatatgtattgttgggagatgtgccccacagattacaacggaggagaaagagatgatcaatctaatccgccgactagaacctaccacagtccagctagatctaatcatcaactagggcttcggcttcttccagattgtatcttgatgtggctttggctatggttgtaaggactctttatatttatagcgatgagtatcttcttcaagtagaactcagagtttatgctagacactagtgggagaaactttgttttttctaaataggactctgacaccttataccccggataaacaatttccttacagactcgcaaaaatctgtatataaggaatttccttcctgtatacttattaagtatgtggtatttttgtatatcacaaacccttgtatagaagagatataccttatctataacccaaacaaatatatatatatatatatatatatatatatatatatatatatatatatatatatatatatatatatatatatatatatagacacacacacagatgaaggaagatctctcgctcatttgaccttttttttaaaaaaaatacacaattaagttatgccagggagacctacacaagtattaattaatgatcaaaagtttgaataaaatatactccatgtttgtgatagaaggtttacgaatcctttcctggatggatgtgtacgtcttctttatcaatggaatgggacgaagcttctgcctttgttttagaaaatatatactcctcaaaattgtggcatataccctcaagaaggatcgagtctctccattaactagctacttcatactccctccgtatttcgtattttaatgtatgacactgttgacttttcgaccaatgtttaaccattcgttttattcaaatttttttataaatataaaaatatttatgtcatgcttaaagaatatttaataacgaatcaagtcataataaaataaataataattacataaattttttaaataagacgaatggtcaaacgttaaacaaaaagttaacgatgtcatacattaaaatatggaggtagtactgcttacacgttgcctctcaataatacaactatgcatatattctcttcttttttaatcttacatgaacagcactccagttacaaatttttaatttacgcgcgccactaacccgtcaattacgccatctctccacccccaaacattataaaaacaggaccccccttgcacttgcacacacgcacactcctctcattcgatcgccattagctgctttgcttgcactactgctgctagctagctgctcgatctcttatcacatatcatatatataccaactaattacgatcgaattaaggagctagcaatcaatcaagaccatggatagcctgccaaagagagacgctaactacgtccctttgagccccatcaccttcctccacagagccgcctccgtctacgccgaccgcacctccgtcgtgtacggcgccaccagcttcacgtggcgccagacgcaccaccgctgcctccgcctcgccgccgcgctccagtccctcgccgtctcaaagaacgacgtcgtaagcaactctataccctattattatagtcgtaatcgggcgagttcagaggttctgagaagcagcgggtgagaacgactagctagtgagaatctaaagagttactgtagtttttttcatattttggcttctagaataactacaaatttttacaatctaggtaagaatctaaactattttgggagagttgaaaataagatgtagtatatgtgtcactctccatgcatgtcacgtgctaatttttgtatcatgtggttacgtaggtgtccgtcatcgcgcccaacacgccggcgctgtacgagatgcacttcgccgtgccgatggccggagcggtgctgaacgccatcaacacccgcctcgacgcggccaacgtcgccgccatcgtcaggcacgccgagcccaaggtgctcttcgtcgactaccagttcatccgcgtcgccaccgacgcgctcaaggccgtcatgggcgacggcgacggcgacggcggcgaggtcagggcgcccttgccgctgctcgtcgtcatcgacgacgccgacaagccgacgggcgcccgcgtcggcgagctcgagtacgagcagctggtggcgcgagaagacccggcgaggtacccgcctcgtccggtggaggacgagtgggacccgtcgcgctcaactacacctccggcacgacgtcggcgcccaagggcgtagtgtacatccaccacggcgcgtacctcaacaccatgggccttcttctccagtggggcgtcggccacgagccggtctacctgtggtcgctcccgatgttccactgcaacggctggaccttcacctggggcgtggcggcgcgcggcggcacgaacgtctgcatccgcgcgccgaccgccgacgccatgtacgcggcgttcgccgcgcacggcgtcacccacatgtgcgccgcgccggtgctcttcaacatcctcctcgacggcgcgtgccgggagccgctgcgccgccccgtggaggtgctcaccggcggcgcgccgccgcccgcggcgctgctcgagcgcgtcgagcggctcggcttccacgtcacgcacgcctacggcatgacggaggccaccggcgtggtgatggtgtgcgagtggcgggagcagtgggacgccctgccaccgtcggagcgcgcgcggctcaaggcgcggcagggcgtgagcgcgctcaccctcgccgacgccgacgtgaaggacctcaagacgatggagagcgtgccccgcgacggcgccaccatgggcgaggtcgtgctccgcggcagcaacgtcatgaagggatacttcaagaacccgcgcgccacggcggacgcgttccgggacgggtggttcctcaccggcgacgtgggcgtcgtccacccggacgggtacgtggagatcaaggaccggtccaaggacgtgatcatctccggcggcgagaacatcagcagcgtggaggtggaggcggcgctgtaccagcacccggcggtgcgggaggcggcggtggtggccatgccgcacccgcactggggcgagacgccgtgcgcgttcgtggcgctgaagcgggagttcgccggcgccggcgaggtgagcgagcaggaggtggtgtccttctgccggaacaggatggcgcactacatggtgccgaggaaggtggtgttcgtcgacgagctccccaagaactccacggggaaggtgcagaagctcgcgctgcgcgacatggcgcgccgcctccgcctcagggcgcccgacaaggcgaggcccgtcgctgcccctgcccgccatgggccgttgactcaaactgctaggctttgacttttttgctgacgtcagcacgtgactacgtggtaaggattgctattggtctctaaaaaaagggaaaaccacagtaccacacacctttgtagtagtgcactttagtattttctttttaatttttcatacgctgcaatatggtcatagtgtatattatcatcgttgataataaatgaactagtgaataattaatttgctcgttgatagatgatgagaaatctcggataatccaaataaggtctaagctacgaagattacatgatactattgtcttaagagtcctatagctaattaaatggctgcaaaatgtaaagaaaaacatttttgcattgttttttttcagtggtattttctccgtctcaaaataagtgcactacttcacgctaaattagaggagtgcagttattttgggatgaacgaagtcctagtactacatgtgaaatgacaaaaaagcagatttaagaaaacaaaatatatgtattagaaacaaaaaaaaagacaatttgcacgcccatatacactggagtagcttcatagctatcagatcaatgtcacgctgagcgcatgccaatttttataatcagatctacttagtacctccgtattttaatagatgaccccattaacttttatatacatgtttaatcattcgtctcatttaaaattttttgtcagaatatatgaatcatgcttaaagtaattttagtgataaaataacttacaacaaaataaataataattacattttttttataaaatgaattgttaaatttgtgtaagttaacgacatcatcggttaaaaattgaggtagtattccttattagctttgtcggaaaacgaagtcggaaatagatgaaacgtatcatttaaaataacaaatttaatcttgccatatgtgtacagtgtacttgtttatcagcgttcattgtcctggttttagcatcaccagttctgtaaataatcggtcgtactatcaaagagctgaaggacagttcttgcaatcaatcttctatcggatgctgatagcgctttacttttaaaaaaaagaatcgtaacgtgcgtccatgaacaaatcgccaccaaggcaccaacatcaaattctgacccgatagtcagcatgctcaaatcttttaggtagacgctcttatcatgaaaaaactagaaaagaagtcatcaagcacgggatgcacattatgttctgcaaatgcaacaaatattttaggcttgtggctttgtttaagcttaactacgtactatgaagtattcaagtgcacgtattatttattttgtggggaaaaaatcttgtccatatcgagctgaatcatgcactgcatcatcacctacgatttataattgatttccgtttgggactatttacacatcacatatgcatttatctcttttcccttctccaatcatatgattttctttgtcttctactcccccttggccttaccggtgtcacttatccctctccctgaaacctccataccatcacctcctttatcttctttggcttcggtaccccgcaccgccatactcatagcttgtcttccgcggctccgtcgttgaaactgccgccaccttctatcggctatcgtctctagtattcctacgctatatccctcctaagccttctaaccactcaaatgatgagcttatcccttaacaacaccaggtcaccactctcctcctctttcaacgccgaggtggcgccaccgtggtctcttgctgccctggccacctacacaactagccgctactgtcctagccatccttctaagtcgggcactaccttccgccctcagccccaactctgaaatcctaaccacttgggggattgtcggagatgaggaaggaggccgtggagtacaaatcttgaagtggatctgaaggttagaatcacttgatttttcctctaaaatcgtgcgcacgatgtatagatttgtttgatacgtacgtacagacttgatttccgtttccttttaatttgtggaactatgatcgtcactgtaaagttttactcttaacctatcagagaaacaaaaaaaaatttgtttctaggcactattccannnnnnnnnnnnnnnnnnnnnnnnnnnnnnnnnnnnnnnnnnnnnnnnnnnnnnnnnnnnnn

SEQ ID NO: 12729 - DNA, 3084 bp, Oryza sativa
cttatccattaacaacagcaggtcaccactctcctactctttcaacgccgaggtggcgccaccgtggtctcttgctgccctggccacctacacaactagccgctactgtcctagccatccttctaagtcgggcactaccttccgccctcagccccaactctgaaatcctaaccacttgggggattgtcggagatgaggaaggaggccgtggagtacaaatcttgaagtggatctgaaggttagaatcacttgatttttcctctaaaatcgtgcgcacgatgtatagatttgtttgatacgtacgtacagacttgatttccgtttccttttaatttgtggaactatgatcgtcactgtaaagttttactcttaacctatcagagaaacaaaaaaaaatttgtttctaggcactattccaagatctagcaatgcatcggaggaatcagaatactagtatagtagatgctacgcagacatatatttccattcggaggatgagattaattgtggcattggcatgttcagacttcagaacattgtcgcttgcctgtactgatggatgatcgttgttgctatgttggagagagttcacaatcacaatgtacacgttgttggtgtgagcgtaaggcatggattacttctgatactgaacagtgaaattgatgatcatagtgacgtctctttttctctagaatggtgcaaaacattttcttcaggattcctggtagctggcttgctgctcgtggcaaacgtttcaattgactggcagagctactgctgacgtttcagaaaacaaaaggaagaactttctgcacgaaaaatatacatccaacattgctgcaatccgatagatggtgacatgaaaagcctaaactggatagatggtgacatgaaaagcctaaactggagaaatgcttctacttgacttaaatctgatgagctgggcgattatataaatcattctgaagaaaacttgcgctgtcgtagcgcttgaaattcggccgaagattgcagatcctttacacgcagtgatcagaagctggattctatataattccctttttcatcttctgtctgaattcgtccgtgtaggcgacatttgatcatgcagtgcagagcatatatagcaggggcgcagtctgaatttcgtaatgccttttttttgtgacatgctccttccttatatttacaccttagtaatattaatacgtgacattatcagggcaagcagaatacagatcttatcttatagagaaatctcgaaagaaaaaaaaggcctatagagaaatctcctctataggctttttttaggcaatcgtccttagagaggcagcgcatgcagtgtacattatatgcaaaagagaagagagaagagagaaaggattagaaaagagaagaaaataagatatgcagctgacatgtgggtcacatgtgctttgtttattttttttttgctgactaggatgccacgtcagtgaaaccacctatatatactgcctagggatcttgagtgaacggttttgtatagtttaggggtggagatttctggttttgtggttaagggaccttaaaaaaatctcgctgttaagttgagggacctccggtgaacttattccatattgggaacagcatcgtcagaccttggttgcatatgggccgaggccaacattatccagggcccaaggccgattaaacatctacctagacttggaggcccaatggaggacaggtaccaatctacctgggcccaaggccatcagctagcgcgcgtgcgtgacaaagacggcccagcaacacctaggtgtggatcggccgcagaatgcggaagaaacgagatgcacttcatactgtgatgacaaagtgatgtgtggtatcaacatcgaggttccgtattcaatccttagcacatttaaagtttttttaaaaaaaatatttagagtgacgtccctctctttaaatctcgttttttaaaatgcagagaaaaccatgagcaacgcagcggcggaagacggccatcggtggtgtatcaatttgctagtcggccgtacaccgtctggcgggtcgttgtgtttggcatctgcggttctgcacagtactcttttctaaccgtccgtccctagacaacttctttttttcaccgtgtttggcaatgcatgcatcgtacttcgatcgatgtgagagacatagtacggcactgtctgggacgaccgtctcagtgatcatcggccgtaccgtacgtgattattccctgaacgtaagtacgcactcgtgtgaaaacgacgaattgcccgtccttccgcaagatggcacatgccagatgcaaagaaatttttatgtattcccttcatcttaaattatagggtgttctgtttttttaggataatcaaactcagtaacttttaactaataatcgtactaaccatacacacagtattatacatgttatattataaggtttgtattttaaaatactttcatttgatgctaattttatatttgttaggaacataacatgaaataaattaatgtgttatttatgaccatgtaaaaaaatataatttgggacggagagactaacacactaaaaaaacataagctagtaactcgtgcacaatactgttaggaggtgaaccaaatctctaaggtgttatcttagatggctaaaacaatccaaaacaataccattctcatataaagtctagaacaataatataatttgagaacttttaggtacaatacgctggtagtatatactgctatataaacaattcaatggtgaagattgatttgatcttccacttaaatagatcatagtataaaatttataagggtaaatttatcttttactttgttattccacaggtttatttatgctaaaaacaaaatagttgatctagataaaaaaatttggtaccatcatcgggattgtataaatatgtgtaaacctagctagcaagatttggaatgtgtaaggcttttcacgtatatctgctatggtacaacctaattatttgatctgtaaatggtcatttataactgacgtatgtatgtagatttttaatgatgatcagaattgatcaggaa

SEQ ID NO: 12730 - DNA, 3066 bp, Oryza sativa
  unsure (1)..(3066): unsure at all n locations
gatcgatcgatcgactctctgatcaaccctgcacgctgcaatatatatgcttagctgctgttgcgtgattccggccgatttcggcggtcaatccgtgcatgattcagcgtgcagactacagtaggagttggtactatgcgcacgttgctttggacccactcgtacgtgcatagtatatgtgcaatgtacgtagtaacgcacggcatgtttcgctattgcccgacacggccgcgccgtgacgcgcacatacgtcgtaccgtgctaactactctcaccttttcatgtggttatcatcatgcatgggacttctctcgcataaaaccatatcaaccagattaactgtagcattagtttgtatactattattataagttgaggcaacctagttagaagggatgtgcagatttattgtactagacttctatgttgtttgatcgagtaatagctatatagtgtgtatgaacgaacaataaaatttactgaaggtagctgtacatgttagacgaccggggtgacaggcgaggttactactctctccgttttacaacgtaagtcattctagcatttctcacattcatattgatgttaatgtaggaatataaacgtgagaaatgctagaatgacttacattgtgaaatggaggaagtagctatgaagatcgatggaggaatcgaagggttggcaggtggggataggagggagaagacaaagtcgcgtgagcccactctcgtgatcggctaaacatccgatcgatatccgtccaagcgacgcgagacaaggtgcaagaagaacatccgccccggtacctgctcctgctgggcaatcccatggcagccacacctcccctttttcagcgcaacaaaggggtcttgctttcttcagctctctctctctctctctacctagctagtacaccatatatagctagcttcactcccatctttgcctcctcctttcttcactatgattaaccaatgctgcatgtgtgtatgtgactacggttgtccaattgtattttttaactagtttgtaattgcactctgttttatcggtggactatattccgttggctttcttaaaaaaaccagtttagtaaaatgaaggtggatatgaaagaaagaccacatacatacatacatacatacatacatacatacatacatacatacatacatacatacatacatacatacatacatacatacatacatacatacatacatacatacatacatacatacatacatacatacatacatacatacatacatacatatatatatatatatatatatatatatatatatatatatatatatatatatatatatatatatatatatattgatgtttattaagagataatgaggctcaaaccttggctggctagtccaccaacttgtggtgctagctgataagactccgagtctttctcaagctagatcggtgaagtaatcttccatctacaagaatgtgactatggctgtttatttcaacaggtttccatatgaagattgtaaaatatacgaatgcgactctacgtacaataggccatgtgtatattgtcacatatcgattcaacacgataagttttagtataattgaaaacgaagtttcaactctggtgagattattgtctaatgtgtgtttcccggttgactcaaaaggcattcttcgagctaaacaacacttcacatgtcttaattttgtatttgtacgatacttcatgtcaacatcagacatgtatctttcggtgatggttggcttataggtatagtaataacgatatgtttgtgacatcaaggcaagatatgtatctcaactaaaagaatatccagggattgggtaatttcaaagatacgactaagttcacacaaatatacataccacgggctagtttgatatcaaccgacgacttaacttgtatgtgactagctagctagcagtacatgttacttggtgagcttagcaattcgtagcctacaacgatgaggacatgaccaactttttcgtgggagaaaggagaggaggaaagtaggagtactacataattgattatacacttggtggtccttttcatcttttgagtcatcttgatttggcttcttctcccggcatcatcagggctcaatcatcactccagttgggccctttctccatttattatgtaattattaatcaagtagtactctgattgttcccattgagccctaattttgaaatgacatggagatggtctctgtcgtccctatgttcaatttgactgcagataagttccatccacatagatcaagaggtcgatcacagcttttcgatctgaagtgaaaaaccatcagttcttcagttagtcatgcatgcagcatgcatataaatatgtgatatgccgttgcatatatatagcattatagactaatcgattgatcaatcaatccgctgtgcaaaaagtgcaagatcactcgaattaaactgtggtcctagtaataattaaccggcaaagctcaagtacgtactatatgtacgaagcctgtctcactcaatttattgtactcatgaatgaactcaaatcaagctctctaatcaatcgagctaactttgcatggcatagcatatggtcagcttctagtagtcaaggtttttggtttcaaaaaaaaaaaaggcaagatgtacatcccgtacggcgacgtatatatacacacatgtatgttgattctctaatgatctagatcactctgattattgctattattagtgtagtacacacattgacgtgtgagtcacggtttcacctaagttagctcacacaaaggccgaccaaggatatatataagatgaaaatttgttatttttctttatatgaatatcattaattaattaattaagcaaacaccaacaactaaagttgatcctgtcgcaataacaagagttaattaattagttgcatatcttatcctaccaaaaatgagagaatggaatgtacactacgaccatgcatgtacatannnnnnnnnnnnnnnnnnnnnnnnnnnnnnnnnnnnnnnnnnnnnnnnnnnnnnnnnnnnnnnnnnn

SEQ ID NO: 12731 - DNA, 11248 bp, Oryza sativa
  unsure (1)..(11248): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaattttgctcaatgttgtagctgtggttgttgcacagctgcagcccaattgtataaaaaaaccttttttatatttgcataaatcttgaggtatttttgaggcacatatccaagagaatgtaaaccaaacaaccaacttggaaaaaaaaaagaatgtgaaatagccattgaggagcagcaagtgcaggggagcaccatttctacgcccacacgtggggtgtccggcgcactctcggcgtttggaattggaagtttcacacgttcgtcgatggaacttatattttaagtgcaaattgaaacataactaatttgtgccttttgtattcatcccattccctgctcttttccacacttccattatttgttctttaacaaattacggagtgatttaaaaaaaaagaatgctatttgtgctctggcaaatgaagatgctctatagtggtggtccacagggacagggatgccgcatagtcctacatggtcagttaataatatacttggatccctaattaagtaattaggactcacctaagccaatgttgacttgaaacacacggattatactgcacggcccatcgtaattagcaaaggctagctaagttacagtttttcactggtgctaactaatactccctctcttttcataatgtattatggcaccgttaacatttaacgttatgtttgatcatttattttattaaaaagtagatattatttattttgctgtgatttattttatcatcaaaggaactacaacatcaacatattattttacactttttttattaaatttttaaataaaatgaatggttgtgttatatgaaaagttaacggcatcgtgcgttaataaacagtgaaaggcgccgacacggcgattaaagaagggaaccgaccaagatcgtgcttcgaagtgtggccactgcagagtactgcactgcactgcacttgctcagccttcttcttcagaagaagccaccgtcgttaacacgttaagcacggcgttttcctggaataatcctacctgcaactgcataaaagtaggcgagaaaaaacaccgggtgtactaatggcagtaatcaaatggaggagattagcaatggcaggggtatcattagatgccggtaattaagtaagttgatcactttgatctctctgttaatttactcatttgatcttttctttaccggttaaatcacgtttgtgatggtggttagagcagagggtgtcttttggactcatctttctccaagttgagcctttttctctgacgatgttgtgttctgacagtgtgcaacgtagtagtccttcattattgttcactgtattgggttggaccaattctgatgagcaagtatgtaccgttggttcctctccgttcgtcagagccactagatctgataataactgttgggattgcttagaggaaacttggtagaaaacttcagaaaaaaatcacatgtttgatttagattattaagcagattattattgcaaacatccacttgattataaatgtaaatgcatattttatgaaataaacttaacaaataactttttttagataatacttaacaaataaccaaaacaagttatctaaacagtagaaaatgctttttcttaagaaaacatgttccttttaatcacgaagcaaaataatcagttttaatattccagtaaataagttggaaaaaacaatgcctaacatacataacgggttaaacagaaagcctcttacaacgcaatgtttgacaagctgaaaagcaccaataaaaccttccctgtgatatgtctattatataagatatccttttaaaagcaaaaagggaaaacatgttgtgtcataagtttgatagagaaaaaaaacagttatgatcgcacatttgtggtgtttcatggtgagcgaagcagctaaaaaggcttcaaaaaccttttttagctaaaaaaaagcttcaagaacctcccaaaaaaacaaaaaggcttcaaaaaccagtttacctcaaactgtgtagtcacaaccttcaaaaaaaaaaatcaaaattactcgccatggcccccaccccccacacggctaccgggccaggaaacacgaaagcgaaagggcgagaaaaaaaaaataaaaccaaaaaccacacacaactgaagcgagaatagagagcaaagcaaagcgaagcagcagctgcagctcactcctcccactcgagtagagcagccaactcctctctctctctctcgccgcagcgaggagggagacgacggcgaatcggagagggcgttagatcgaatcggagaggaggggaagcgcgcgcgcgcgctcgcgtcgcgggtggggggcgatggggtgcacggcgtcgaaagtggagcaagaggacacggtgcggcggtgcaaggagcggcggcggcacatgaaggaggcggtggcgtcgcggcagcagctggcgtcggcgcacgccgactacctccgctccctccgcctcaccgccgccgcgctctcccgcttcgcgcagggccacccgtcgctcgccgtgtcgcaccacaccgcgccggtgctcctcaccacggtcgcgcccgcgctggcgccgacgccgacgccgccgtcgacgtcatccacggggtcgtcctcgctcccgccaccgacgccgctgctccccaagcaccagcaggcgccgccggcgccaccgcccacgcagtcgcatcagccgcctcctcccgtggcggtgagggctccccgcggcgggccgcgtcgcctcaaggtgccgcacatcctgtccgactccagcgtcgccagcccggcgcggtcgtcgttccggaagccggtggtggggacgccgtcgtcgtcgtcggcgtgggactgggagaacttctacccgccgtcgccgccggactccgagttcttcgaccgccgcaaggccgacctcgaggaggccaaccgcctccgcgagctcgaggaggaggagaaggcccggggctacctccacccccaccacctcaaggaagaggacgaggtcgacgacgacgacgacgagagggaggaggagatgcattgcggcggatgggaggacgacgacgaccactacgcgtcgacgaccacctcggagaccagatcggaggagggggaaatggggaacagatcggagtgcggcttcgcggccagatcggagtacggcggcacggcgccgtcggagtacgccgccgcgccgctgccactgccgctgaggaggagggacgagaggtcggaggccggggactcctcctccacggtcacggcggccgccgagatgcggatggtgatccgccaccgcacgctggcggagatcgtggccgccatcgaggagtactttgtcaaggcggccgaggccggcaatggcgtctcggagctcctggaggctagccgcgcgcagctggaccgcaacttccggcagctcaaaagtaatcagagattcatagcagacatattatgcttgaacaaaaactataatgtggtttgaattggtgtggcaatgtacatttttagtgaaaaaacgcaagcaattgcttaacaatttcacttaatttgacttcttcttttgcagagacggtgtaccactcgaacagcttgctatcgtcgctgtcgtcgacatggacttcaaagccaccattggctgttcgctacaagttggacaccaatgcgttagagatggagtcaatggaagggaagagccatgggtcgacactggagcgtcttttggcctgggagaaaaagctctatcaggaggtcaaggtaattctgctcatcgacgcttgattacaatgccattcttgactgctggttagtggttatacttaatagatgagcacaccactaaaattgaggtgtttgtttgctgtgacattttttgttgcacgcctcaatcattcgttgtcggtgaagcatcttcaaactattcacttggctccacttgaaaattatccagctatatatatttgctagagcatagtagtggactaaccgataatttaggtcactgcacaactttagcagcaatgcaagtttaatgaggtgtaatcttctagtagccacccttgttggatgctagaatagaatgcatgaactgttgcacttggcattgcagcataggcctacctagcagtcaaataatcaaggatgaattgaggctaactttaacacttctggtgtagcttctaatcgattaggtgaagcttcacctcatttgaaattggtgttttgagcagcccgccttttgttcagcaaatgtggtagaagaatctgattctattgcataaagcgtctttacagaggtcctgcacttgcctaccctggattctgaaacagctgtagcatttggttgataatttttcactactttcagtaaaggaagcaggcacaatacatggccattgatctctcaaccacaccttcatatacccttcctttatgctctttttatatctaaactactcctgtcctttgagattctttgtggctttgtgggtgaaggtttagatcctcaagaaattgtctttactgcacataaatatacctcataatgccaaaggtagatttagcgtatctatgtctaaagcaccagagtccagagatgtttaggcctttaggggcattacccttggtaggcatgagacttataccatatctattcgataattgagtgagactaaccaatgttctttttatttctgcaatctagaacataatggattcttactgtccggtgtctactaaatgcttctattctctaagcagtttatgaaactttattgaaactattcccatatgtattaactttttactgcttcaggctagagagagcgttaagattgagcacgagaagaagctttctactctgcagagcctggagtacagagggagggatagtaccaagctggataagaccaaggcctccataaacaagctgcaatcgttgatcatcgtgacttcacaggccgcaactaccacatcctcagccattgtcagggtgcgtgacaatgagcttgcaccacagcttgtcgagctttgcttcgcgtaagacttgttccctgttctgacatctatgataccagattttgcgacattgtgtgcaagtatttaaattgtatctgaatattgatatgcaggctgttgagcatgtggagatcaatgaaccatttccatgagatccagaatgaaattgttcagcaagtccgtggtctggtagacaattccatggctgagtcaacatctgatcttcaccggcttgccacccgtgatcttgaggctgctgtctcagcatggcactcaaacttcaaccgtctcatcaagtatcaacgtgattatatacgtgccctctatggctggctgaagctcacactcttccaagtggacagtaatatcccacaagaggcttacacctcgctgatctctcgtgaactcaccaccttctgtgatgagtggaagcaagcactggaccggcttccagatgcttcggcttcggaggctatcaagagcttcgtgaatgttgtccatgtcatctacactaagcaggcagaggagatgaaaataaaaaagcggacagagacatattcaaaggagctggaaaagaagaccaactcacttcgagccattgagaagaagtactaccaatcctattcaatggttggccttggccttcctggcagtgggcgcgatggcattgaaagccattcgttcgatgcccgcgatcctcttgcagagaagaaaaccgagattgcccaatgtcggcggaaggtggaggacgaaatgacaaggcatgctaaggcagtggaggtaactagatcaatgacactgaacaacatccaaacaggcctgccaggaatgttccaagccatagctggtttctcaggaacagttgttgaagcccttgacgttgtctgcaggcgagctggatcggtgcggtagaagcttgcgctgccagactttccaagaaaccgttcgttaagtctttttgggtggttcagtaatttatatagggaaaatgcaatatatatagctaaaattagtgatgagaatatgggggagaaggctcccttgatgttttgccttgttgggagttggtcattttggttgtagataaatgattttactcaggattgttgatgttcttttgcttgtcctgtgaagtgcaagggaagattacattgtacagatgctgtggtcacttcacctagcaaatctaacggcgagttatgcttgcacttctcccatggaagatagtaactaaccatttgttcttctgggaaaaaaatgtcagaattctgaactgaattagctatgtttccagtggttggagacttggagctgtccctgcatctttgtgctgtctgactgtctggatggaggacattcgtcttgaatctttgatgtcccattttggcccccatgtaattaatgtcgtgctgcattgtccaagattaactaaaacatgatctagcaacgtcattgtagacttctggagttttggccaatgctctgatgctcacaactcaccacagcctctttttgttgtttgtctgaaacgacacataatcatatctgcttttgcacatgcatttcgttctaaagtttcgtctgttcttcctttcctacctgcatcaagccagcaagtctgcaacaactgtaaaaaggacctgccttttaaagttgctgtaacttagccgcgaagggattagtcaaatgctgtgtcactactcatgcatgcccctcttgtctgccatagcttgcattgcatggcatatctgaatatatctgaatatctgatcagtgataactagttgcccccctcttcaacaacatggtggcttggctggctgggagatgaatagcagcaaggctggcaatttggacctatgctggttgttggacacagctgcatcatgcatgacaaggctgttggtttgcaaagggcaactactctcctccctttctttcttgtgaaagggcatgaaaaagtggttgtggcattcatctccatggcatatgcatgatactagtaccacattgcttgatttgatggctggaagcatggagagaattcttggggcatatggtatcaacatgtgccaccttttcttttttgcaaacaaaaactgctcctcactggtttatgaaaaaaccgataaaaaaacttggtttacgaaaactgataaaaaaaccgatgactttcagttaatgctagaaaaaaacaactaaaaccgatcggtttccacaaaatgaccgctgacgatttcatgaaaaccgatcaattttgtgaactctggttgggtccccactgctgtttcatgcccaagttgtgagatgatttgtgggctagggcaagggtccaaaaaacacactctcatgctggatagagaatctggtgataaagaagtgtgtctggttttgtatgtagctgaaccttttgcaagtgtaggtgttaattgggtgttttggaccagacaataccatggcacctataagtgggtgcttctattgttacacgagagaggataagaacttggaagagacatgatagtggcaggcaagatcacagttttttttttcctttttttttactctggtcatgcattgtatgatgatgttctatatggaacagagcttaatgatgtggtgtggcttgtgatgggctctacgcctatgggctatggccatgtgcatgacaaaaccaatgatgatgcatgctcactcgatcatttctgtgagcaataaggtcttcaaaatgaggctttgattgctaattctggttgcaaaacattagaaaaaagaaagaaattcataatatcatgagtccataatagtaaatttttaggcaaatctatgcatatgatttccatacaacatcttatcgaaatatataaaaaggatatcagtgttctgcattgttaaagaaacccgcctgcctcgaggtatggcatgcagtgtggaactaagtaggatccaaatacaagaaagtgaacactattgtgaaacaaatttctaggagataagttttttttgaccaatccaaatcggagtagagataaaatatatccctcctaagacccttgtatatagaggggcagtatgagacatctatgacgggcttgtatttgagattagatctatgatgaatagaggacttcatcccacacatgtgtacattgtctacttctgtaatgttcttaatgataaagaaaagcgccacaagtgttctacatcttctcatgtctctactgctgtacaagggacggggaacggatccgatgatccactaataggcgcattggtttacaacaaacataatgcggtgaaattataaatataggatccaagtaccagtatctctaggtagagatagaaagcgacgcgccatgcgtgccatggaccagtatgcaagtatgatcgagagagcaagcggtgacgtaccaacgagtgcacgaggccggtcgtcgccgacgagggaagcggcggaggcctcgctggcaccggcggcgccatgaaagcattggttcggcggtcgctgccctctttaatttcaagttttggaaccacaaccaaaaatgatataaaaggcccaaaataaaacacgctccaacgaaagtattgatgggcagtgtatgtatctatacaggcctagtattaatgggccggaccaaatggcccaaatccgtagctcattataatgggcctttcttccggcccagtttggcctgtcaaaaagtccaccgggttttgcatttcactgcactgcagcaagccagcaactcgtacaggcagcagcattgattggcatcagatcacggatgttgctgattcatggcgattcatccagtgcccgttacgaaagcgtcagtgaaagccatttactacgacctcgcgtaccacgcaatcctgacaaatcacatcgatccacgcacgaaagaacagatcgatccatccatcgagcagcaacacacaaaaatcaattcatggagtaattgcctgcacaattgcagcagaaaatcaattccgaattaattaattaggtcatgtttagattccaactttttttcttcgaatttctaacttttccgtcacattaaatatttagacacatatatggagcatcaaatgtggacgaaaaaaaccaattgcacagtccgactataaattacgagacgaatcttttgagtctaattacaccattatttaacaatgtgatgatataataaacatttgataatgacggattaattaggattaatagattcatctcgcagtttacatgcggaatatgttttgttattagtctaagtttaatcctttaaatatggagaaaatcccctgtgtatcattgaaagttcacctaatcccttctgtacctgtgaattttgctcaattccttacatacccctgaattttagtttgtatcccttccatgccctttccgttagttgaccgttaaattcttatgaaaaagtccattttgccctttggtataaagaagcatataaattaacatagtatattgttggagcatataaatttgttatatgagactattatgtttatgagatagttatgcaccatattatttgcgataaatatacttttagatatgacataaaaaattaatattaatttattagttattaaaagattttttttatcatatgtgttctggagtaataaacaaatctgttgtattactatgaaaacacatatgctacataaaagaacttttactttttatatcatatgtaaaagtaaatttgttaccaataatatagtgcatcacatattcataaatataatagtcttatccaataaatttttacattccaacaatatacttcattaattcattatgtttctttatagcaaaggtcaaaatggactttttcaaaagaatttaacggtcaactagcggaaaggatatggaagggatccaaactaaaattcaggggtatgtaagggattaagcaaaattcaggggtatagaagagattaggtgaactttcatggatatataggggattttctcttaaatatgtgtccctgtgagtaaaaaaaaattttggccaaaacaactaaacacggcctaattaacgatcgttcaatgcattgcaatttggcaaagtttcaagaatcattcatggcggcgttgcaatagcaggacaggagagatggagcatgagcccgccatcatggcggcatcggaatcgggatccgcgcatgtgatcgacgacttgaccatctccatctccctcctcgtccggccgccgccgggctagggcttagggctagctagctcgtcgcttttacagctcacaaagccggcgaccatgccggccacgcggtggaggctggagccactcatgccgactaaaatattccatcccgacctcgccaaaaagctccatggcgtaggtgagaaatcaaagtggtggtggtggtggtggtggcggtggcggaaacaagccccaggaatcttccccctccgcgccccaatcatggcgcactaccactagctttgtcgatcacaagccctccctacttgttgccgcgccgccacgcctcctcgagcgcttcgtctcggcatcctatgatcggcatggaggtggaggtggaggatgacatggtggagtggtatcgctgcggtggcggcggggcggcggcggcggtggaggtggaggtgagggagctgagggtggagctggaggtggagcggcggatgcggcggaaggcggaggcggtgagcgaggtgctcgccgtggagctggaggaggaaagccggcggcgcggggcggcggaggcggagtgcaggaggatgcgcggggaggtgggcgagatgcgcgcggaggtggagcgcgcgctggaggaggtcgacgacgagcgccggatgctgcgcgtcgccgagctttggcgggaggagcgcgtccagatgaagctcgcngacgccaaggccgccatggaggaggcgctgcgggagatngccgccgcctccgccgccaccgccatcgccgacgacgacaacagcagcggcggcgcggcggcggcggcggcggcggcggcagtccgacgaccaccagcaagtcaagcccca

SEQ ID NO: 12732 - DNA, 10953 bp, Oryza sativa
  unsure (1)..(10953): unsure at all n locations
cgccgccgcctcccataacctcgtcctgtaacccactaatctagagttactaatgcttactaactaatgatgtactactaatgctgtgatgacttgtgaagtgtctccataattccttctcttgttcttcacaatctattgcccttatgtgtctctgggcattcacattttgatacgcaatgcttcccacatctatgcttgctcttgtaaaagaacatctatgcttgctcttgtaaaagatagtaacatttttgtatataatcatggcaagaactaatgtgtgattatgcatgtcactaacatgctgtacatggaaactttttgctactccattaagcctactattggagtatttataggtgctaagtgctaactagttcatctgtgatagaattgcaacagcagaggggaaaacacagtagtacaactggttggtcagattcagataatgccttttgcccaaatgttgaaagtatgggactcactgactagtgactacagttacaactcaaactaaaacaagtatatggttaaaaacttcatattttctcagctgcctgatgcaatatttggcagatctttgcattcaccttgctagaagaactcaaagtctaggtacttgcctccagactctacctctggaggccctgccattcttttgctgctgttggtgctgttgcaattgctgtggattgccatctcgacggtgtccaccggcggcggcttggacatcaccgtcgccggcaccgccgcggcgacggcgacgggctcgacagccctgggcacgccgggcggggtgctgcaccggatgagcgcccagttgacgccgtcgaagaaggggtgctgcttgatctccgccgcgccgcgcttcacgccgagccgcccctgcggctccttggcgagcagccccctgatgaggtccctgccggcgttgctcgtcggcgggtggtccgggaaccggagctgctggccgacgacgttgaacagcgtggcccggttcgtctgccccttgaacggcgtcctgccgtacatgagctcgtgcaggaacaccccgaacgtccaccagtccaccgcgctgccgtgcccttcccccttgatgatctccggcgccaggtactcgtgcgtccccacgaacgacatcgaccgcgcccccgtcggctccaccaccacctccggcaacgccgcggcggccagctgctgctgctgctgatgatgatacctctgcctcggctggctgctcttgggtttcttgccgaacagcttgggcatgaagcacgtcggctggatgcaggcggctggctgggcggcgcacgactgcgcattgttgcccctcttgggatcggagcccagggatgacgacatcaccagcgtcggcgagacggcgcagcggagcgagaggtcgaagtcggagagcatgatgtggccgtcgtccctcaccaggacgttctccggcttgaggtctcggtacaccactccgagcatgtggagatactccagcgcgaggagcacctccgcggcgtagaacctgcaaagccccggaaaagaaaagaataaatcgtatgcttcagtttaagatgagctgatgaagagaagaatatggcggatcaaacaaacgtcatgaagaagattacatgatacatcagaaatattgggaaaaacaagtaggataatcatgtttgttaattcagggacagatcggaaaagatgtctatgtttgagatacctaattcgaacacaaaatgggttagtggggaaaatgctactatcaacctttagcatgacaactgacacatgctttgtggtctgctagatttgttaattttagatatcctgttccacaacatagaaaaagcagcagacaggcaaaatgccccactcgagaagtcggagcataatccattcactatactattaatacactaatgtcaattgaaatgctgaaaaaaaaaactaagccattttgttaatgtgtcaatcatgcatcagttccagcttcaggcttggcaagattaattttttagagaagaaaatttctgcaatactgaaagatttctccagtgacagctctgaactgccatacctgatcttgtcactttaaacagagtatggtttcttgctgaatgctaatcctatcaagattaggagcctagagcaagagatggaattaaagtggagtgaaaattacctcgccgcgtgctcggggaagtgcttgccgggctggcgctgccggagagcatggaggtcggcgccggggcagaactccatgacgaggcaggcgaacctgtcggtctcgaagtgcgcgtacagggtgggcaggaaggggtggtcgagcagctggaggatctcccgctccgactgcgcccaggtcagctttcgccggctcttcagcgacgccttgtccatcaccttcatggcgaaccacgccctcgccgcgccgccgccgccgacgacggagacgttgctgagctcggacaggtacaccgtcccgatgtcgccgcacccgaggcgccggaggaggcggaagttgcccatggcgagcggcccgtcccggctcgcgccgcgaggatcgccttccacctcgggtcgccccccttgtgcgggttcccgccgaagcctccgccggcggcgctgccggcgccggccgtgctgttgctccacccgctgccgtcgctggccgcgctgctgctgacgctggtcttggcgctgaggctggtgacggtgcagctgggcgcgatgctcgtcaccgtggccgccgcgccggagctgtcgatgctgctgtgcgggctcgccgcgccgctctgcggcggcgacgcgtcccacatgatcaccggcttggccgccttgtcccggccatccacggcaacgaacaccgtatccatctcatccaccggctccggcgggtggctcgccccggagaaggagctcctgggcggcgcgtccccgtcctcctcgtcctcgctcgacgcaatgctgagcctcacctgctccagctgagcaagaaccttcttctccgacgactttcctttaccaccaccgccggcgccgccggcgacgtncatgtggaactggaacaccttggggagaagctggaactggaactggaaatcttggttgggcgcagaaatggcggtgggcaactgggagcgcgagcgcgcgtggtgaccgtggcttcttggcggcttggcgtgcagtgagcgtgacggatgcatctcctctctctgtgcttggattaatggaggtgaaatgcaacggacaaaagaggttggggagaaaggacagaagctgcaggatgcagatggagagagaaaccaaactgcagcagcagcagcaggcgttgcaggctttgcagaggagagagagagaatccgagtgagctgcagaggaacagaggaagaaccgaagaactgctgctgctgctgttgctgctgtcttcttcctctgcttcggctgcttagatgttgctgtttgattgcaatgcttatattaccgttagtgaagaacaggtacagtagtactagagggtttggttgataagctgcggctgtcagtgtcgtgggcctaaggaatgggtatgctataccggttttggagcgggtttcgcttgaaatggttcagttctcatgttccaaacaggtttgggaatcctttaaaaagcaggatttttatgggttcttggtagaaaacagttcagttcctatgaaattccttcgaaaatcatacgctccaaaggagaccttaactatatataagaggcagtgattcacaaatttgttctctctatggactggcaactccaacttcaagttttttttagctagatatatctcttgcttcaaaaattcctggagttgaatatgtgagtgaactaatattattgtttatattgtggacccaaattagatgactaaaccactttactttagtctacaaactctattttctacgagtactcgagattatatagtcatgacaaagtctttgagcactcaatggggactaatcctgaattttcaggacatcttctaatttgttcaaaccaactactattaatattgtacaacacgaaggtattactatacaatagtactactctagtactcatctactcattgtttggatggagcggtaaccttatgtattggcacattttaatggcatgatgctgtggcttacttactctgcacctaacctatagaactttgcgttgtgtttcagtttctatacattgagcattctatcttactcaatgtcattgctatgagtagcatattctttacctcctaaactgtccttcctagggatcatcttgttcaaaaccaacattccctttattctagaaaagggtgaaaaaaaaggggaaaggagaccatcaccagattcctttccctttctttcttgaaagaagcgagcatgtcttttgatgatttgatccaagagagattgaagttgcatttttttttgtagatttgatccaagcgagcatgtcttttgtagctgaggcaagatcggtcaaagggggtatgtggtgcttacctgtgtgtctcgttctttgatgcgccgatttcactttgtcagtcatcagagtttagtttagtggtgtgctacaagtttgttgctgctgcttcgtgtagggatcgatggagcttcggcttggatcatggcacacaatctgatgatgcatccttgcttcttttttccctagttttgtttgtagtggagtagcagcagcattgcagcagtagttggaagaatgctttctgtgaataagccagagaaatgacaaatagcttttgacctgtaaccatcaaagaagaagagacatcagctgcaagcctgcaacgtactactcctatgtagaagaagagccaaaataatcttctctgggaacaacgtctgcaagagagctggttgttgttgtggtttttgttgaccatgaaatagtgtgtgtaacaaaaaagacgagcactggatgagccttacggcagttggcacacagcaccatttaggtgttggtttgctggggaaaaaacagatcttcattctgacaagagacctaaacagagagatgttcatcacattcaacacttcgattactccattacttcatcaaaccaaaggaacacatgtatgcgcatggctttgcagactaactcagttgcactaggtgttttgattgatgataactcgtgtttttgtgccactaccgtggagtggtggcacagtcgggaagatccatgagcatatagtttttgacttttaacagtacgatcatcacttaagacttcaccaaggacaaattaataatcaggatgcaagttgcaaacaaggacaagaaatgcaagagcaaatcattagccagctagatcaatgtaatctacagaaatctacagaaatataaatatttgagctaatgcttgaaatctattgtcaaaccggacagttctatcaattacaaaacattagataggtttgaaccaatgtccttaccactgaagagtctgagtctgaagggcgttatccaaagcacattggcccatcttattcacgtaaaaccccaagcaaatgatcaccggctccaatcgccttctgaaattcaaacaagaaatgcatcagcaattcagcattgcccttaatcaccatccacacgaattgcggcatcgtggtagagaacatgtattggacctgcagcaaaactgttaacagtacattcattggcacacatgaacttccatgtatcgaaggactgaagaaatggcacaccctgaacataaacgaacaccaacaatcgcactaccaaatcccaatcccaaccgatgacggcagattcgtcagacgagaagtgggtggcgcagcgcagcgtagtgagggtgctgacgactcgcctcgccgccatggcgagatcgatgggggcggctgatcccgcccagcgatccgcccgttgatgacctagtgtgcgctgccgtggcggcgcggggaggcgagaggaaagcccatagatatctccgcggaatcgatcggaggcggcgtggaccaagcaggttggggaggaggaggataccatcgccgccgagcagagcaccaccaccaacctcttgatctctcctctcagcgagcggttccactcgggttggacgaattcgagggggggtgagagatcctgagatctacagaatttcccttgctggccatggaagaccagatcgtcggcgaaggaggcggcggagctcgccgggaacggtggcggaaacggcgacgagggcggaggatggctggtcgactacgtggagcatcgcaggccatccgtcttgatccgacggccctaagcgcggccgaacaatttgggccgtattcccaggagcaattcaccagcagtttgggccggaatgggatagcctcgaactcaccaagattaattgggccgagtatttaatgggccgttttgctgaaccgcgagcaggcctgccagtaatggcctccatgttgggccgtattcaattgcaacgcagcgagacaaggcaggccgacctgtaaatgggccttttggtcagactgggtatcttggcccagtagttcaccaagacaagaaataagtttacattggatcccttaatttgtcgtcgagtctaaaatttatacctaaccgcaatacatatggcgcatccctagactttcaaaaccaatacaaataagatcccaatatggtggttcggctgatgtggcgcctacatgacattggcatggcacttaaagtcaagaaaaaccatggggtcgacatgtcagtgagtgtctgattaaaaataaaaaaatgcagtgggtatcgccttccttttattttctttctcttttctcctttcttgcttcttctccttcccggcatccaacagccacccatggaccgccatccttctccatgccgaggagccacaaggttggcggagaaggggacccggtttagcactacgtcagccgaaactaccgttgaaaccgctttggaatcttatttgtattggttttgaaagttgatggacacgtcatatctggtagtacggttcaggacggatttcagattcaatgataaattgagggatctaaagtaaacttatatcccgaggcaacggcaagtggttacggtaatacaacatgatttacacagtatgacgacttcattttaaaaatctaagcttctttcaactcccatacatgcatacactgacatcaaaatatatacatagtccgtactacacaagtactgctacattattttttaagggactgctaataatttaattaatcaatcaaccatataataaactatattattacaaatctaacgcaagccacagcaggacaacaagcaggtgtgtctgctgaagcagttagatatatttttttatttttattagagctaaaaggtaaaataagccataggctagcacgtcgttagcattgagcacgttgcggtttgatagttggctgcttatctactccactaccactaaggtgcatttgcgtgatccatccagcagcatagtgtgcgacaaggtttgtttgggctgattgcattgcgtaacaaatattcttttcttttaatatattgacgtgcattccaattacacgtttgagaaaaactagatttgtttggagagttttggattcggagaaatagctagtgagaatataaaatagatgtggaaatgatcacttatagtttttttaatctacaactgtacagcttttgttataacttgaataaaagttaaaatatttaaacgaaaattttgatttgagagaagttaactgatggaatcatatatatcgtctccgacagtgcaaggggagaaagaatgtgtcatccactacactgaccactgttgacacgcacgccaccgaggcatgcatccacagatccacttgcattctcgctgtgaacgtggtagagagaggccggtttgtccctgcatgttgccactcctgtcactgtccttgttgcccatattacattcagccaccccccacacacatataaaaagaaagaaacatccacttatcatatcttaaaatgtatttatagagactttatataaatctaaaaagtaggtcaaataaaatgatgaaagattgttattggttgataagaaaacgtagcgggacattaaataggagaaaattatgattagttgagatgaaataggtgatgaaatattttaaattttggaaaaaaaaaactaaattccaaaaatagttatgtttttggacggatggaatgtattgttttcctcaaagagtgatgcatattatatatatggagtagattttctttctacggattttcagaaacaagcctctgaacgaagttacgaaactcatgtgaatatatgacctatcttgtacgaatggggggtgaatccaacatggatttcagcggctcaagcatttgaacgaaagtttgcacattgcttgcttaacctctttggcactctcttcatcgtagtaaaagaatagctcatgaatataaatctggacacagggaacagtggcggatccaggatttgagcaaagggtattcaaagctgaaaaaaaaatcatacagaactcaaaaaattggactgggaaaatcatacaggagtggtaatgacatgtttaaagccttaaaggtacaaacagtagcacaatagtcaagatgtctatctccaactgcacacttggggacatatcactatcataggcattgggtgcttcaagtagtagctgaataggactagaaggggcattttctgggatctgaacttcactctcaatggttaatggttttggatcagaggtggaagctactttctgagacttggttgacctttcccacaaagacttcaaatctattgtcttcttcttcttcatttttcaaatttcaagacctacagttcaaatttctgactaatttaacttctaagcaatagcaattaagcaatggccaatcgcttggggaatttgacaagaggatttattttaccagtgccagtccactgtccagctgtctagggaccaaggggacgcgccgacgcgggggtgcgtcgccgcaaccggctgccgccgtgcgccgcagcgccgccgccgtccgtgcgaacctcagctgctcagcgtcgcccgtccccgagaaggcggcggcgtcgtcgcaggccacgccgcctccgcagcagcaggcccagggaccagggtccagggagatgaggctggtggcgattctggcgacgcgccgagccggcggccggcgccgccgagcgtcgagctctcgatgccccgtcgcccgtcggtggggatgagtggaggcgcggcggattggggctgggacgacagaaggcgtggggactagctgaccgggggatagggactagggttttgttcgtttttgggccagtgggcctattcgttgggccaagatggggaggaatgtatggtctgctgcgaataaatgggcttcttttcatttgggctatacatgctgtacttccttctaatttctcatgtatatatgcataacatacctatatatagttatttttttaaaaattctatgggtatccaggtgaatacccatgaatcacatgggatccgcccctgacagggaattcgttttttatttatagagggagtaacaaatagtcctggagctcttgtctaaataataataatggtatttgaggtacgaacttcagtagttcaagcatcaaatcggtactgtatgtcacatatgcttgtgcctgatgatgcacatatgcacccaatgatgcacgatcatgagtggttgacaggggcgaagctagcatcaaaataagagggtgcactaccattgagaatatagaaaattttaatacaacactatatattttagtctttttaagtgagaaattaggaattggggggttcatgtgtaccccaaacactatatagctttgccactgatggttgacagatttcgtaatgtccagaaaccagtcatttgataacgaccacctaatttgccaccaaaaagcatacgcataacgtacgactacaccaacaagttcatcgttagttctcaaaaaaagttcaccgttaagttgactcaaccgcatcacctcttgatcatatatgcagtagaattaatgcacatcaagaaacacgtgcagatacatctcaattacgagttaaataccattcccgagtaaattacattggtggtatataaacttgttaggtgtgtgcaatttagtatatgaacttgtaaaatgttctttttttacacgaacttatctaatacgtgtgatctaggtctaaaatggcttagcaaggttaattttacctagctgatgttgattaggatgtggcgtccatacgaatagtgagtatgcataaaatatgttatatttataaatttgttctctactttatcttgaatttcatatgtttctaacccatgaatcattgctcggtattttatatctttctctacgatcactatatatcattctatctttttattgaacaagtgtatgtctctacgtagtatcctaatcagcatctaaatcaacaaattagttatataatgtccttttgactttaattcatatgagcaagaaaagttcacgtatcaaaacaagcattttacaagtccatacattagattgcacccacataacaagttcttgtactatcgatacaatttactcctataacaattaaggtggtacacgacaatgcatgcatgctacagtggtagtagtacgcaacgatcatgttgggctagccaagtagccgtaatgcccctcggctccgccgccggcgccgttggcggtggcggtccgcggcgtcgccggctcgaagccgagcaccctggcgcgctcgacgtaggcgcccctcacgttgggacgctggtaggtcagcagccgcgccacgctgcggctcgcgtcggcgcggaac

SEQ ID NO: 12733 - DNA, 68077 bp, Oryza sativa
ctcagctcctccccctcgaagacctcgacgaggcgcctcacctcgtcgactatggcgtcgaagaggctgggaccgtggtcgccgcccgtcttgtacaggctcaagaaccccttcgccaccttcggcgcgttctgcggcgagccgacgtcgtcgtcgtcgtcgtcgtcgaccggcacgaggccggcgcggaggttctccgcccactcggggcacgtccccgtgccgcgcaggacgatggcgatgtcccggcggcccatgcgctggacctcgccctcgttgtcgcagacggcgacgtagccgacgaagctggagcgctgcgtgagccacccgggcgccgaccgccgccgcgcccacgccgggatggacagcgacgacgtggcgaacaggctgcgcgtcggccggtacgaccggtcggggagcacgagcgtccggtgctggctgtgctgcgacgccgccgccgacgacgacgacggcatggagtggaacgccgtgtacgcggcctgcacgaagtcgccgtagcggaggacctcgcgccggaggttctggtcgagcgggtcgagcagcccgtcccagccgccctcgctgtgatacctccgccactcgccggcgatggagcctttcggcgagggccgcggcgacagcgtgaggaggcgctgcaggtgcgcgaggctgcgcggcgacatctcgtcgacggccggcttgcggacgaagggcaggaacgtggacaggttgagcgcgttgagcagcccgcagcggccgctccggtcgtcggtggtggcggcgccgccgccgtcgccgaggtcatcggccggcggcgcccccttgttctggagcggcagggggagcggcggcggccgaacgagaagccggtcgaggttggcgaggtgcgtcctggtggtggacacggcgttcggcggcgccgcggcggccgccgccgccgcggccctggcgttcgggttgagaggagacggccgggcgtggcccggcgtgccggtgacctcggcggcggacatggccgggaacgcacagacagtgcactgacagtatctcagagacagcagtagaagctcgcgagtggcgagggcgcgcgcgccggtgtctggcttataacccgcccggcgcggcgtggcgtggcgaggcagcgcgcgcgacatgtgcatcatgtgtgcatacgagcgtgtactgtgtatgtgtgtactttgtcaggctacggaaatttgtgtcattaagtctgactaatttacctcacttattggagcccttttgaaaagccaacttaaaaaatgattaagcaaaatcacaaaagcaatggagatcaccgtccaagactgggaaatacaaggtcgtaaactaagtcaagtcaagtcgaagtaaagtttagtcactgagtcgcatcgcatcgcatgccgacctaaatcgtgaaacaggaaacatactattacaccatcatcctatgtaagtattttccccaacatagaaaaaagttacacgacaatatattagaagaaaacaacgttttaattacataacacaaacaactaaagtgttattgtcgggggacgagaaataaaaaaccgaaaagaaaagacaacttatagacaacttaaaaaagatgaaaaactcctagagggcggagtcccactaaactcctagcaaaagtcctcaaaagcagcagttccagcagatgaccacatacggccttcctggaggatagactctagcaccattgaaaaccgaagagagtgagcgatcgaatactctaaagttctgctcattccacagttgtcaggagaccaggaggaccaaagagtcgaagcccttgcgaagatactcaggtaaacgagccctagcagacggtcaccaaacctagagagaacaaccacagaaaagagcgaggtcgggccaaccaggaggagacagaacatggtaccatacttggcaagaaaaaacatagttaagatggatgtggttcgccgtcttctgttattgggtgcagaggaggcaatgtcgagtgactgtcgataccacactttagcagaaggtcgaccgtccaacaacattgcagaaacgcaagccactcaaaagatcctccataagtatctattgaggccttgtttagttcccaaaatttttttccgaaaaacatcacatcgaattttcggacacatgcatggagcattaaatatagataaaatgaaaaactaattgcacagtttgcatgaaaatcgcgagatgaatcttttgagcctaattagtccatgattacccataaatgctacagtaacccacatatgctaataacagattaattaggtttaataaattcgtctcttggtttccaggcgagttatgaaattagtttttttcattcgtatctgaaaaccccttccgacatccggtcaaacgtccgatgtaacacccaaaattttttttttcgcgaactaaacaaggcctgagtcttgaattcacactatttctgccaaacactgattttccctgtctttttttaagcaacctcgaatttgtccaagtcatgaccacagcacatacaattttggagtatcaatcaccattcattcagctaaaacatatccctaactattatctaaaaaaacatacccccaacttcgaaactttcactagttttttgtgtttggagaatgtaaagaccagcccagttcaaagaaggcattgtgggctgtaatagtggactaacctagacaaaccatagttgagggacgtcaaatggactttcccgttcagtcattaggactagctgggccatttctttatctattcaagtggcccactttaccagtgcagttttgttctacgtaggcgtgcgttttttaactcagttttgtactgcggcggctgtatgatattcctagtttcagacgaacaagagtaaacactagggttgagtcagtaaatccacttcagttactaagatcatctatctatctactactgagtaaaaaattaaggaggtttggataggtgataccatacgaggtagaaaaaccgggaggttgacaaatacgaggagaaaatgagaattccagggttgccgtttttcactctctgtcaaaagaccctagcttctctcgtctgcaatttgctcataatttgtcacctcgaggagagaccgatgaaaatccatcgatttaaaatgtgaattgaacttatccacggtcatgactcataacgaagataaaaacagttaaaagcactactagtcctaattggagtactacctcgtaaatggagtaactatacacaattgcacatcgatgcatgatttgattaatttgatgattggttacgaaactacggatttgacgatcgatgcatgttgctgtgcattccattgacaaacaagtcgatgaagtttcaaaaaaaaaaagacaaacaagtcgatgatgatatctattcttcttcagaaaaagaaaaggatgcaagaggaaaaatactactgatatctgtatgctagctagctgctcgattgtcctgctatacctatatactccctccgtttcaaaatgtttgacactgttgactttttagtatgtgtttgaccattcgtcttatttaaaaaatttaagtaattatttattcttttcatatcatttgattcattgttaaatatactttcatgtacacatatagttttacatatttcacaaaattttttgaataagacgaatggtcaaacaagtgctaaaaagtcaacggtgtcaaacattttgaaacggagggagtattctcgaccatacgttatgcctatgccatcatcgatcgatacattcaagggctagctagcaatgcaagatatttccaatgtgatgagagatatttatgcccacatatatatgcaaccatgagctaataattcattcatcgatcgacgagatatatagtaatgctgaacagaaacgaatgaacgtacctgcgtacgtacgaatgtacgatctgaatatctgaatctgttgttcatcgatcaacacgtggaatattcgaagctgcaggcaaattgcaacccaactggcaaacagttatttctttctttttttgtcgcaattgcaatgttctttctgtccagtgtggctacccaggcaatgacacaatgatgccctgaaaaaaaaaaagaagagaagattctgagttactgacactatacatgtacacgtagccaggttcagtctctgatcgttgccaagaaattgacgcgaaaactcctgccaacaattagatttagttcgatatgctaccacaggcacaaccaaggagatctttttttctctgagcatttcaagaagattttagacgtaagtaccgacgtcactggaagacagggaaatgagagggatggcatctcttccctttagccttgggcatgccagagatgaggtcaacgagtcctgtagttgcagggaaaccatctgattcgtcaattaacaatttaatactccctccgttttatagtgctagttattttgactactttaaatttaactaatttatataaaaatttagtaatatttttcaacacaaaacaaacataataacaggtagaagtgaaatgattgtgttcctctaattttgtgtatttctaaatgttagtgctgtgagaaagggaaaaatacacacacgttttttttttcatatttccaaaagtgtttttttcaatcgtaggtgacataccatatgtacaagatgcgctcacgtggatagtttgataatcaaatgatttacttaactcatattagtaatctaaatgtgtattttgaaagtagaatgatatacacgacacacataaacaagttaaatgaccctccatatattttactgcataataaatgttagttttaatgaaactaattttgtgttgtagaaattgctaaacttttctataaaattgataaagttaaaagaaatttgactagtaaaaaagtcaaaactgagggagtaccaacaaaaggactaaaattttcgtccttttttgctgttaaaataatttaattttttattattattcttttcaaatacatatgcattttataagaaaaataaaccccctctataaataaacagagaagaggagtgggagcagtagtctcctccaaaccgtcgagagcccaacaataataatccccccttttcatcgcggcgacgatacccgccattttcatctcattctcaccaccaaaagcgaccacgcagcgaccggccaccgatcgagatggagcagcatgaggaggcagcggagaggaagccttcgccgccggtgatattccggctgttcggcgtcgaggtccgcggcggcggcggcggagttgacgaggaggagtacgaaggaggaggaggtggagggtggattgttcatcaagaagagctccagtatgcccaacctcacctccatcgacccgctgccggtgccggccgacggcggcaaacggcgcgcctccgacgactccgagctcgcctccggccagcagaagcgccgccgccgcaaggtgcaggagaggaagaaaggtgagcaaccaccctttttgtctgttcttgtatctactgttcattacttgttccatcacctgattcctttttttttactctgaaacttccaactcactgttaattcttgacgcaatttgatgatccgtgaaagcaaaaaaaaaacaaaaaaaatatctttgattgagcaaccaacaaaattggttgaaaatcccctcttccaaaagagagagaaaaatgattaaccttttgtgtgtcagtcaattggtcaacaacacatcgataacaatccacaagcaggttctcagacctgaaaaactttttactagttaggagtaattaattattccctgtttgttgcttcctgtgaagatcatgtgacacttaattgcctttgattgattaatctgtgaaggggtaccatggactgaggaggagcacaagaaattcctggaagggctgaggcagctggggaaaggggactggagaggcatctccaagaactttgtgaccagcaggacggcgactcaggtggccagccacgcccagaagtacttcctccggcagaccaaccctggcaaaaagaagcgccgggccagcctctttgatgttgttgctgagtgcagtgatgatcaggtcagtgacagtgcacttctttgatcagatccacgcatgttgggatcttgcagctaatgctcttgtctgaaaccttctgttgcagcttccaagtcctcagagtgttggaactaagcctcctacccaggatataattcatacagatcgcggcgatgtcccggtaattttctactttgcttccattttttcttctttgtagccacaagctgagttgtaattacccttagatgattactggttgtaacttgagacaaacaatcctatctgaagactgaatctttaatattgctgcagatactaagctatccagttgctagaggctttagaggcgatagcgtgcaggtaaaatcagcatctgagaacatcttcatggaacccagcaacagtctgaccaaaactaacacaaactgatccttctgtcaggttgatgaactaactgaatatgtgaagagattaaaggccgccgaggacatgtcgctctccatgatctctggactggaaatggcatcatcatccatcagcagtctagagctcagtatcgcgcctcctcattgcgcgatcgaggcggccatcaaggtgctgtgatccagacgcaattctccaccgaaggaatctggatcggcttcagctactgttcttcgtcgccgctgttgttgtttgttgttgttgttttttttttttttttgcgggggttgtttgttgttgttgttgttgtagttgtcatgctaactttgtatttgggtcatgtggcgtttctttcagcagtcttatataatacagtgagaatgtcagtaccttccgagacatgtttaattaagccttggttggttggtataagttggtgaaaagaaaaccagatagtagcctgtctgtattgtacggttgcaaaattggagtatattgatgcagagatcatgaagggtctccatcttgttcataagtctagtttgtttcctgttcctgtcacaggaggcagctgggacatcttcttgtgtggctctgagcttcttccagtgcttcaataattggacccttccccttcatgtccttgtgaccattggtcccagccaatccattcatgccactctcgtaaaaaacacaacaatctctcttgtcatcatgcattcattccagacttatgcttgcttctaacagcagagaatgaaagccagtgaagaatcatgcagaattcagtttctttcttctttttttttttactgtcaggacatgctggtcacttatgcttgctttgcatgctaagaactcaaacacaacagtgaactacagctactccacaaagaagcaaagcaccagctttctttgcatcaataatggcccaactgttaagatctctaggcctagcaagataatggatatgcagaaatcatgccatatgctacgcagagtctgtctactgcaggtctctggagctgcataggaagggaaaagggagatggatgggatgtggtcgaatctaggccaggatatgtggatctcgataggataagtggtccatgatgaggagaaaaacacaaggagatgtcaagcacgctgcactgctgctgggtctcaacctttgcaaagaaagatgcatggcatgcctaggtggctcccaactgaatctctctgctgctgcttggtttgcatgcttgaaactcaccaaaatcactgcaaaactttgcctcttggcctcttcgatcgccgtcgtcggtgcggtgcctgcatgcccccaccgttgctggtgcagagtcgacggcaacctgtcgtcgacaaaaggaaggaaagagagagatgcaggaataaagaaatggatcataggattgggaaatatgatcttcagagataaggtggagtggagatccttttctgcagttgttttcttcttttcagggttgtcacaactttttgtttctcgaggtggcaaatcaatggaataatgtcactagcataggagatgatattgttattttgttggtgctaacctcgttggagatattgcggctgcaaattattgacaagatctcgaggtggatcgtttctgatcaggaaaaaagaattagccataaataagtagacagacagatagatagatcctagtttggcctaacttgcgcatcagcaagaagagccaaggaaattggcaaacagcaaccgaccatctggtcaaaatccagccacttgcacgagttgagtaccaaagattctgatgatatcttgagttaatgtattggaagattggtacttgaagtaggtttagtagtagtattccttaagtacgaggtcaagtcgtgtctttgtgattacgctagcgagcagcttcctagtacaagaatctagtcaagaaattgctacggccaacgaaagcatggcagcatttcctcctaattcccaagctcttgcctgctcatcgactgattctctagcattttttttttgttttcagtcaacaagttacttaccgagaagcttgggaagagtgaagaattacgaacactacagagtgaaatttcataggaatggagtgtagtacagataaactacaaacactagtagaatggatgcagaaaggatgagtcatgagtagtttatctgtactacactccattctactagtgaaatttcataggaaattatcacagcacagggtgctttacttgtagctatttcaattgaattcatgggaaggaacaagacttatctttgcttgaagtgcccaggtgttgactttgtttcatttcaccctagtttcagtcaaaatgagccgtgaaaattcagtctgcggcgctgcagcactgaatctgaaatttctgaacatacatatgtgttagtccgacagtgagaaaattttgaagcaaaccagattcagaaacataaagatgcaactaattgtaggtcttgccctctcatcttggatggactgaatcactgaaaagtaccctctccgtttcaggttataagatatttttactttggtcaaagtcaaactgctttaaatttgactaagtttatagaaattaataattaaatatatttttataataaatttatcttgggtcaaaaatattactccctccgtcccataatataacaacctagtaccaattggatatttcatagtacaacgaatctggatagataggatggtgtctagatttattgtactatgaaatgtcacatccagtagaccagtactaggttgctatattatgagacgaagggagtactattttgttctataaacttggtcaaacttaaaatagtttgattttgactaaagtcaaaaatattttataacctgaaacggatggagtaggatggcatggcctggactctgaatttttctgaaagttgcaaatgtgcaacgagacattatcaattgatcatctacacaggtgtcattatcaattgatcttctcatcttaacaaatgggatgattgcagctagcttctccagaaatcttagcatttgatatcgcaggacgccagtcaaaacccgtttggtgctcagaaattccatccattattcagaaacgctctcaaggacttctctcaaaaccatcaatcggtgaaggctcatctcatctcgtctcatctatgagatgaacaagcagatccgcgtcccaacccagcgatgcaacagaagcccggtaaggggcaagagccggcggcagaggtttagcccatgggctggcaccgacggaccagcaaggcacggcccgctacagttgccgtgtcttagcgggcccgtgccgtgttgggctgggacgcccaattggcctcctatccactagctcgatcaatatggccattttatgggccagatttcatgtggccgttggatactatggacctgaacgtgggcccaacagctgcccacactcgtatgtcactgttacgcgggcccatatagtttctagcacacatagggactgaacgtgggccacaaaacccattcagaagcccaacaatactcttggcccatgcctaatccagcacatatacctcgctgaaaaatatcaataagtccttgtttggtttggagggatcgaaggagattggagaggattgaagggaaataattccacaccatattaggtgtggaataaattcgggaccacctatacatttgtcgataaattttctcctaaaaatttgacagatgtaattatagtacaatcgtagtgtaattacactgtaacttatatgtaattacactgtaacttgcatgtaactacagtgtaacttatatgtaagtttcacataattttgaatcgttagatctattacaagatttattttggtgatgaagaaaacaaatcatagcacacacatatgcgaaagaatttattcccacaacctccattttatcgaaataacatgttacggagagatttttgaaagttacatacaagttacactatagttacagtgtaattacatgcaagttacaatgtaattacactacgattgtactgtaattacatctgtcaaatttttggggtaaaatttgtcgacaaatatatagcaaaattgataaattccctccaatccctccctcatggagattaaccgaacaaggcctaaaggatcttgaataatttcatcatttgtatcttgtgaacgttctattttctattactaaagagcgtacagagatatgcaagtcttttgcatgttcgcggaaaaaatactaaggagaagagccaagaggatgtacatttttttcagtttgagaggttttctgaaagttgctagagcagttcgagcactggaagtcaagactgaactttagtcactgccatgtgccatggctgcttgcctgcttcacaataccaagagcaacagattctgtcgattcacgcatcaactgaagtgtgacactcgcttacaaaaatttgactgatgtagtacgaaaaaaaaaatcaaagttggcgtgcggtgatgagtcagtaaagagcagctgaattcccaaaccatttgaaaaagaaaaggagaaaagatgctcaaagccaaaagggaaccgagatgagtaggagcatctcatgctgccctcaaaaacaagatcaacgcaactaatcccaccacatgcatgcatgaacgccacactaccatcagcattcagaaacccacctaagcttgcagaaaagctatcagcagcagaagcagtagttgcgtacgccacccaaaagagtgaggaatctttggtttttaaccacgcaaatgttcatgttctttcttcttctttttttcaggtctccagatcaccttgcattgcattgctctctctctgtctgcatatccgatgttctagttggtacagagtttcagttgtgtgaaaaatctttgttgttccaatcaccatcgaagtatcgaactcatctaatcaccaatccatactgtgtgctggttaattggctctactttatgatgtgtctttaaattactactcctagcttatgcaggattaggtgtagtttactgcaaagtgttgaacgagcttatattcgtcttaatccacaaagatgtatttttttcatgaacctttagtttggatatgtacaagagtaactttagtgctcaactgacgatcaggtacactgtccagctggtggatacgtacgttctgcagctgacttcactgatgactagtgtgcagagtaagcagctgcttgatgactgaagtatatgttatgttaattcccatttcatggaaactaacattgtaatctcgcagtagttatgatatttgcagttttacctaaactgacttctcactgaaatgaaatgaagctcttctgcattttttttaaaaaaaaatatttgcagttttacctgaatttacttcttaataaaatgaaatgcagttcgattaaaaaaaaacctttgcagttttacctggatttactgtcctgtcctgaaaagagattaacagctgcagggtggttaatgcatatgcatgctcgatcagcatttcgtcagagacgcgtcagtgagagaagacaaagagctcgatcacgttgaagcagcacaatattcgcgtaacatccacgagcgaatcaaaggcgtacttgtagtgtaaatgctatgtttatctgatataacatattttatgattttgagtacttgctcacttttttcctataaaaaaaaagaaacaagtctcatatatatatgcagggcatgtgcatttggatattgtggattttgttataaaatctgataatcataatgcatgtgctgcaaaaataaaggaccatagtttgtacaacatcttttttttgtttcagttcgtttcttttgtcgttctcacaaaaatgcatattccttcatatttttgcgtgttccaactcgcgtgtttagagctctttttttttcttttattcaaaaagaacaactctcatatatgcagcgcatgtgcatttggataataggaattttgttaggaatctgccaatcataatacatatgtattgtaaaaataaaatatcattgttaggacaaacatcttatttcgccgttctcgaaaaaaatgcatattctttcatatgttctttatgtttttgactcacgcgtattaaacggtgtgttacttgcatcacatgatacagaggccgagactgataaacgtgaaaaacaaaagaagaccaagagagaagtgcatatattcctttttctcacacaaaattcctcccttactagctaagttataccattttcctcaagcctccctcaccatctcaaactacacacacttgcctaggagagtagaggggaagaaaaacacaaaataaaaagagataatagatgagatgagaagagataccatctctagtaatctcgatgcatctccaacgcatggttggccataaagcccaagccaaagggtgagagaatttgatacaacttttattttgcgcgcgaaaagctatcaaagagagagaagaagaagagaaaaacttagcaaaagcagcttaaaaacagcgtcgtcacgctgcctcccgcttccccctcttcgtcttcttcttcttcctccaatggcggtggcgcaggcgtcgctgctgcagagcttcccgttcagggcggcggtgttcgcggcgtgcgtactgctgctccccctcgtgccgtcgccgcaggcgccggcggcggggggagatggtggcggcggccgcggccgtggggaggcgtttcttgccaaggtgtgggagctgctccacctgctcgtcgtcgggatcgccgtgtcgtacgggctgttcagccgccggaacaacgccgggaggcggggcgacgagaaggatgccgcggcgcaggcgaaggcggactccgccgggtacgtgtcgcagatgatccacgactcgctggtgttcgacgacggtggcggcgacgtggcgctcgacagcccgggtggcaacagggtgcggtcgtggagcgcgatgcaccaccccgacgagcctgtggtggtggtggcgaccggcggcgcagtaggcggccggagccacgccgtggggcggcgcagcaggcgccgccgctgtcgctgcccgtaagaacactgaagccgcagggcgagtcgtccttcagcgcgggctacggcgacggcggcgagccgtgggcggcgcggccgcgcaggatctcacaggacacgcccggcggaggcggcggcggccatgaaaccgtgctcccttcgccgatcccgtggcggtcacggtcggggaggttcgacgcgtcggcgccgagccccccttcgccgtcgccgaagaggctctccccggcgtcgtccctgtccaaggagacactagccaaggccagtgaggactactcctccaggcggaggagcccgtacaagtcatccccaccggcgccgcctccgccgccaccttcgttcctcgtccacggctaccatccgccggcggccgaacgccgcacggcggcgaagagcttcaaggaggagctgcaggagcaaacctcccacagcttcactacctccgaattcagccgtagcagcagcaactcctcgtcggcgaagccaagaatctccatagatagctcctcctcctcctcgtcgtactacccagttgccaaatcggtgagaacaatcagaggaggaagagaatcactccagagccagagccaagaacaacccgacgtcgccgtcgccggcgacgcgccggctcttcttcacggatcggattcagacgatccgtacggtggctacagggcgtaccaatccattcccaggttccagtacgagagaggcagcagcgaccccatcctgggcaacgtgacggtgtcctcggagagcagcgacgacgacgacagcgacgtcgacggcgacggcgagctctcgacgagggggaactcgccgaggagggagtcgtcgccggaggtggacgagaacgaggtggacaagaaggcggaggagttcatcgccaggttcagggagcagatcaggctgcagagaatcgagtcgataaagaaatccgcggggccgcgtggtgtcaagcacggcaagtagctcgcccgccgcccgccgccggcgatcaccggcgccacttttttacttttttttttgttctcgttttgagcagagatagatagtacggtactatttgtatttgtgatagctaattagtagttatcaagaaccacctgtaaacaaattacattcatgtagatgatgaatgagagtgagtgcatgttcatgctcaatttctgggcaaggagatcgactgttgcatctggcaatcaaactggatatctgttccattatctaaaaatcttgccatgagctaatctgctagtaaaacatagcagtaatctgttacttctactgtatcttcttctgaacttaactgaaacaacttcaggtttcagcctgtaattcattcagttcagttcagttccctttacagcagcaagcaatctaagcattcagcattcagcttcagttagctggtgaagaatctgatcctgatcagaggctaccctttagactttagcttgctggtttgattccaatccttggttggatgagtggtccaaatttacccagttgcaccagtagctgtaattaagcctgtaattaattaacttgagagtttctttcctgtggtgaccaagctgcattcagtactgcatttctctgtacttttctctctactgtatactatgtcagcttgttgagaactagattagatcggttggttgttggaagcacgctaggctaatcttggtgcgttgctgacgcatcgttgtcggttgttttgtcagttatcatcctggcatcatgctgaaattgatttggggataagttttgctctgaaaacaaacaaacaatacaccatatcaaggcatcgaaaggaatgcccaatgtccatgggttgttgtgcttccaagaatgtgtagacatgagtgaaggagtgaggtgttacgctggaaagaacaggtaggcaaaaagttaggaggaatatcaacaggtcatcatcatgttaattgttttcaactttacaaatgctacttttgaaactcacgagttatttggatttccaattagtaatagattgaaataggctcaatttgaaacagattgaaataggcataacttgacatagattattaaccgagcgtctgtgatgcattatctacacggttgtagatataaaatgaatattttggtaaattaacaatttttttggaaaaagaaactttacaccctctcacatcgaacgtttgaacacatgtatgaagtattaaatatagattagaaaaataactaattgcacagattgcgactaatttgcgagacgaatcttttaagcttaattgcttcatgatttgacaatatggtgctacaataaacatttgctaatgatggattaatcaagcttaataaattcgtctcgcggtttacttacggattctgtaattagttttttattagtgcccaaacaccctatgcgacaccctatataatacatgatgtgacgtgcaaaaactttacaccctgaatcttaacaccccataagcaatacggcacaagaaaaatttcttaagaagaatgtttctttttaggcacgtaacaactaattcgccttatactttgagtgactacatcacaccataactcatgtccattacattagacatctctacttttattttcgtgaagaaatctatagctatacgtgcatttgttccaaaacgaaacaaacaaacaaaaaagaaagataatgacataaacacacagaaggcactgcgagatgaagcaatggattaagcgattaacgtcctatacaagcatggaactatccactttaccggattagcggtttaaccccccacacgatctccttaaccccacctctgcaaatccacgtggcgtccgcgtcctcgagtcagtgctcggatccaagcccatccacaaatcaacggccgccatgtcacctctaggggacccacgcccccgcccccgcccccgcccccgccccgttaccctgccccatctgtcggtggaagtgggccccacatgtcagacgaaggggtcgcgcgcggccgggtgtactactaatcggatgcgcgggggttgctgctcggtttgggcagtttcgactttttggagaggagagggtggggaggcgtgagcgcgagggaaggggagggggtttctcgatttcttccgcgcggttgcggaatcgcgaattcaattcgattccgctccaccaccaccacctcgcgccgcccagctgttccgattcgcgctgcggagcttccctttttccacccgctgatcgattgattcgttgtttttgggggggatttttttctggtgtgtgtgttttttttcccgatcggatcggtccagatcgggtcgatttgggcggggtggaagaaggtgaaggaaaggggagatgcggatcgaggagcttccgggtgattccggcgaagaaggtggggatggtggtggtggtggtgccggcggggcgctgctgcagctgcgtcgtgggcgccggccggcgcggccgccggtgaagaagaagggtggggtggtgatgcgtgtggctttcgacgcgaagcgcgcgccggtgggcgtcggcgcgcggatgctgttctacccgacgctggtgtacaacgtcgtcaggaaccgattcgagccgcacttccactggtgggatcaggtcgacgaggtggggaaaatttcctaccccctcttttgatttcggttgtttttggaggttttcccccctcttctggttgttgatcgccgtggctttcgcgttcatcttgtgccgccgacggattttgccctgtaatgtagcttcttacggtggtttgctgaccatcatggcagtttgcactccaaacgtttagggttaggtctttcctactgcatatgcatagtggagaagagattttcttcgtttatagttcttgctgtatttggatttttgtttcaatttcgattcgtttagtgttttggacctgtatgtgggtgattggcactaccttttctgcagtattgatttctcgatctgtttagagttatagtttactctgctctaattgtgtacttttcttttgcttcgatcagcatgttctgctcggtgctgttcctttccccagcgatgttctacggctgaaggagcttggagtttgcggtgttgtgacactgaatgaatcctacgagaggctggttcccaggtgcctgtatgaggtagtcacacggccaaatcattccactaaatgactgatcaaatgtgctgaataatatgtagttctgtaagttttgctgcttctgtttgttaattccttcctgcgagtatggctcctgcatattatttgttgttactctgataacgaggaggtgcacggccttgttgtaaaccacactggcatatagcataatcaggttccagtggtctcagtggtgcaatactgcaatgtgaagagagcaattactggagatttctgtgtttgccatctagatgcccacccatcagatcaagggtttgagaaaaatactagaagcgcccttttgtttagctgatgggaccacaaatcgctgtttgttaggtactatattgttattacctgactgtggtagttaaggtagattgaagatcctaggtcagtgatatgtaaactactcatggtcaacctaaatgacaaggttatagcaaacattgtgttagttcagaaaaaagaaatctaattaggcattgaaatgttcatgcaacatgctccttttttaacattctgctttcttctacgttaaactgtacatttggtgcaatctttacatgtaatctaatcacgctggcgctgtttttttgtaatttacaactgatgtgccatgtccatgctaacttccctaaattttacatatatctgtttctgcctgctggtcatgagcgaatgttcaaataactagcagttctaggtcacacaactgaaatggtctttttgttttttaggctcatggaattgaaaacctggtgttaccaactagagattatctttatgcaccatcatttgagaacctttgccgggctgctgacttcatccacagtaagaatctactcaaattgcatatcctataatacgacggaatcactatgtatattctagtttgtttttgactgtactgttcattgcatgagtagatatcagaacttgtgatttgataccttatgtttggtttggtttgtttgtagtaagagatgttttttatgtttgttggtcccaacaccctgtaataaataatttgtgcattgtacttaactctaccaatataatggccgtcgccatttggttttgcagtatgctactgcagtttcctcttgaaacttgactgaatatgctgctacgttgtggatacaaaaaatttaagaccttttatttactgccttttttgctctgcttgctcttctacatttttacttttcgtgcatgttgtgatattcacttcctctaatggggaggtagacaaaaatttaagttcattaatttcgtagagatcctattgtgctgttgcaattgtgatttttaactaggtttgtctcgtgtatttatttatgttgttttaatcttggaaggaaatgctttgtgtgggaagttgacatatgttcactgcaaagctggacgtggacggagcacaacagttgttctttgctacttggtatgttaggttatttggccatgcagatacgacttaattatataatcgaaatttgatactgaccattaactctgtacttaggtgcaatacaaacaaatgactccggctgaagcttatgaacatgttcgcttgcgcaggccaagggtgctattagcttctgcacagcggcaggtaagctgccacaaaaaaaattctgtgcttgtgggcagaatgatttcatggctgtgtttctcttaaattcagaatgctcttattgtgaaaaaaaatattatgcattcagaattaaataggactgctttcaatatcaactggacccatttatatgacttccatcttgaaaaaaaattgttagacactaatatatgcaacttattattggatatttgaaatgatttttagtggtcaaggagctccttacatttttgctagttccagaaaagagataaggttttgtccactattcatgatagtaatagacactgtggctatcaagctgcccctaccttttgttttgtgaaccggttcaactcaatcttttagatttagatgtttggagatactttacagtatgcaaggaacacctttatgtttttggctcctttgttcatattcaacagtcagacttcattaacgctgatgtgtcgcatgccatattttgtaggctgttgagcaattctaccagcttaagggtgaagaaatctgggaaatccatttgcctggacagcccaataatgaaaccaccgctgttccttgccactcgcaacctcattgcatttgacgagaagacattcgtcatggtttccaaatcggacctcgaagggtatgatgcggataccttggccgttaacgtgggcagtggcttgtgggagataagcctagtataccgcgtgcagtttgcgagccaggcggcctttgcagggttctcatacctgtgggtacgatgccgtgccccccgtaagaacaaggaggcactccctgtccctgagagtaacaatagcgtggggagcgagagctgctcccttgaggcagagcaactcgccaaacctcacccatgtttgcttcaaggtgtcatggttaatccatgatcgttcgacttgcattcgccgcgacctttcttttaactttttgtctggcatgtcatccgtatatattaaagccaagaacatgcaaatgcaatgtgaagtccttaactccagtctcctcagcaagcaaagagtgcagttgcttgggtatgtacatatctgtaataagttgacttctacatgtacagaggtaaatgacaaggtatctcaaatcgctgaccatgtgtcccaactagcccacttgattattcggtggaaactatcatatatttttcctcttaacttccacgcaactgctgtgcattgctcgaagagaatattgaatgtgattagtagctaaaagtttctccgatgaagacatggaagtgttggctctcgtctaataggaagaaactccatgaattcatgcccactgtataatgaatggattaacagcatcaaggacatctttgtagtttctaccgtatatagtcatatagggctggtttggtttgagatataaaataggcttaacaatatttgatttgaagccaaattttagcatgcctaagaaaatgggttatttcaatagtgaattttgtctattttggcttcaattcaaacacaactttgccttatcaaaattagtcatatcaaaatttgccaaaatttggcattgacaaaattttggtaagctctatttaggctacaaaccaagccaacccatgtatcttcgttgttacacacacggggaacgcacggaacgtacagttcttcatgggccgtcgcaaaaaaggtcggagttttagtctccgaaacccccttgaatgggatgattggatccaaacgtgagacaacgttacaaacggagctaactgtgattctgtgaacatctatggatagtatcagaaaccggcaatacatgatctttttttttttttgaactagggcatgaagccaccatttctgttactagaaatgagcaaataccagaggagtctggtacagtgcagtttagcggcaatacatcgatcgtatcaacacctcaagctgctgcaagaccaccggcgagcgactccggctggcatcgtcggacatggacgcgatcccggcggccgtcgaccagtgacagacccaggatttttatcatgggtgtgcccatctagttcaaaagggtaaagacaatccaaaaacctcaagcacataacacaattcaagcctaatttatcagaagtgcaatacaaacagtgaaataattcaaataaagtcttatataacaaaacggtgaaatctaagtcgtggcacttttttcattgcatagcaacacccaagcttaattttccatgtttttttttgtttgaacgagctaatagaattgatttgcccatactatttcatagtttcctgtcttggagtttccacattccatcctatttgtctggaggatatcctctgctgtccagtgtccaccccgatggacgacaacttcaggacggtgacgatggaacaatgtatgaggtatccgctctaccgatctgtaattaatgagagggaaacgacggcgtcggcgtcgttgcagaaggagccaccgcgccgcgcctcggaggcgctcgagctcgcgtttgcggttgctgctcatctcggcgacggcgacgagtgaacggaacggactcctcaatctgcttgcatatctgacgcggacatgatgggccaaatgcggcccacatgtcacccacgtcatcctgggccgtgtcggcccacttagatccgtctcgccaccgcacgtccgtctgaatctctctgcgtttcaccatgagaactgcggttaaaacttcttcggaacaaagactgacaaattcttcagagcataaatcagaaaattagactgaagaaaattctctgaagttgggggggtggggtgggtgggctatgacggtgaggttgtcggcgtgagagaggaggacggaaatagtgacgggattggcatggttccgattttaaaaattctcagtggcaccgagccgataacacgaattgtaatgttatatttttctaatatgtcatatttgtaatggcatagattaaattaaccctttcttacttgtgaataaagtgccgactgaactgtgttctattgttgatagctgaattctttttttaaaaaaataatgacgtgcttttatccattttgctttgcagtgtgaacgttcaggaaccagcagtagctatgcaaagttgcaaacccaactgaaaaaagaaggggaactatcaactactagtaaatatactaaccactaactacttttttattgactttgactgacaacgttatttttcagcatgatgcctgtagacaaatgtgctgtccaagttgccattttatttgtttttatatcagaggaataatgtattttgtcattatttgtgcttgctttcaagttaagctggcagtttggcattttcactccacatgttttactggatgctttttctgaattttctctgtccaagaatgaatttatgccttctttattcattttgagaagaggcatacaattgcaccaaatattcttcagccgatttagttatctggatttgcattgtgcatgaaagtaacttgatcgacttcttcctgtcctgttcttcagaatttttaatgttgtttcatctagagtttcagagcttcagacaagccattccatgtgttggaaaataacagaatatcttgacttataattctaactggattcatcatttttcctgtcgatttatgcgaactcgaatcttcacaaaacttgaagatattcacccaagaagatcctgacaaatttgtctagaagttttgccaagaaactaccagtgggttctgttctacctgtatttactgctcatgtaagtttgtactgaggttgctgaaatgtgattgtatttagctccagtctccatatgctttatttgcatgtattaaatacagcaacatcactggttatggatttgatgcactaaacatgcttcttctaattgaaatttaacttaatcgacagtttcctgttctgttcttcagaagtacagtttcttccagatgttcagacaagccattccatgtgttggaaaagaaaaacataatatcttgacctgttaattccttctaactggatcaatcatttgtcctgtttattcatgcgaactcgatcctcaacaaacgtgcagaaataaccactaaagatcctaacagatttgtctgaccaagtagctatcgcttctgagaaagttcagtacatcacaaacgcaagtttggcctgtgctactgcttcagatttctcaatgaaggagagatcaggctgcaatgcaggaagagaattcagatgcacacgtgcaatggttgatcgctgcattgatcaaccaaccggtcatgcctcctgaaatggtacatggtgatgagaattcagcagcacacatcatcgtcagttgatttccgggtcaaaatgggcaccatggatgagttttcttcgatctgaacatcctttttttctcctcgtttgacatttctgtagtgtgtgttggttttcagaaagcacaaataagtcagtgacataaagccatcatctgtgtgaagttcagtacagagacgagaccaaccaaaccaacaaattttcgtcttctgaactgcttctgcatgcatcgtgctgtcaaccacacatgcatacggattactgaactgcatcttgttcaggtcaatggcctctatgcatatgatgtcctccctccgtattaaattagatttgttgtaaataaaaaaaattcttatctttgaccattaattcctaaaaaatcacatagtttaacagcgtgcgaataattatatattatgaaagtatttctcatgattattctaaaaatatagatgttaaactatataattattcccacgctgttaaactatacaagtttttaaaaattaatggtaaattatcatgttgaattatacatgtttttaaaaattaatggtaaaaagtaaaagtgtttgatttcgtataaaactatgtgattataatatgaaacagagagagtaataatcacatagtttaacatagtgcgaatattatgaaacggagagagtaatgcatctttgtttgttgagtaaatttcacaaaacccaggttttgaggcacccgtaacgcaaaacccctaggtattaagatttgtttcgaataaccctaggttttggggcaaaatgtttcaagaaaccccatgtttaagctaatatcattgtttttgactaattatatattatgaaagtattttccatgatatacgtgtttggacttattttaacgagcatcggttattggtagtatggctgtttatgtatataagtaactggttaatgtgtcattattaaggggttgtgtacttgtgttgcactttttaaatggtgtaatacaaaagtgaggaagaagataaagtacacgagtggtatatgtattttgagtttactaatgtgaacatatacaataataaaactatgagtatttgatgtaaacatatggctttttgaaacattttgcctcaaaatctagtgttactcgaaacaagtcataatacccgaggttttatgttgtatgtgtctcaaaacctggggttttgtgatttactcttgtttgtttgtttgtgttaggcctgttttagtttctaaatttttttccccaaaaacatcacatcgaattcttggacatatgtatggagcattaaatatatattaaaaaaactaattgcgcagttggggagaagtcgtgagacgaatcttttgagcctaattagtccatgattagtcataagtgctacagtaacctacatatgctaatgacggattaattaggctcaaaagattcttctcgcggtttccaggcgagttatgaaattagttttttcattcgtgtccaaaaaccccttccaacatccggtcaaacatccaatgtgacacccaaaaattttcttttcacgaactaaacaggtccttagcgtcatctatgaggtcagaagttcaacccttggacctgaccatggccggagctcgatgtagcttagtgtatttccattggcttgatcacatattcagacagaaggatctacatgcgaattgctgatgaatcagttgagcaacgcgagttggtcttctgaattgcttccattctacgccaaggaaggatcagaattcagaggcagaagcgaacaatgcttcaccgtatcagatcagatgctacgtgcacgcgcaggagctgacctgctggctcaggaacagaaaagaaattcacaactggaatctggatgtcctacctaacccttctgaatatgtattggactgaacagtcgcagcaacagtaaaagtgcagttcctgagtactaatcctgctaataaactcgtattaacctcgctttctctgctctgactaactacactctgctccaggaaagcatgtgaaaaagaaaagagagagaaaaaagaattgaaaagacagtagcattggccccagtaatgaacactacttagtaagcacaacatttcagcctttctaatcagggactttgtgcaggcaatactagcacaatcattgatcaccaagcaactttgcatttgcacaccacaagtccacaactgcacaaaacacaattagtgtacaattaaagtattgtaaactgacaggcatcatcattgattaccagctttgaaaacttcatcaagcaaagcaaggttcagcaaaagaggggtatagtatactgtactaggtgttagcaaaagcagggagcaaaggtgtcccatgaattagcaaattttcttctcatctctgcagcttttgctcccggatttaagctgaggggctccgcgtgggacctgtttgcttcgtgatccctccacatctaagccctgcacacaagagtagtacacctaatgagataattaatcactttggttaaacaatgatgcatcacctcgcacgcattatgcctctgttggatgatgatgatgccaaatgatttttagtagtttagtggcatcctgcacatggcatgctggctggggaggctaatgatcctgattatgttaggcgcaaatctaaccaagattgcattgcatcaccagaccaaatcatgcgtgcacacctgcacctactactaattaagctatggattacttaactaatagtagcgacaactcacacataatctacgagtactactaattaagccattgcttgcttttctatgttaatcccaagtattagggcatgctattttcagcttatcttttgtctatacaatttctcataaaaaagatcttctactgcattatttagatcacttgttttaagctatttataaatcactgaagtttatttctcaaaatattgatttatcatcaaagtaaacaaaatccgtctcaataatccgtgcaaaaacatgtttagaatatatagggccttattccagtgatactggattggtatgatctgtctggcgcaagttcagtaaggtccaggaaacttcgtcttgttccaatgatctcatcttcagtagctttcatccagatttgatgagatatttcccctgcaatcaccgtactactagtagtagcttcgccaagatggccagagaacatatgagccaaaagttgctgcagattgtgtgttggaagaggtcaaattctgctcatcttttcttgcccggttcagacggcagctaccactaaaccttctgactgattaattgactgcctgtttaacagcgacacacatgttcagagactgattaattgatttgcagagactgttgttattgttgcttcagattcagcttcagtttcttgatctggtccccttttgtttcttgcaagttttgcatctctgaagttagctatagcttagctagatgttcctgtcaggaagcttagaatgcttcaaagataagatcacagggaatggaaagaaaaggagaagatttcctctttggaattcatcctcactgatgcctgcactcggagatgttaataattgcaccgttgacagttcgacccctgttaattaattaattaattactctggtcttatacatatgaggagattaacaaaacaaagcaaggaaaatcagccatcgttatcctgagatctcaagtgccacaagagggatagtaagcatcaatacagtagtaatcatatcattcttttggcagtaattagtagtccaagaacactacagatatgaaggaattaatattgaaaacttttatgatccatttcatgcatcactttatacaaagacaccatattctttgctgagtaaacaacaaacagggtgaagtgagagataggaaaaaaaaagattatgaaactaattaaaaagttcaaaaccagagctaaattatacacgtagtataaacaagaaaactacaggggtccaaccctaattaagtaattaattaataccctgctaattaagaaaaagccactactcatctctaattaactaattaatcagtagtggggtctctacgccgacgacctctgcgccgccgccggcggccacgggcgggtgggcaccggccgcgcgggggcggcgccggagttgttgcgggtggtggtggctgcggaggcgacgcgctcgcaggaggggcacatggtgagggtggtgggcggcgggacgcgggcgccgtaaaggtggtgcggcgcggcggcggcggtggcgagcttgagggcgcggagctcctggagctcgcggtggaggcggcggttctcgtcggtgagcgtctcgcagcagcgcttgagcagctcgcagtccacctccgtctgcttcagcttcgtcctcgccctcctgttctggaaccacacctccacctgccgcggcttcagattcagctgcctcgccagcgccgccttctgcttctgatcaatccagcaagaacaagtcaatcggattgttcttgatcgatttcatggtggattggtaattagtttgattgattgattgttttgcttacgggattgagggtgttgtgctctttgaaggtgtcctcgaggacggcggcttggtccttggagaggcggagcttcttgcgggatccgccgccggagtcctcgtcgtcgctggcggcggcggcggcggcggtggcggcagatggtgcgccgcgcttgccgctgaggctggagagcgtgctgttgggggaggacgcgccgggctcctcgtcttcctcgctgcagctgggccccctcgccgtcgtcgtggtcgtctctgccgccggcgcacggttcacgtcgatcccccgcaggaacggcatctcgatgacgtcgtggcacgccatcatcgccgacctcccccgatgatctgcacgcaaactaaccttcgtaagatcgatccatgcatccatgcatgcacgcacgacttcgacgtaagtccgtccatctatactcaccggaggaagacgaggagaagagaccgccgccgttccagccgcacagctgctgctgcggcggcggggcggcaccacggcgcggcggcggctgctcgtcgtcggctgcaccaccggcgacgccgaggctgagcccaagcccaagcccgagcctgagcccgccatactgctcgtctctcctcccatgaaccatcatctccattgattcctctcaactctctccacttctcaacactagcgtggtgagttcgttcttgggcttgatggaaatggaggtgagggactgagggtggtggttggcgagaaggaggaggaagcttttaaagcgtgggggagacaggggagcttgattagagggggtaattaaggaggagattagatcaaaagcgatattttgtggggtgcaggaaaagtcaaagaaaatactagtagtagtagtattgtgcatgcatgggctgcgagtattcttttgcgtggaatgggcgcacgcgtcagcgtcgcagcgcaaatgatgagcagcttttcctggttcggagggagcgggggcactcattgacttgtcccccggggttggggccgggtggggcccaccggacatgacttgttgctcctttgaccctggttcctggccatgccttcagttgagcctgcccatagctcgcagcctgaggttttacggctttacgctaaaaaataaaaaaaatatatagagagaaacgccccttcaaatattttttaaaaagaaattataatcgtgttgaggattcttaaggttgaaaccacagtctttttatcactggactatcaagtatatctcctgaggcttatccactttgtctactaatatagtaaaacatttttcctagtgtgtgttatgtttattcacaaatgttaagatttttttatactcccctaaccctatttttctatgtactattatatcttaaatagagagtagtattatttgtctatttgattatctttctttttatcttatccaatcaccctcaattcctccgtaaatgagagataccagcagagtctttcccaaacattaatctctaatctccttgtccaaaagaaaatctaattatagtttaaaattttagctcacaaaaaatatttttcttccttaatactatttactatttcatctttttatttatttttttaaccatcgaactaataatactctctcattcccctagttttctcctctccttgttctctccaagtattaatgaatagtatattatttgtttaacctcatgtataatctcacttttgaccactgaaaactatggaccagtttaggggagtttctaactgttgcagcttctcttagaaatcagaagctccccaaacagtctaagttttttctagattctaaagctgtagttgtaaactagaagtcaaaaactggaaaacatatctttttcagattctcagaagttggcttctcagaatcagggtgtgtttggttgcttgcattgttttagcttggcccatctcttccatcaaggctgagtttggcctggctaggtagatacatatgcaaccgtttggttggttgtattggtttagccaggttagcgtgagattctgcttggctgcttgcaccaaagatacggcttgaaagagactttgtttggttggttgtatggatagtaggtataagtattttctttctttgaaggagagattacctcacttagaattaatattgaaaattcttaccatctacgaaataaaaagcgtatttatttatggtatatatatcagatttaatagtacatgcaaaatatacaaagcattgatttcggagctcctgacaacaataattgaaaacagtatcggatgagcatatacagttgcacagcagtacataaaccatatttatcagtggttaatgacattcggtggaaaaaagaaagaaaaaaaaaggagaacagagctcgcagaggaacttgccgccaccggtacctagccgctcgtgccacccagctaggcatgttcgccgccgtcggtgcagcgggtccagcggccgggagggtgttgtggttactcggatctggcaggcccgagcttctaacctctgaatctggcgaaaaaaaaaggtgagtaggagatggatttgaggtagctgtccgtggcggcgagggtgtccgcgcagcgacgagctcaagccggcgaggaaagtggtgccgctggcgacgacgacgagcttaagccaagctcatacttcgacatctccgtgcaggtagatctggcagtggcgagctcatgccctccggatccgccggcggagagctcttggtgagcccttgctgaagaagagagggaggagcaggacttgcagctagcctgatctggccggcgaagatggagatggtcgccgctagtggccatgaccggcgatagcgaagagaagagaagatagaagaaatgaggaagaaggtagggtggtgtcggggaccccatcgtttctccggctctccctgcacgcgcgggtgcagcgcttgcatgcgcgggtgcggcgccgctgcatgcgtggagccaggatgagcagcgaagctcgattcggtcgttcctgctcagcctggctgcgagagactttttgcatctattcggcctggctgtgggacacgtgcagtcaaccaaacagtctacaagttgcatccgagatgcgagccagggacgagccaggcaaccaaccacacccttagctccccaagcaggacctatatctctttaaggacggacgaagcaactagacagcttaaaatggtactccctccatcccaaaataagtgtagttttgcattattcatgttcaacgtttgatcgttcgtcttatttgaaaattttttatgattagtatttttattgctattagatgataaattatgaatagtactttatgtgtgactaaatatttttaaatttttcacaaatttttcaaataagacggatgatcaaacgttgggcacggatatctacgactgcacttattttgggacggaggtagtataagcagtagtacattgctccatcttaagctgttgacttttggggtgcctattttcttttatgaagatatagcccaagatgtgacacagatgccacaaagaaaaagagaaaaagagaaagataacagatgtactcctatcagtggaatagtctccgtagtccgtaccgaaagtatggacaattggttgcaacctcaaaaaaaaaaaaggcttacaaatcttccgcatattcctaagaaaagatgagagtgaaataagtaagccacattgaagcaatccatcactaataacacaacatgtgcacatcctcgaatgcgataacaaacctggtaattaatagtcgagagtgtcggcaacaaccgtgtattgcagcagccagccatatatacgacaatagagctaattgtatcgatcaagtccattatcgattaaaccgattcctattgcttactactatgtccaaaaactggctacgaacctggatacgtatatgtccaggttcatagctaggattaaatttttttgacggaggggtacgtacaaaaacatgtgttccaacgaaatcatgagatcagttatatggatgctcgtatttacagctaattatccttttaacaatgtcggtataaatctgttgtgacttcataactcttataacatgcagattctatcttgagagatactcatagagatagatgtacacgcatgcatttgtttacaggagtgagtataagtgtgtttatacaagcgtttgcgtctaaacttaggctgagtttggaaggtggagttccccgtggtttccggtgttacccattaatacgtgactaattaagtattagcttaaagacttgataaatggattaatataattttttaaagtaacttttgtatataaaaaacttttgcaaaagtcatactccactgtttagccgtttgaaaaggtacgaacgggaaaaaaaaggggaaataacacgaccttagtatcaatagtatgtggtatgcctagattctacgagcaaggcgtggcataaatccgccacggcagttacggtgggcacccagattgaacatggtttccattaaaaacataaacctggatcagaaaccattctcagcagccactttttatatttcttatagtgaaatttacgcatttcaacaaaagacatgaactagtcgctgatgaacgagagcaagatcgacgacgtggcacaatccggcgcggcggcgatgcactacagttgggtcgtacgtggcccatggaccatggtgcgtgctgccggtcgccgacgcgaggcgtgcggccacgctgtccccttccacccaaccatcatctcctcccctctccctgccgccgccgccatcatcaccccaatcatgcccatcactgcattgcccccacgccaatccgattacatcctccactcccaaaaagaatcaatggtgtatttagttcgcgctaaaattagaagtttagttaaaattggaacgatgtgacggaaaagttgaaaatttatgtgtcaaaaagttttgatgtgatagaaaagttagaagtttaaagaaaaactttggatctaaactcggcctaagaggggatgatgtgacccctcctagatcaatgtacatggacacctcatatatccacatacataaacttaggagaggacacatttccttttaagttgatttttttttggaactcgacaagccaagctcgattttaagccgagccgagccgggagcagcagccggtagtagtgggctagtgggcccaggggtcacgtgggccgaggcgggaaagcaggaggggaaaccggggtgggagggcccacctactcacgtgggcgggaggggccacgtcggacgcggcaggcttccacgtgggcctcccctgcctcgccttcccccgacaacgcacacctgctttgcttccaatcattggagccactcatcacccatttctttcttttcctctccttgtttctttttctttattcacttttttttttcatctctctctctctggtggcatcgtcgtcgacgctcgcggtttattcatagctttttttcagtttgacattctctcccgatccataaagtaaattccagtacatatttggtttgtctccacacaaaaagaaagaaaaaaaaagaaagaaagttggaaaaaagaaaaaatatacttgtctgaattttctaaaacatacataacttgatattccctccatataaaaatataagaatatagtactagatgaaacatgtcatactactgtgaatctggatggagagtccgtccataatggtagtattaagatatatatcatttagtaccaggttgatatattgcgggaatagtatgtaaatttgtttaatacaaatcttttatttggatattttgagtcaacagtcgattaatcaaagagaagaaaaaaagtatactctctccgtacttgtaaaggaagtcgttttggacagcgacacggtctccaaaatacaactttattctataaaaaatatttattaaaaagtgatatatgtatacttttatgaaagtattttttaagacaaatctattcatataatttttatatttttaaactcaataacttcaaaattatttataatttatattttcaaggtttgacttaaatattgtcataaacgactttttttactagcacggagagagcatactgaccaacttgtaagcagcagcagctgaggaccaatcgaccatgagtacaaacgtgtagcatgaatgcattcttcggtttttctcctggtgatgtgatatatatctgtactcttatcaatcacgtacccaaactaatcaactgtggattaattaattactattttccatatatttcaagctttgactagtagttaattagtctgtcccgtcgatcggacgtgtaccggtatatacatacgaccgagatgttctatctatctatcacactcacgcgtagtactccagtaacatgtatacgtgtgtaaccatggatgggtcactggattagcaagtcgttgtgcatctagacgtgtactttaccatatacacttgtacctgcatgcattctccctggtggccaagctcgccacgtcggcgcgtacgtggcccgctgcacgaacggatgcacgtagtgtacgtgcaatttcatgtcatcaatattagcaattccaccatcttctcccatacttagcttcctccacaagatttagagtctctatgcatataagatttaaatgaaaggacaaatcaaatatttgagaccagaactcgatgagtcatcttgatatatatactctttaatttttgtcacgtataaaataagttaatttctttttaatcttgacgataaaagtaataggtctagtttttttttttaagaaagaagtatactagtatgatccatggaggcatcgaccaatcaatcaatcaatcaatgattcattatgttttggaagactaatactagaatagatagatagcttggcccatgagatcgatcgatcgatcgagttgacaagaatcaatcgattggaccgtgtacgtgatactagtaatgacaaattggagtaacttggacgcgagggcacttgtgctggatggttccatcgatccatccattgaccatccgtcgaccaattaagctgcctgcctgtatgcgttgcatgcatgccgtgttgccgtcatgctcatgcatgcatgtggacacactgcacgcgcaccacatatacagcatgtgctactctctttatctataaatataaacgttttaagttttaaaattttatgaatcataagcatttctatgatgttgtttgttaattttaatagtcacaagtgacagagatccataaagaaatagcagctgggctaggtgtaaacaaactagacaaaattataacccttttctatcttatatatggcaaagaaaaatagaggcttatatggttctcgcgtcaataatgaaagctcgagcctccatcgggccctaaggccctaatccccatggaccaaggtagagccgcccctgacagtcacctctcgttttaatttcctccaaccataatttaatcacaaaccatcaaggacaacaaattatttttttcttaaacataacctcttataaataacttagaaattattatatttgtggtcgaaagatgaccagagattacgagtgacgacctgatgcatgcatgatcattcatctatcgccaagcatgcatgcatggttgtacacgtgttaatcgatcaatcatcagttgatctcgtatgtgtgaactggacagccagctacgaatactactaggtctttctgctacttagtagtaggtcagagtcatatacgctgacgccagatcgatcgatcgctagctggcctgatgcatccatccatgtatcgtccgtcgatggctacaggactgtcttcctaggtccttgttgaatgttgattatagaaatggtgcatgcgagtgacctagctacttcctctgttccacataaaacaaatatacgattagacgtgacacattctattacataaatatagacaaaaaaaatcaaaaatatatctagatttgtagtagtagaatatatcatatacttcctaaatgtttgacaccgttgatttttttaaacatatttgaccattcattttattcaaaaactttgtgaaatatgtaaaactatatgtatacataaaaatatatttaacaataaatcaaatgaagggaaaagaattaataattacttaatttttttaataagacgaacggtcaaacatttttaaaaaggtcaacggcgtcaaatattttaggatggagggggtacattactatattatttttttatgggttagtaggagtagcttgcttccgtgagcgtcagattaaacgatggatcgatcattagcgatagatccatgccaattattccttccgacttttaatatgcatgcatattagcgttgctacgaacgacttgcttcagatttatagtgctagccgtttgaaccttcaatttggagaagcatattactcctaattagcagcatgtaaaacgggatagcttcgatgcgtggtgcatgtttaactaccgacaacctccagcgccggggttggcaaatggcctcgatctgtcacctttgtgcaaacgacggcgagtcctgctcccacatcttccatgattgtcccttcacaaagcaggtttggacaaggattcgagatcggcttagcctttcctgttcggtgcccagtggcggacgcagttttaaaatatagatgggacgaagaatgaagatgtttactcgataagcaatcgaacataacacatatcatatttatatatcaatcgtataattatcttgatcattgtttatggcgtgcatgcattgtgaagagacagacgtccaaaccttattatacataattttgatggcctataactattataagggggtggggagggtcttgggggtgtggggcgatatgagtcatagctgggatggtcgacccaccatgcctaatgggtagatccgcccctgtcggtgccggtagaagatctttcctcttggtggtgttcggtccgaaaatcagtgcgcaagcaagacagaaagacatttgacgccggggtgatccttgtgacatgcctcatatggaaggaacgtaataatgctagagtgtttgatggaagagcaacctcagcgggccatctttgtgccacaattgtggaagaatgggaagcttggaaagcggccggtctgctgtgcgaaattgaagcaagaagccccatatccatagggatcagctagttagcagaacaagggtgtgtgtgagcttctgctctgttagtaggagctgtgtcacctctgattttttcggggtgtgtgtttgctatcttttgttttttttgatctgtacagttctaaattttctccttcttaattcaatgtttgatcagcaaagccgacccgacgaaaaaagggatagcttattaacatatgattagttaagtattaattattataatttaaaatatatttatttgatttttttaaaacttttatacatgctagatcccgtactagcggagattatttaaaaaaacaaaaatctccggaaacgaacgagggagagacttgcaattcaagttccaataataggtgcgtgttgattataattatttagctcttgtcaacagcattaattacttctttaattgctttagagcacccgcaatggtaaagtaaggtactatctataaaacatgtacacctcaacaatagactagattaatagtaaaccacttcaatggtatgtctacatgggtatctatagctctctaatccattgcctcgtttttctctatagactatctccatgttagtagatagctttgctctctcttcatttaatctcttccaagtaggaaaatatgctgacatagatctcttgtagagagcttatagataaccattgtgggtgccctaagtatactactctactttgttgtttagtcgtgcgtggttaaatcccagcttccatggcgttcgagcatgccacgtcgtgcgcacgtggcgcgaccccggcttccatgcatgcaggtaggtgtgtcgatcatgccggaggtagccgcgaattcatggttgatccaataaataataataatgtaatcatgcacctaatggaaatggataaccaactgattgtttgttaagttaactacatgcacgttgacgtgacgacgtagcagctatgagtaacatgatcaaatgcgtatatgctacgtactcagtcaatggccaaccattagtattagttaaagtgtgttactatactatgtcaggagataccaagaaagaacaattaattaagaggccaagaacatcctacctccgtccatattacttatctttttaagttttttttcaatgtttaatcatttatcatattcaaaaaaaaattgaattattatttattttgtttgtcaattactttattattaaaagtactttacatatgacttatctttttttatatttgtattaattttttaaataaaacgaatgatcaaacattgcaaataaaaagttaaaaacatcacctattatagaacggagggagggagtagcaatgtttgattttcatactacgccatatttatgatgatcactagatttggaatcaatcaaatcttgatacaagaggggaacaatatgtgatcaatcatgcgtgcgtgcatgcattggtactactcatggactaattttgtcattttgtcatacagtactaaatttatctgttagtgcaacagaatgtgagcaatcatgcgtgcgtgcaatgcattggccctaataaatgtcactcatggactcgtggcggtggtgacaccaaaccggcatgctgtcgggggactctaccttgcctgatgatgacaccatgatgattataattagtactcctcctcctactcttaaccttcacactatcacaagtgtgccacacttatacttatctagtagtgctaagctagctagctgcatatacacgtgaaagtgtccacgtcatccgtgcttggggcccacacgtcactagcacgtaaccccaaagccccgacaatccggcctcctagctcgtcatgccactgctgctaactcatctctccttaatcatttttcttttcttactggagtagtacttggagtagtttgaacagctgctggcatcatccacttacacgcagctcaagctatgtttttttttcctaagtggtttagttaaacctgatgtgtccaaattattggtcagatatgatcatctcatcacctggagctgatcgagttgaacaaggctacatggatgtacagctgaagaccacatgtccaagtttgctaatactaacagaacatgctaagtacagcaaataccttactctataaatatggttcgtaacaataataatagtactagcaaaacactatgggatacgacgaccacctgctaaccctttactctcagaggtagtttaaatattatcacctccatcccaaaatatacattaacagcttttaattataaatctgaataagtgtttatctaaattcataattaaaacttgctatattttgggacggaagaaatactaagtttatagccatcatagtcacaacggtaacatggagtctatgccggaaatttgtctcaactcttaaatttatagagtagtcatcacaatactaagataagaaagtaagaggaatttcctatcctttcgatgtatatgtataaactatcacaaagcaatactgtagaagtgtactactgtactttctgctggtccaacctacaaaatgaccttcttgatactcctactctaaacccttcaaaatttatctcagagatggtctatgaaaatgctgcaaaactgctgctttacaagaacattaccgcagtatctacagtattagagattaaggaggccatcaccaaggcaaaaacatgtacatcatcagccttcgagtgccgtatccatgtgaagttagagaagttacctagcacaatcactcaatcagtcccttgcttctgccttccaacttgtaattgcacataacagagcatggttgggaaccaaatccttgttaggaagccgcgattttgtaatcggtgacttgtcattctcgcacaaccacatctcaatagcgacccggtcgtacgagtacccgtcagatgcaatgcatgggtcctgcattatcctctacagggaggaaaaaaagcaaaatgaagtttcacctcagacccttcgaaaaaaatggatacaacaaggtaagagtaaaaagttgaattacagaccaccttgaagtgtaatatagttcaaattctgaaacagaaacattcttacaagacaatgagctacaggtagttgtgatgtaattcacttaaagctgatgtattgcaataagccaaaaaataccttgagtattgggcagataaaatggcttggtggtccagatatcactggccgtacagggtcagagacagcactggcaatttttttcagccgttccagctccacaagaaccttacacttcagatctggtctatgcttgcttcgcatttccaaacagcttaggccaagctgcgctagctcatgtgcttcttgtgcaggccacttcccagcactcttgtccaagatgtcaacaaggtgaccattttctactgcttgctccacaaggtccgctagccccacaggtggctttccagtgagcagctgcaataaaaccatgcccaaggcgtatgtgtcagattttgttgacacttggcctgtcctttggtactctgggtccatgtaaaacagtgtgccaactagatctgtgtccttgaaaattgtgcgcgttgtcgacaaggcatcccccagcggaagcaatgttgaaaggcccacatcgccaatcttgctggtgaaattgctatcaaggagtatgtttgcaggcttgaggtcacgatggatgattggcttcggcttcgagctgtggaggtagacaagggccagggctatttcccaagcaatgcgaagacgttggtaccatgggagtggggccgtgcctcctttgagttgcaagcgatcctcaaggctgccattctccatgtactcgtacaccaagcatggtctgtccagacaggcacctatgagcagcagcagatgtgggtgacggatcttacccaaaacctcaagctgcagaacaggggcatcttataagaatttcctagagataacaatgatggcatcttgcattatatatgcaagaagagtagcactgcatatttgaacatagcaaagttatcgcaatttacttcttagcctatgaatatatctgaagatccggagatcatgatgatattaggacttgactgctcaacctttaatggttcaaggaatacctcttgtttgaaatgtttgatcctgtggctgtcgtcagaagtgaggacttttatggcaacagatgtctgacgtagattgcccttgtacactgttccgttagatcctgatccaattttaagtgcctctgaaaacgatgatgtagcagattcaatgtcttcccatgtaaatgttgagtatgacatcccatctaattcaagaagtttttccagcctttgcatcttatcagcctccttcgaagtcctcagctgcaaaatctgcttctgcaaagcttcttttcttgcaagatccctcacatgcctgcactgagcctccaaagcgttcagttgttccttctcttgatgtgcttgctcattgactctgttgatcctggagtagacctcgctgagccgggcttcctcttcagcacgttttgcagctaagtcagtcacctaacatatgattgtcaagatgacaattaagttgctgactattggagataaagtaaccaactaattatgttgaaacacagtactcccaaacttacatgctgagaagcattgatggactcatcctgaacaagtttgcacactcctttaatatgcctaagttcaagcctcagcttttcaagctcgctatttacatcatcctgcattgagaaaattaagttactgtatattcagaaaaaaaaggaactattcttatctaagaagtttaaacagtgaaggctcatcctcaattcatcaaagatgtatcatttgcaaaattatactactgtgaaaaaatttattacagttttactgtgaaaaaatcaaatggctcaccatgtcctctgaaagcatcaattcctgcaggggactgcttgtcattggagctttatctgagataagcacgttacttggtcgaggggtttgaccgctagcacatggagaattactgttattatcaccaacagatgctgaagtgctttcagtaagatactcatgtaaggagcgcggtctatcatggtctgcggatgataaactttccagattctcccatgtcaagtttgatctaaagcttctcgaaggtgtggcatctgcattggacaaaagggataaatttcttgcactgtttttttttcttttcttttttgctgaatttcaaaaccaaacgacctcgattccaaattcttattgaatgcaaagaaccaagcaaacatttgaaaaggaagctaggtgctacaaacttctcaaagactagcaaagatccattctatatcagcttcaaagagtaccaaggacgaaaaggttcaaagttggaagcagtcattatgttatcgtctatacagtacacagtgaaaatttccagtgccagttttacggacagataacttcacctgataatgagggcttatcatctgaatggatttcagttttggagctatcactggacaggaatagctcagaactcttgtgaccttcaaatccaggagaataaactgcggataaaccaccttttgagacaacataaactgcacaaaagcttggaacacttctgcaaatttgagaagatgtcctagtacccttggatttcctaagacatttccaccaaattaatcagcattttgatgcatgcagttcaccattatttattacagaacatgttaagtacctaataaagttgccctgagaagagtcaccgacaacaagcttgtggatttcgtacattgaaacaacattggaaatggtttctgccacatcttcacctttgacaaccagtacttcagctttagcctgaacaagatcagaaaatgtatacacatgttcagcaggatgtttaaaactatgagtatcattgctgagttctaacctgttctcataatttctgactctatacgaaagtacaattctgaacaaaattaacattatgaaatgtcctgaataaatactgttgtgaattgtgcttattcagttgtatttcattatatttggctccagtgtgcccttaggaatgttcattttggaacggaaaagaaaaaaaggatggcctgaagtggcaacgtcataccttctcatcacacatgttcttgtagaaaaggagcatcgttcgggccttacattcgacttctttcacatatgcgctggcaatgtcagcccgtactttatcaatcgggatatagttgcccactacaaaagaagcaagaaaaatagatatatttaagtgacaacatgatttacaaacgaaagtatacatctacacagtaggaaacacatcaaatatgcactcactcggtgttggaaccgtggtgatcctctgcagtacatggataagcacgaacctaaccatcccattggtgcagaagtttttcacagcccactgcacggcgtacttactggatttggaactactcacggccaacccaacagtcacagttgggtcgttgttctcaactttatcttggatggccatggctttgcagcttgcagttttgcattgcctatatccctaatacaaaataccctgcataagggaaatatggtgtgatcaacagcacaacaatggtatattaatcctgccatgttacaaatcagcgctaaaaatatcctgcattgtatcagctccagtaatcacgaggaaatacgctactcctaatcatttcctatcatctaaggtaacccttggtcatcaccgattcaccatctacaacacgggacaaattatcggaaccaatcgggggcaaaaacccccacggccggcaggaggatcgagcaagcaacgggacaaggcgccatttactggatctccctccctccctcgcgcgcgcgcgcgcgcaacaaaacgcgcagatgaacggcagccagaaatcgatttctctactcgcaagcattcgcaccgcattccttcgtctgttgctgctgactgcgcggggcggaagacgggaaggggaaagggattcggtcgagaggcctcacctttttgcgccgccgccgccgccgcctttttctccaactccggcgacggcgaggcagtggaatcgccgccgaggagggggaaaaaaacagcagcgcgagacaagtgcggcgcgtagggcctacttgtcaggtgactgtactggatggataattttcggcccaaatcgacaatattacagtatagttcgcatttgattcaggcccattaaggcccacctatctcggcccatttgaaacaccgaaatagagcaagagacgcgcgggctcaaaaaagaagaaaaaaagaggcgcgcgtcgccgtcgggcggcggcgaagccggagatggcggggacgccggggaggcgccctccggcagccggctccgcgccgcagcggaatccgaccggaggcaggtagataagtatcctgctcctcttccctcgcgttccagctcgcgaagtccccgtttaatttgattttgtatgcgtttttgctgggtagggttatggtatgtactagggtgtgttcgttcggggatggcgactagttcttcgagctttcgccggaggggaagatggcggtgcggccctcggggaaagaggggtaaggatttttcagtgcttgcctcttgggctcgtggtgaactggtgatagcttggagtgtgaggggatcgtcgacaaccgtggcgtgtgcttcgattattgcttaatttgttcaggttacgcgcgactctgtcagccagatgtagttggagagccttttgtcatatcctcatactgcctgtagttcgagacaaaaatcatattttcgaatattttacttttttgggatggttgctacgatgcagttgagtggttcagttgtgattggtgattgtctgtgtaggatgcatcaagcggtatttctgatttgggcctctggaagatggatttgagtgatgatgtgtaccaattgctttctgaaggtacttgtctgcttcgccatttctcaacaactgataaatttgtcaaatgtaaccgttcatttttacttggacgttcatcattcagttgatttgatgtcctttccaagctttgcttcttaaaaggacaaaagaatatttctatatttgtccggccaaattatctttagaacactttccatcttgaaaggcgtcaatgaaactgtactgtgcaaatctgccataggcatttttgatttggtattgtgcaaacaactacagcattctagaactgtatcacaagttcacaacccactttctatcactcttgctcattgcacattcatatcttgtttcagagaactgtttactccactgttgttgcttatatttcccttcaagtttgggacctgattctgaattctttcagaacaatggtgcacgttactgctgatcagcactattcggtcaataatgcagtgcagtcataagtgcaccatttcaagtgtatttgttagttggtactaaatatctgtgcattacagtgtttatatgatactaaaactcttcatgccagaacatttttagtttagtaagaaaccataaggtccaaaatggttggttcagtgttcagactagcagctcggcaaaatcttcttactaatgtttcagattaattatattgctgccatatactgggtgcgtatgattgagaaaattaaatctattaggtaacataaatatggttggttcagtgttcagactagcatctcagcaaaatcttcttactaatgtttcagattaattatattgctgccatatactgggtgcgtatgattgagaaaattaaatctattaggtaacataaatataaggcgtgtaggcttctgggctctggagtaccgttgttttgtgcaatgttcaactgagttgtttttaaactagagaatgagatataaacagaaaacaaatcatgaatcttcttattctttttaatgaactgactgtgtttctttatcattgttgatccagccgagcaacttttttaagtttatcttttatttccatacatcttatctctttgttttattgaaatggatttgtttatcaattcaataccagtgaagcatatgaatctgatgatggaaactgttgcaacggcacattcggaatatgccaatatggaatggctacccttgcctgcaggtatgctatctttttcacaacttttaattcatcaagttctgttctttctttagattatcactcacgtaaacaatatatatccacctgttgatatggtcctgtactccagtgtcagtttttttatatataaaaaaagatatggtccagtcactgctgatggatcctaacttatattttattcgataatttgaagatatatgctagtatcttgcaagggatattttgtccaactgcatcaacaaaattaggcatcaagatttggatgttggtaagcacatcctctctctagatcggtgcaagtgcaacctccgtcttgaatcttgatgacattagatgagaatatctccacacgaaaataatataggccattgctcactcagttgcttacatactctgttttactttagattatgatgcctttctacttcaaataggtaaatactctttagtacagaatataaaaaaaaggtaatatctctgtaacaagcaagtcactgtcaaaattatcctaacaccttcaagtttttgctatttttattaactgcgcccttgattgatccgtgactgtcatttttctttgacgcgttccgtgatagtcatggcttaggattaccgtgcataagggataaaggtgcatgctgatcgattgccgactttttgagtgtttagccacgctttttcttaacttatcctctttggtccgttcaaccccatggatgcaattttaattagttgcgagcagaaagcatattgttggcttagataagctgtcactgtttcgtgcttgtagcaatatgataatacagaatgcagtagtagaccgacaacattgtcccccggttttacgagtggtagaccgacaataatccacctctcgcggtggatcccttttgacttgcaggttaattacttcaggttcagatccgttgattgctcgtgttcttgaaaatataatactcctgtttttacatccttgctatagttatcatgatcaccttgccgtacgttcgttggctttgattaatctggtgatttggttcaagatgatgtggtgtatacattttccatgcatttttctttggcttctttcggcatggactgacttgtgtttgtgttggttgttgcagtccgtaggataggatgagctgatgatgagcagctgcagctcgcaggattatttatttgtcgtggaagctggtgtgcaacgtctacgaattcgtgtaccagactacccttatatataagtactccgtatacatacaggtacgaaaaaaacgcgaatagtagagaaaaatttaatattaaataaatagaatagatgagtctttgaatccagatcaattagctaaccacttgtgaagctagccagaaaataaatccatgtacgtttctctactacaggtacgcgcacggtcggccacaccttgagctgcacgaatgttattcgcgttggacgaggcaggtgcgttacatgcttgtgtgtgcaagttgcggcctcatcgcgtttgtgtggctgtctcgttgtcgtccggatttttggatttttggtccgcacgcgcgcgccacgggtccgatcgatgatatcgtcatccctgccgtgctcgtacgggtcacgctcaagtgataccatgctcgccctggttcccaaacctccaatgccaccatgtgtttcaccagttgtgtgcctgcagcccacatggaaaatatatacggagtataaatctagggcctgctcactttgctattatttttaaccttattaagttttggcattatcaaattttggtaaggttatcaaaattttagcaaggttgtcaaattttgacaagattttatatgtacttactaaaatttggcaacaaactaaatgtagctacttttttaagtaactttgccaaaacttgataaggttgaaaatgatagcaaactgaacaagcctcgatttatgcttgcagaaagagtgagtgcacattttaggtcccatgaaatacatacacgtacatagctatcagcgtgtcctcgtaatacacattcaaatagcatcaataattcctttcccttactctataggaagcataattccttatatagagtataggttgatgcatatataaacgaatcatagcataccacatgacactaacttgataaaggttgtataatctttagactcaacatctactataaagacgcatatttatggacctcgtggatggactccaccatcatattaatattgtctctccaataggatcgataggtaaaaatgtcattagcattattgtcttctaatgtgaaacaaagtgagcgttctacaaaaatatttgacatcctcgtgttggagttcaaatttacaatctcaatgctttagcctatacaaaatcacctatgtagaattgtaatctcaccgacctgcttgagatgccattggtgttaattttctccttttgtttcttccttctcttcttcttcggtttcttttcttctcttcttttttcatcaccgagggcttcccgagatcacctcacgaatcctttctagtgcaagttttagggtttaggcaaagagtacgacatcccttctcctttgcctttcatctctttatataggcgctggtggggctcgagggttatctccaatttggttaggaattagttctactgttcacaaaactaactctccgtctttaggaatcagatacgtgtgatttatcttccttatctagctggcatttagctgataaaatcaaccaaaacctggtattgatagttatagtgagacaaacctctaatcctcaactattcaggatttacgttcacccgtggcacattagggttacatggtacaccaagaagcaacacatttagaatccataaactttttggcgtagaataatccgtgcatttttcatctttagttaacgtctgtttagttacgagtagaagagttaaaccagaccatgacatcgctcaaaagaaaaaaaacaagaaaagaaagaaagaccacgacagtttgacgagctagcagcgagagagagtttgttgggggccgtttgctgtggatcgttcaccagtcaccacacgaaacgatcgaagcagaggctgaggctgaggagagcagccgaaggaaggaagcccaaccgcgtggacggatagaaagaaggcgtgacccacaagccgccgctacttgcctccctcgtctcacgtatatccccttcccccgaatatccgccacgtggacggccctcgcctctctccgaccaccttaaccaatcaccacacagcagttaacccctctcctccccttcctcttctcccccctccctctcctcgtggtctccaccaccaccatctccgtctccactcgatcgatcgatcgatctccataggtgggggaagggaagctttggaaggtggagggacggagggggggatgacgaggcggtgctcgcactgcagccacaacgggcacaactcgcggacgtgccccaaccgcggggtcaagatcttcggggtgcgcctcaccgatggctccatccgcaagagcgccagcatggggaacctctccctcctctcctccgccgcgggatccaccagcggcggcgcctcccccgccgacggccccgacgccgcccccaccgccgccgacggctacgcctccgacgacttcgtccagggctcctcctccgccacccgcgaccgcaagaagggtcagcccccccccttcttcttctttcccaaccccttaatttcaatgatttaatcatcccaaaaaccattctggcctgatgcgacttactagatcctctccaacctcaggtttttcttcttcttgtgcttctttttttattattattcctactagtatgttcttcttcctttgctgcttcggcgtgtagatttgggagatttgatggagtactgctactagcagtcactgctagttgtttcttccaagtaggacagacgctagagaaagcatttaatgggcagattgtactgatggtcatggatgagtgatttggtactacttagctcatgcatacgccactccacttcaattaattactctcggtacaaggacggcgtatagatgcctccaactgtttgatgagatcacaaggacgttttgtcaaactcatgctcagctccatatttgtctaggataagtaagaatttagaatcagaccagatcgttccaacgagtaatgatggctgatcctgtggaactttttaatttgatcctttgcctctgcaaggatgcatggggccacgtgttctgagaggataacagtgtcgaattagggattttgtgagtggctggtaactaggctcagtgttctcatgtttagacacccgatcatcggagattggaacctatgattgcgtacggtgttgttagctctgttctgattcagaatgatttctagtttactgcgtagttatattcgcggtgttggtccaagaaaagtcttccaagctgtcagctttcaaaacccaagaaccttcctaatggcatgcctatgttaatgtgtgaaagcttcaaagcagcacgtgattgtttgatctttactgtggcagtagttcctactgtaacggccttactagaggtcatgccattggtagactgcgttgtcattgcctcattaacttgtacttccatccaaatttgatgcttggagtgcagttttagacttatatgcctactgacttaaatgtattggaaaagtcaaaagtatatgtttgtcctttatcaatttgtaatgaaaggcactaaattggataaaagaaatcgccttgaaatgtacaatttgctattcttttgacatttattctgttaagaggattatgccagattgacaatgttttaatcttgttaaccttctgcataacttgttaaggtggcaaaagacataaaatttgtctctttcccttttatgttctggcatttctcttggaatctcatagaatccttttactttttaagattggagtcctctctctgtgcgccctgtttcttaggaacgggctcttttttgggctggataattttcctttggtgataggcagtactgttattttgtgtagtagtcccaagtttgttggtatttttgtcagtatatgatgggagcttaactattacagttctccagcttcttgtactccagtcattactcgctacctgcgtgcctgcaggccacattctgtgtgccatgtttctgattaagatgactttgacaggtgttccttggactgaagaagaacaccggaggtttttgcttggattgcaaaagcttggcaaaggtgattggcgaggaatctctcgtaatttcgtggtctcaagaacacctactcaagtagccagtcatgctcagaaatattttatacgccaatccaatatgaccagaaggaaaagaaggtctagcctttttgacatggtgccagatgaggtagcttgcttgatcttatttcgattattgtgctgatattggcatgtagcataataagcctgcctgggtctattcttatattgagacgaggagattgctcatttgtgtggtgatagatatcatattgctaaaacttatctttttgaacaaattgtgtagtttatttatgtattgcatgaagacttgagaacacttttatccttgttcgaattagaaaggttgtactgttttctctgtactctaatgggggaactgaactgtgttttggtggttttacagtctatggaccttccaccacttcctggaggtcaagaaccagagacccaagtattaaatcaaccagcactacctccaccgagggaggaggaggaggtagattctatggagtcagatacttctgccgttgcagagagctcttccgcttctgctatcatgccagataatttgcagtcgacctatccagtgattgttccagcttatttctcgccctttttgcaattctcggttcctttctggcaaaatcagaaagatgaagatggtcctgtgcaagaaacacatgagattgtcaagcctgttccagttcattcaaagagcccaatcaacgttgatgagcttgttggcatgtcgaagctcagcataggagagtccaatcaagagacagtgtctacttctctttcattaaatctggtaggaggtcaaaatagacaatcagctttccatgcaaatccaccaacaagggcacaggcatgatctccttctgcacacaactgcatttagatgaatcccaggcaaaataagctttgcctccttgtttttttgtttttattttaagattaaccgttctccgtagtctgtatcatgtgctgtaagttatgctatgtatgaatgtatctgttgtttgtctggcacacatgataaatcactctatgttaacaaaatcagtaatggtagtgctgatcttcgtggttgtactgttgtaaactcttttataagaaaaaaaaatattagttagtcattttgaagggatctcagttcattatgcatctatgctctttcctgatctagattgctcaatggagtgctgatgaatccagcttttcaattctgttagggtctgagctggccattcagttatattctgtactattttgttggagatggattgttattccagcaacccgcgtctagctttatcgtttgcaaattgcaagcattgctataatttcagcatgattatttattcctaattggttcatgtggtttcttacccagcacaacactgatatattcttatgctgcacatgctatattccgaggatttactatgaggttgtacctttcaatcctgattctggaggagatgctccctcttgaattatgcaccaagtgttacatatgtggttggtgacattagtggctgctggccagtctctttcagatattgggctcttttaatccatttgtcatgaattatttggtcatccaggacatcatgccacttttacatctttagcaaaagtcttcatttttgtttctggtgcaggctacaaaagttggcatataccaagaaccccaaaaaaaagggttatctaaagtctgtgtaaaagaaatgattttgctgtctttccctgaagtggagtgactttacctgttgtgaacagcagaaacgtttaatcctgcagaatatggaatagtttttccttttcatctggaatcagaaacaaaatggcacccttgttacaacattaatgttacatttctttgtaattaccatctgaaagagccagtcacggcaactgaccacctcaacacactacatttagacagaagaattacaaacttacatttgctaattagaaccctacactttgtatggtttttgtatggtcaaatacattccaattcatagggctttacatgctagggagagctgttttctctgcttgtttttcctcctcctcccctacaatcttcttccagaaccaatgcttcctccagacctgctccatctgctccatgggcagcttctttgtctccggcaggaagaaataaacaaacactgtcatcaagcagatccatcctgcaaagaagaagaatgtccctgacttgatgcggcatagaactgcaaggaatgtctgtccaatcacaaatgtcatcaggaagaccactgcaacaacaatactctgccctgctgatctgatctcaagtggacatatctcagttgggaccaagaatgtcaatggcccccatgaccatgcaaagccagcaacaaacacacacatggtgatcaacacaaggtaagcatactctctgtccatggatccatagtccttgaactctgcagccaggattgcacccacagcaagctgggaaaggatcatctgaataccacctacaaggaagagctttctacgcccaaacctgtcgacaacgatcatcgccatgatattggcgaaagttgcgcagagtcgattgaccactgaggataggagagacgcgctctccttcagaccaatcgtcctgaacataaccggtgcatagaagttcatcacattgattccagtaagctggttgaagaaagggaccaggagtgctatgacaagctgtggcctgtatttcctcttgaatatattcctgaacggatactgaactgtcctggagaggttgctagcagcaactaagtcatcaagctctttctggactgaagtggtgccacgaagtctctggagtaggatccttgccttgtcagtgtcgccatcgcgttcgattatgaagctcggtgtctctgggaggaagaccgcaccgatggttaggaatgcagcaggaactgcagccatggatagggatatcctccagccccatccagctgtgattttcacaacgcaatagttaagaacatttgcgaagagaatgccgaggctgatgcagagctcgaagccgttattgatcgccccacggtatcgtggaggcgccatttctgacaggtacagtgggattgactgcaaaatatagtttcatagcaaaggcgtcagtacagttaccactgtcctttgggaaggaggaaactattgttaagaaagaacaaatgcaaaaattagagtctaggattaggagtatgcatcagaaggaaaattatgtgcataatgaagtttagttacaaagtggaatcccttttctatgttatctgaaaatcttgattgcaagattgggctttatctccggatctcccttgtcttgcacagtgtgagattggatcagtgaacagtcactgtttttctcataagccattctaattcctatctaggcagtaaatcgccaagtttttagaccacgacatagtttgttgctttccctctgcgttgtatctccacacaatatttcaacactgtccctctccaaaacagagattcaacaggctgtaaaaacttcttaactttttaatgacccactcactcgttatggccacaaaaacgaaaatatgacttgtcaagtcaatgcaatgatctatacacaaacaagaccttaatattataaagacaaccatgtagtttgtcagtgctccacttcttgtcgagtgttatcaacttggaacaaagtacatccacataaacccgctgtctataccctctaaacccaagtcaatgaagacttgacttttgtgcacacgacacgcatggcctgcatttcgttttcaagtgtgtggtgttaggttcagcatgcaagatttatgattttgatacattgtctagaactctagatagcatcacgatgtgcatgatggcatgaacttgatgtactagtgacttctaaaacaacataaggagtaccatgccacatacggagtacaagttttttttttatctgaattgtgcaatagtttaacagagttccttattttctttaatataacaggcactctaaaaatgtgtgacagatatctctgcactatctcttgaactagattcacattcattcagagattactgacctgaaatcaaatgtgctgagaattatacctgattagtgaacccgagacctattcccagtaggatccggttgatgagcagcatgaacacattgacggcggcgccgccgaacaccgagccggcgatgaagacggtgccgccgatcagcatggacgtccggcggccatacctccttgtgacggacgacgcgaagagggtcgcgacgaggccggcgatgtagagtgacgaggtgaacacggtgaggagctcgctgtcgaacgcgcagtagtggctcactctggtgtcctgcttcttctggtacacatccgggaagaatctcttcagaaacgagtccattgaggtcacaccacctgccacaattcatacacgatcgagtacatgagctttcagcatgatctttcctccgtactagtggtagttaagtcacaacatcagtggacagattaagcaggagaacttgaacaatgtttgcgtgatcatccaaactacattacttatctttatctatactctccacacaaaacaagaagcctcgtcttccatctcacacacacacacacacacacacaaaaaaaaaaaaggaatacaaagagtaaagtgttggcaacattgatgagaagctgcattactgctggaagatgagatcttttgagctggaaatgcagcttcttaattcctcatgacaaaaaagcttgcaaaccttttcttgtacgtagactgggcccgagccagccattaacaccggcccatgcagatgcagacaggcccaaccacgagccagcacacgacacagtcacaactcacaagcagtagacgagatgaacagatgagatagatttactacagcgaggaagtaatcaaccgcgcgaggcggcggcggcggcacgaaccggagatgccgaggtcgtagccgaagaggatcccgccgctgccggcgacgacgcaggtcagcaccacgtacgccgtcacccgcccgccgtacccttctccccctcccccgccgccgccgccgccgctctccacgaacgccccaatcgccatcgaccaactccactcacctacccacccactccttcctttcccggagtggagcacgactccacaagaacgcgagagtggagtggagagagctgggtggtggtgcgcggcgaggcttttgcgtggatttattactggagaagaagaaggcgaggaggggttggcggatgccgacatgggcaagccgccgcacgcgtcacgagcttctggaccctgacgccttcggcagttctccgggccccacctgtcagcgacccaccccccggggtacgttctgggctgcacatgcctaacaagcccaacttagagtacgtaagtctagatgggcggggtggcccatgctgactgacaggttaggcccacatgagagcgcgataatatcttgttttaagtgggccccacatgtcggtggctccgtaggttatgggcttcttctttttttgtcctttgtgttgctgctgcacgtgataaagcccaagttaacatggcccatgctgttgactctggacagacaggtgggtgccagcttaatgtggcccatcctgaactagcgggctgacatattgggcccacgtgggagtgtgcgtgatatctggcaggtgggccatggggaggagcggctttgcttaccgatccgatccgattcgccggcgtcggcggcggcggcggcgagatggatttgccggcgagccgcgggcggtggcggaagcggagcgcccggtcgcacgcgcccctcctcgtggccgtcctcgtgctcctcatcccggcctccctcctcctctcctcggcctactcctcgctgctccgctccatcctccccttctccggcttcggaggcggtggcgaaggagggggcaaaagatgtgggcggtcgccggagctggaaggggagaggtttctttggtacgcgccgcacagcgggttcagcaaccaggtgggcgagctccggaatgccgccgtcgccgccgcgctgctcaaccgcaccctcgtcgtgcccccggtgctcgaccaccacgccgtcgtcctcgggagctgccccaagttcagggtcgccgacgcttccgacctccgcgccgccgtctgggaccactccatgcagctcctccgggagcggaggtaaaaatctcactcccccaaagtggggttggttaatcctagattactctctttgcttgttaatgttacagtaatgcaatttccaaatttcacggtttccaccatagattaccatgttcatttggtaaattcgacacaaagccaaatatttattgctattttcatctgtttaacttgcaggtatgtatccatgggtgacataattgatctatcgccgataaaggctacggttagaacgattgatttcagggtgtttgtctcattgtggtgcggcgtagacatgcgcaagacttgcttctctggcttgtgctgtgctgtctctggtggtggatcgctgccaggtgattacgatagatgccgatcgatgctgtccggtttagggggcagcgaaaatggctgtgtgtatcctgtccaggacgattgccgaacaacagtctggacatatcaagagaataatgatggggcgcttgattcatttcaaccagatgaagacttgaaaaagaggaaaaagatatcatacgttaggaggcgcaaagatatgtacaaggctttggggcctggttctgaagctgaggatgcttccttgttggcatttgggacacttttctcaggaccatacaagggatcagagtcatattttgatatccacgaatcgccaaaggatcgtcggctacagactatacttgagaaggttgagttcctcccttttgcccctgagatcattgctacagggaaggagttcgctaggaaaaagatcaaggagccatttctttgcgcacagctaaggctgttagatgggcaattcaaaaatcactggaaagctacattttctgcactcaaggagaagttaaaggctgttgcgttggaaatgaagaaaacccagggtagtggtcctattcacatgttcatgatgactgatcttccaccagcaaactggtcaaagacctatcttgcagatattgcaaaagatgggagatataaattgcacaccctgaaggaaagtgatgaactggtggcacagaccgcagagcggcttatggctgctgaacatggtgtgagatctggatttattcccaaaaacatagcaaacacgaggaaggattgtgatccagttcaactaccagaaattttgttatatgttgaagaatctgtctgtagctgtgcatcactaggatttgtggggactgctggatcaaccatagcaggaagcatagaaacaatgaggaagaacaatgtctgccaattgtaggagaactgcacacatccttcgagcaaactgcctgaaaaaactaaccaccgttacttgactcgtcgactgtagatagcaatatgagagccgttacacaacagaagctgaatccttgagatcttccatccccagtgcatgcatgactgcatgagtatataatgctgaaagcccacgttttttttgttttttttatttgagtagaaaggtataacgtgtgccttaatcattcagttttgtaagtttggatacatttatttattttttggtatgtaatgtatccttcatcctcacagtttttgccctgatgacagtgatagcctgtagaagaattgctcgaatcaaatagctcactttgatctattcgccaaacttcctgtttgtggtttgcaaatccatgtctttgtttgggagaaattgagatcatgtccaatcacttcactgagcagtgaagcagatgcagacgcaaattgtggatcatgtttaaacaaaggcagcgaagctatatattgctcttgttgtcggactgacagtaccatcagccttggctaaactgttaaatctttcaagttcaccgcttgaaatgacatgccagcatgaggtttatcagaatgatgatcacctccatctcgtttgcctgtacttattagtcgcaactaacatttagattttaaaaacttaattttaaagttgattttgatgttctatcacagtattttattttctagcattgacttttaattcactaaaacacaaatatataagtttttatttataaattatatttcatttctccgttcatttttctacagcttatgaagcttcagccatcgaccaaacgatgaggctggatgatccatgaattttttactctagatcacatttagcatcactgaacaaaagtgttctcttttttcttttgacaaagtttacacaagaacatctgttagagtgcgcagcccggcccaccaaccatgggccacccaggtcatattgggtctgctccaccacaggctcaccggagccacaaattttaggtcctgggcctacacaacccaaaagactagtctgatgggtgaggaccgcccccaccttttaagtcacaatctcccccgtcacatcaacccatgtgaccccgaagacttgttacctggcctcaggcccaacaatctcccccatcacatcaacccatgtgaccccgaatacttgttacctggcctgtccaccatgtgacccatggaaattgttccgggatccaaaccttgggctctgataccactttgttaccatgtgacccatggaaattgttctcaccacttgttataaaggttagtctaccacttgttggagtgcgcagcccggcccaccaaccgtaggccacccaggtcacattgggcctgctccaccacaggtccaaccggagccacaacttttaggtcctaggcctacacaacccaaaagactagtctgatgggtgaggaccgcccccaccttttaagtcgtgctcccccaccatcaattaccgatgtaggactaaacccaacaatctcctccatcacacatcgggcccaacaatctcccccatcacatcaacccatgtgaccccaaagacttgttacctggcctcaggcctaacaatctcccccgtcacaccaacccatgtgaccccgaagacttgttacctggcctctccaccatgtgacccatggaaattgttccaggttccaaaccttgggctctgataccacttgttataaaagttagccgatatagcggaacgataactaaccttcccgatcgcttcaatcattgatcacccaagacatgccagatgacgacacaggaacacacgatatttgttaacgaggttcagccgaaacctacatccccggggctctgattatgggcgctcctccccaaccaatatagctcctagccgctacgagtccatggccacgccgccatcatctccctgcgtgtctacgctacattgtagtcgccatggttacattgtggtgccccccgctctatttaagagagatgccgggttacagagtttgactctaactccaccccctaacacctattacaattccaagtccaactgtaaccaaatagaactagtatattcgacacctattctaacaacatcaatgccacaggatactctcatcagctgtcagctgctggcatggcaggcaacaacaccacagatccagaggttctccgtgcctcgagatccgcgtgcgcgcgagccgcctcatgcagcgggtagacatggttgacgcggacgcgcagaacgccagccgccacgccggcgaagacctcgccggcggcgtgcagcagctcgtcgcgggtggcggtgtagtgcctcatccctggcctgcccaagatcagggacttggacgccagatcactcactggtacagggtcaggcctccctgaacattgcccataagagatcatgcatccacgcggcatcagacactccattgatcccttcacattcagagtttcagacaaaaaaatattcagtttcaggcagctgatttacctcatgtcaagcctatgattcaacatttaattccaattttcatggcaatgctttttgtcaagatcaaagaaggtgaaagtgattgtaaggtgttgcaaaatgagagtaggatggttttgctaccttgaaggtgtctttaccgacagcatcataaacaacatgaacacccttcctcgatgtgatttcagcaacttgggctacgaaatcctcctcggtgtagatgatcacatgatggcacccgtcttcggctgcttggattgctttctcttgtgtcgaaacggtcccgataacggtggcaccaagggcattcgcccactgacaaaggagagagccaactcctcctgcagcagcatggactaggacagtatggcctgcctgaatctgcacaagagaccaacatggaggtgtttctaagttgcattctgaaatcaaaatcagtttctgttttgttttcttttgttttgtgtctctgaaatcatggaagttggtactgaactactgaatcagcttagcacaaaacaatcaccttaaaggcttgtttcacaaggacatatgtagtcattcccttgagtaaaacagatgctgcagtaatgtggtccactgaaggtggaataggaatggccagtgttgccggtataatctgttcttcagtgtaagtgcccattggagtatcagcatagccgactacatcgccaacttcgatacctgttaccccaggtccaacagcagacactactcctactgcttccttgcctggatgaacacaaagtcaatgctccaagaataagatcattcacattttcgacaagtttgactgttcatttgcaaatggatagtgcgatcttgccttttcggcataccattaaataatttctgataaattcgattgaatactcattagttaaacagtttcttttgtgtgttttcaatttttctagaagtcacaaactgcacttcttgtgataattcggtgcttggctagtacaaaaaacaccaaagaactttattcaggggaagactcttcaagcataacactgagtctgattcttcgtatgcaaatggtgattggctgtagtgatttgagaaatcctacatagaaattacaaggttcaaaagtcctatatcactgctcacttgcctagttagtgaacagtgatagaagactgaaaagtgctagagtaagggcttgttcagattgatgccattttaaaccatactattttttttggtaaagttgtcaaatatgcgcatccatttagtttcttaccaaactctggtaaataaataagaaatcctgccaaaacttgacaatattgccaaattgccaaaattttggtttggtaaggtttattttggctacaatatgaacatgtcctataatttttccttagcctaccagtatactctataagctcagatggcaaccaagaattttctccgggccatgaactgacattagatttaacaaagtaagttggaattttgttatcagaatccccatacaccagatctgaaaacattcagcacatcactgtcattgatgatggtaaaatactaaaatccgtaccaggaacaaacgggagaggttcttgatgcaacccagtacggtaataaatatcgacatagttgacaccgatagccttgttcttgatccggatctccccctcgctgggctccccaatctccacctcttcccaagttagcacctttggacatcagaagaagaactgcttactcccaaatggattagatttgcaggagatgaattataaggaaaaggaaattagatggagttttcttcttggtatagaacacacacttacctctggaccaccaatcttgtggactctaattgccttcaccttcatccctggaagcactcagaggcaaagctggatgtgcaatgtgctgataagtttatcgagtagaactcctgaaaatttgtgagttcctagcagcaatatgtggcagttcagcaataagcagcagtctctagtggattcaacaggactacaaaagtacaaatacatgaggacaaaaaaacaatcctattcgtaccaacctccgcaaatttgcggctggcaccaattataaatttataatacttgaatgatgcgcatgtttcatcaaaacaggaaatgacaaaaagagaaaaaaacaattttgagctaggatcagaaattcagaatacatgggtacatgggagtcatggaaacgagatctgacccaagttggagtctgaactctgaactcaccagtagaagcagaagcagcccaaggagaagaacttgggcagcttcgccgcttatccggcggccggccgcgtcaccttgtaggtgcaggtgcagtgcgacgccggccgccattgttgccatcttcggagctcgagctctcccacccacgtcggccatggctcgtgctcgcgcaacaaagcccagggagacaggtcagtaaaatgggctcaaaccggatggtcacagcccaatgggcagatggcagcccaaaaggcatattcaattactccctccatttcatattattagcaattcattttttttaactaaaatagtcactctcatgtcccaaggctttaaatgtgatcttccctccctaccctatatatgcagccacaattagtaatcagagttaatgactactttgaaaaatgattggaatgtactctgataaataaggggaataatgtaatttgccatagctctttatttgctataaaatttactagaatgataaacaatttgaaataaaatgagtatggaccatgcatacctttagacgctctttgatgtagagactttactatctgtctgttgtagcctacggctcaagtggatacaactttttgtttaattatgtgtttccacacgcgctttgctgtgggaattacgaagcaatcttcaatatattttttcaacaatcgagttaggagtaaaaaggatattagttattaacaacaaattaaactggtttactaatatatatttggagagaaataaattcaatagataaaatattagattgttgatcaagatttgtattgcaagaagcagaatgcaaaaaataatgaaacgtcagagtttacgatactaatcatgaaacaaacaaatgatattgtgctttgatgctgaatatattgatagatatatgttttaagtattataaaaatgataaatagatactttgaaatattgtggaaatgatatgagtggtgatgataagatatgcttgcttgttaatttgtagaattcagtagattgtagatgatgttcatgcttacatgagctttgatatgtaataattgattgtggcatgattgcatgtcgagttttagatttagtgggttgtaactttatatttggtataaatttcatcagaataaatagaaaaccgaaatacttttgaaaattcataaagaacatttttaaaggaaaggtggctacaatatgagtaaacccaagtttttttctattgtgttgtgtacagggcgacaaattcaataaaacttcagcccataaatgtggtccatagaaatgtcgacccatccaaaataaagccttaatgtgatagacgggagcgactattttagacccaaatatatgtttaggcccatttagaaatacgattaggtcggtacaaaccgtcattgcttataaaagggcaaaaggctggctgcctttcctgctttcgtccattgctcttatcctcatttgtgaattttaggcagcctctccgccatatatacaccacggaacccaaattatcatggctttctcgctatacggtggtggaggtggcgaagttggctagagtaaggctctacaagatgaggttgtgggtgagtgaggggagaaacagggaggaggcggaggaagtctttgtgattacgaggtgattgatgctacgacagcggttgatctaaaggcaatacaacaagagaaaaggtaaaacaacgttgttggagaggatgttcagagagaagtagaagaaggtgttcgatagtaagagagggaggtgcccggggaagaacggacttgttgctgctggcggcggcgaggtaggggatcgatggtggtggcaacaaaaaacaattgaggtggactagtaattagggttgttacaagattaaatgtatctggatcatcggatctccatccaacggcctatttttttttctatcatttgggggcgaaggcaattattagatcttttaaagtttattttctttcaattctttatttggtaatgttgtagcaattcccaatatgggattattctcatcactgttttttccccttcccttgtcagaaacatgttcctcactctcaaatgcattggagacaactggtcaccaacaatccatccatgctggcctggttgactagttcagtacttctgtcaggagattcgccatcatcatttgagtgagttcacctttactctatctaatcaccacaatcaagttaatttcgaggcagagccagatcatatattatcgacaaaaggatcagttaactcccaggtgtaaatgtgtaatcaaagtgtctttctagctaggatcctttttcaaaggtttctcgtgctagctgctgataagtcataacttcagaactgaaactattatgaaccatggtcttgttaagtcatgtttggattgatataatctacctttacacatccccaaaggtggtagcagacagcattaacgaactgaatcacttggattgaaagccatggagcaagcacacatgatccatctcgttgccacgccagatatacaagtagatatagcttaatgatcaccacaataatcaacttaatgatatggagatagaatattcccaactcctagcatttttgacaaggatctgttagcttcctggtgtaatcaaattgtctctttagatagcgtgtgttaggggacgcacttacgggtggtgattgtagtgtgcgtgtgtgtctttcgtgtaatcgtaaaaaaaaagtctttctaagatctttttaaaggtttgttatgctagctgcccataacttttgaacttaaattcatataaccatgtccttattatgtcatgtttggattgatccacctagctttacacatccccaagggtagtagcaaacaacatttactaactggtgaatcacttggatcaaaagttttggagcagagctacacatgatcaacaatccgtaatcccgttgccacgccagatatatctcgagccaacgaagctcctctcacgtacaccatagggacatatatctctctgacgtgtgggtctattggggtgagcctcacgtgtcagagacgacttatgtccctctgactttacgttagaggagcctcttccatctcgagccagctcatattgattatccaagttcgtaagtttttctaaaactttttctacctaactcatgtatctccaaatcatgctgttgaaaagatagcttaagctaagctcgaacgatcacgcatgatgatcgatgttcagagctttgtgtgcagaggtggaagaactagcttttgtgtgctttggcggtttggccatgcatgcatgcatgcgtgcttcccacgtgagctcgccggagcgggagcacggctaggtgcagtgacgtgtgtccactccccgttgatttgatttgtctcgtagctgcagcaacaaccgccttggcctcatgcttccccggcgagccaccagctgccaatccggccagctatttaacagcgccatcgatcgatcgatcgccagctgcagcgagcgtttcgatcgagatcgagatcgaggtgggcg

SEQ ID NO: 12734 - DNA, 13292 bp, Oryza sativa
  unsure (1)..(13292): unsure at all n locations
aacggcggctcgaggcgctcgccgccgcgggggacgcagacccggcgctccgcttcctcccctgcaccaacgcgctcctcgccgagcccgtcgagggcctcgcctacttcgacgcgcaccgcgacgaggtcatggagggcgtcagcgacgtgtacaggaacgtctgccgcgtcatcttcgacgacggcgtcgccgccgccgtcgccgccgccgacgacgacgacgacgccgaagccgccgcgttcctcccccgcgacgtgctcgacgcgctcgacggcacaccaccaccaccgccgccgccgccgatgtaccaccagtaccaccaccacgccgtccacatggccccgatgctgccgccgccgccgccggtggccgagctgaacccgatggcctcgccatggttcccggtgcagcagcaggagcagccgccgccgccgccgccgcagccgcaccagcagcacggctacatcccattgccggaggactaccgctcgctgttcatcaccttctcccgcggctacccgatcagacaggacgacatcatcaacttcttcaactcgtaaaccaaaccaaacccagatcaaacaccttcttctcgatcgatctctcgccatgaatgatcataccaacaacaccttcttcttcaacataggttgtacgggccgtgcgtggagtcggtgatggtggagaaggcggcggcggggcagctgccggtgtacggacgggtggtgctccggtgcccgtcgatgatcccggtggtgctcgacggacagcagacggcgaagtacatgatcaaggggaggcacctctgggccaggatctacgtgccaagctccaagcccaactgaactgaactgaactgaactgaatactactactacatatgcatgaatgctatacacttacgctgatatagtatcatcaagctgcagccagagctatattatcatatataatcacatgaattaattaagtatgtgtttagctatactagctcagagagagacaagtgttgatccatgtatgatctgttgatgtttgtgtgttaggcatgcatgtccaagcatactaccctatctagagctttggacagagcttaattgcatgttttgctagcttgtctctcatggaataaatgtgtgtctttcatcatcagtctatcgatgtttgtagcttgtgcatacgtttttggtaattttgcaatgaacagtggatgctatatacatgcatgttgttacctagttaattatgtgctgcactgctactttattgtttgttctggttggcaatcaggaaagtcaaattacagagttgagttagagtgaagaagccaaggcttatatcccaattaagtttgtttgtgcagtggagctaaagtcacgctaggattgaccttctgctactgtgttattctatgtggtgcctcttctgtaagtatttacgttttatttttgtttgaatttacatattaattaattgtcattctatgtatactggcttgattcttggacggagatttaatatacaaaatagtctgaaaattgactaaatttttagggttgacatctattcctctccaaagattctgataataatgtttggtttttgtttcacgaagagtagaataattgtgcattctgttcagaaaagaagggagcctcttccagccctatattcaggctaagatagagcatatgaaatattatctacttgctatctttgatttctggttagacagaagcatctttaaatcatcttctgtaggttgctgtagcattgccaaacaatttgcttctctaactagaaatccagacatacattaattaatattccttcacataaacgaaacagacaagtctaggattccattggaggactccatggatcctgataactccaatgctaacaaattgtctgaaggtaaggattttcttcaatattatttcaatctcgttagctctccgtgggaggtgttgggtgcaaatatggttaccactattttttttagggtgaatagctcaagtagtcctccaagtttcatctaagcctcagtttagtccttgatgtttcaatctatccatattagtccttcaagttttcattttagttcaaatttatccttgaaccaataactctcttgataaatgacacttataccctcatcattcacatatataagagaaaaattgtatgcttgatttttttaagataatgtatagtaaattatgtaaaacgaaaataaattatgtactagcaagctgtatacaatagtaattgcttaagtttcatgtgcacatgttgaaataattggaagtatatctgcaatgttgtttattcatcttgattttctcccttttagtatatagttgtatataaattaagggcaaaagggacattttctaatagaaatattgactaaaaatagccatatggcatattaagttggcccaaggatgatgtcaaaccaaaacaaatatttagaggagctatgtgaacaaaataaaacgtgaaggatcaaattgagccttcagtgaaacttgagggacttaattagctattcacctttttttttatatatccagtaagttttcaggtgccttctttcacaaggataggttctactagtttttaccaccaatatatcagcttcaacttcatatgttgaaccttttagattatattttgaataaggataggttttatcaattgtcatactaaatgactaatccaaatcatgtaaaatgtggatattagttatatttttagggtcaatctaaaaatatgacgacataggtaaaaatatgtcaaatgcaattatattacaaatctaatgtaattatatatgtaatttagggacttacatatgtaatttagggacttacaatgtaaatacatgctaactattttttcatgaaaaacatgatggcacatttatagcaaatccgtatttttattgcaggacacttcggtcgagctggaaatgtatgtttaattttcattatatatatttgtgaagaatgtatattgcacgcgcacgatattactagtgtagaactaattagtcatatccctctagtcaattaagcatacatcaggttgtatattgatcggtttttctctcttcacacataaatacacatctatttcgtgattatttatttcttcaattctgttgagatcatgaactctcaacttcttaagtactactgtatacccttcctaaacgctgttgttttcatttgtatatatgctatttcaaatcgccttttgcccattagtaaatcatctactatgctattttgagtgttccgtagaatatgaacagattgtagctaaaataaaccttaccaagttttgtcaatactaaaattttgacaagatgacaatattgctaaaattttggcaggattttttatgtattgactaaatttggcaacaaactaaacgtggatattttttgggtaactttatcaaaaaaaatggtatggttaaaaatagcattaaagtgaacaggccctacattctgtagttgcctgtatactgtattgatattagtgaaaagttgtagtctctaattctccgaacttactccttggctttcactatatataattctgatgattcatattctatggtgtcggtgacaagataactatactagctagctagtagaaggagtactatatatatttctgaagattcatattgcatcagaaagaaatgcaaggatgagtgtttcactatcttattcttacctcctctgctttctgcatagcttgcacttctttggttaatagaaattttagtgtctttgagaggtaccaacagataagtatcaacttaaaaaatatggtacatcccgttatcttcttaatgactgtaaaaatacttgtacagtaagctgcatgtggaatgatggagaatcagattaagctgcatttgttgcaaagacatttcatgcacgagttgatccatcaactagttaagccgaatattcaataacacaggggagcagatgctgccatttttactgcacctctaattgtgtttacatcatattaagagagagttatatatatagtataacatattatttttagcacgcttgttccaatacaccataataatttagctttatttgtttgctcttaatctgctgatcacttagagtttgtataaatgttgttccttgcataaagcgtggcccctctctctcaatttgtcgatatttgtagtttgtgcatacgtttctgtatttgcagtaaagagtggatgctatgcattcatgttgttacctagctaattatgtgatgctttatgtttaagtaaagtcaaattagagagggcaaaagatgtagtactgtttcatcagttatgtttcatattcatattgattgtgctgtaatacaaagatatcccagtattaatcgcgtcaaccagcactaacttatccccttttctcccatatcatccggtgggatctcagctaatgttacttcttgaagcttgatgagctgaacactcggatgaatcattgtttagagctttgatgccacagcatatatctgaatatcatgtttgtgagggagccacggcgtcagcgcatccaccagccttttgatgtcatccgaagaatgagaagcactgagagttattcgcaacctgcaaagaattcatggaaagaaataaaacagttaatcttggttgaaacaggcccgaccttatgtcgatgaacactaggaccatctaatatctggacaacaaattatagcaagcagttcaaaaaaaaagtctagcagggattccatctttggagagcagtagcaaagaccaagaaaacacattaataaaaatgcatatataccctggttcctaatccaattacagtctatggtccctaggaacactgatgctttaggttgctgaagtctatgaatagagattaggatggaaaatgctaggaacaaaaaattttcaacctgcatgagttgggcggtactgtgggtggtcggattggcgtgacatgaaatccagatcttagcatatccctgcagtttcaaaatgaaaagattagaacacacaactgctgatattatcaagaaacaaaaatgggaggaagtgagaaccttccagctctaagtgctgctttttcacttccaactacaatggaaattatgggacttgttatgttgagttttgtcaaagaggcaaaatactgcacatgcctccagatcactgatctccgccatctctcctcccttgatacatagagggcagctgaaattaattgattctgtttagaagaattcctgatatttactttgacaatgagataatttttacgttagttaatgttttatttaaattcgtccttctatggattaatgtgatagagaaggttttctatgcccttcctcgtgaaaacagtgtaacacaaacaggtatatgtagcaatcaataccagattcccatatcaatattttaaattattagaacacaatgtgtagagtattaccatacacagaagcaactactggcactggtaaagcagttgaaaatatgaaggaacgacctcgcgattgaatcagcctcttccatcgggtactgcaaacaaatttcaaattattattcgtcataagattggaaattgtaaagacagattatggcatgcatccaaaatgcagagattatggcatgaagtattatcaagagaggctaattcaagagaacttctatttattgagtttataagcatgaggctctgaagtgcaaatttcataaccaagaccctgataaataatattatgtggtgtccagagcatctattaacatcaaaagttaagcacttagcgtaattcctaaactataatcgccgatgcccataagttactcaggacagcaacagatatggaaaatgtttgaagtcatccaagcatttgttctaacatttcctgttggccgtgatgagcatgccgctactgtttacatattatcaagtaggttttgtctcaggtattttatgaagtcctttatttcaaggcatctatgattcatttccacagtttaatatgcactatgagcagttcttccttgccagataatatggacatgccttagaatagaatacctgcatgctataaaaccaccctggcagccagcagccttgcttaaggtgccaacacttatgtcaatctcattctcacattcaaacagctcaggtgcaccaccaccattctcaccacaaacaagtgttccatgtgccttgaaaaggaaatttgcaacataacttgattaatattaggccagaaaaatactgtatttcagggaagataatatactaacatcgtcgatcaccaacaaaaacccatactttctgcgcaacttgacaagctcaggcaatggagcaaaatcaccatccatgctgaacaggctgcattttaccaatcaaaagagcttctgagttcggtacactactcactaatacagagaataaatgcttcttaaatgatgaaatttacttggatgtataacttgcctatctgtgacaacaactttcttttccattgagcaactggatctgcatgtgtaatcacaaacatggtttataactaagtaaattagtgcttagcattttgtatgttatgagttatgactggaaagtgaaaaacatacagcaaaagttcaagatgggacatgtcacagtgcttgtacacaaatgataccacttcttgctgtcgctcaacaaggcgaatcccatcaatgatcgaagcatggttcagagcatctgagaaaattgctattctttcgtcctccgcaggttttctcccagcagccaacagagagctgatgtttcccagagccgtcattacagccatattggcagaaaatccagtgggacaaagaaggcaatcctgtagaaggactctagtaaggctgcaagttttttattttattttgtataccgggcacatgtggttgcttaaattttgaacgcaacagtacctcctttttcttcagctctgccaacgattcctccaccattttgtgataggtagtatatccacaaatcaacgcagatcctctagggcccatgccgtactcttcagctgcctagtagatacaccagaatgttggcaaagttaaccaccgaagcattgattcagtccactccatagatcaaacaaggaaaaatcgatcatgcgccagtctaggatttgcccctcaatgaaacatggtgcaaatcctagagtgtcaaaaaaattccgcaccaaacaatagccatgggtgcaagaaaggagcaccttcactgcggcatggcgaattgcaggatgcgagctgaggcccatgtaatcattcccggagaaaagaatcagtttctcgtccactttctcttcttggccactcccctcaccacctaatcaagtaaaacgatacatgagaagttggtagagtttctgcaaaacgaaactatattgataacaactagaattgttgataacacctttcccattaaaaatgatattgaaagaaactagaacatgttgtttaggcttatctcaaaggcagttattacatggaagaaataataataaaaaaatgaaaatttgatatgcatggaagcaaagcagatgataaaaaaaggttggaccttcagccagccattggtggagcgttgcgcggtcgagccggatctcgacggctgcgcggtcccacgggcctgggcaggggaaggtctccggcggcgcgggcggcggcgcgagggcgatggggcgcgtggcgcgcaggaggctcctggacgccagcctcgccagcgcggcgtccacgagcgcgtcccactgcgccattccgtcgaacagcttgagggggcggagaagacgaggcagatagatgataagggcgcgggagtggcggcggccgggtggttgggcccacccgtcagcgaccgcgtggtgggtctcacgacgttgctccctcccgccgccttctcagcggcaagacgtggattcgcctctcacattcgaccacccctcctcctcgtctcctccatcgccgctcgcgctcgctcgctcaccgcgacggaggcgagtggaagagaagcagcaagagggacgtgggatatagacgcgcggaatcccatcaggcggcggcgcggcgcgggccagcgatgaggtggcggcggcggcgtgcggcggcggaggcagccggcgacgagggcgagagggctggtcgaggcacagaagccgtccatcttgatccgacggctgccggctggccctaggcttccgttccgtagtgggcccaaccttttcttcgtgggcccgcccattgaatagtagagggctcttttggcggcccatttagcgttcgcagatatccggcccaaataggattccgcctcttggaagcccagtattcagcccaaaatttgcaagttagttatgtggcccgtatttctagagttgcagtgggcttgctcggccggaccaactttgagataggcctcagcgtgctcgtcttgggcctatttttcactcggttagctgatgctttcgtcttggttgcctcaaaagaaattgactcgacaggccactgcaaacgatgtactagtaccagtaacaataacattgtttctcaccatttttcagtcctttattaattatgcgtttaataggttcgaaaacatgctaacgaaaaacaaagaagttatcgtttgaagttgatgaaaagaactcagtcttaagcctaactgccaagtgccaacgatgtaccagcaatacatgtgccatttttctcaccatttttcattccttgattaattatgcgttattctccagcacctaattaattgcctcacggaagactacagtgtagagattcaaatgtgttttatgcagccagatcatggtgctttggtacagcttcatccccactgttcacctcagatatggccaaagatgcatcatatgcagctagctaccgcgatgatgagtaaaaacgccgcaaacctagctaacgcgtatgcatggtacagattggtacgcaccgaaatctgatgagcgaatcaaacctgccgtgtgccgatattgcctgatgccatcgtcgccggacgatgtcaggtttttctcatgtcaactctgaagtcagttctataaaaaaaaaaaaaactctgaagtcacagtgatagtactaactccataatgcttatatttaagacatacaatatactatgatctgttattcctttaagtatttgtaattccttttgtaacaaaaagactgagttgtcagttttaaaatttgtgcccagtgttagctatttgaaaacaaatgaagtatatattttgatcgtgtatatctacttgtagatatgaagatcgattttttatccgttgaagcacggatctattgagcctttcatttcagtggagaaaaacgtggcaacactaatataagcatgcatccccgaatgatttttgcaaccaaaacaaggttgtggtcgccatctcgaattcgaatgtagagtagtatggggggtgcatactcctactgtactcctttgtactgtcctagctcttgaaagaaaataatgggaagcagagcaccgttctctgtcgtagtctgtactccaaccgattggctacatacacaattgagtagtagcatgtagtatggccacagtgatgaggaggggaagaagacacaccaggagataacgaggagagtgcactacgtgtcccggcagctggaaccgaacgcttggatccaatagttgaaatggattattgccgccctcccagcaagccgggggtcgcgctcgcgccatggctgtcgcccgggcattggaccgtgcaaaccatcgtcgccgcgacgcggccacgctctgtgcagcggacacgaagcatgcgcgcgcacatggcggcaggcacatgcgcggtggaggacgcatcagaacacggagggcgcgtcgcgggccgatgtccggagcgcgtgcgcgttcaccgcatcagggccaggcaatgggacgacgcgcgccgcgcggcggcgcttcgatcgatcgatcgacaatatgcatgcattgatcgatctcccccgtggaaaacgaaggccgttgacgggttgagtgtacgtataggtatccactcttacgatacgaagacacatgctttctacctacacaagttcgtgtgggccggcgcgtgagggcgggaacgctgattcgtggatatcagaatttgaactcttttggatgtacgcacaactctgacatggaaacaccgttagctttttcatttgctcttcagcttactagtcgtgactaaaatttaaattctaaaacttaattttaaagttatttttgatattttttatcgtagttttttttcattgtttctaagtcgctaagaatatatataaaagatctattcacatattattttttattttttagtcagtattaagtgttacagtttataatcagtggcaggtgaagcgatggagctcgtagttagtgtggcagtaattactccatccattctaaaatataataatttttttacggataaaatatattttaatactacgaatttaggatatagtccttccgtctaaaaattcttatatattttaggacggacggagtagttgtcatctctagtcattatacatgctatacattttggacaaccaaattaaccatacattttacctacaatttttttatcctaacgacaaactttggagggagtaataaactagtagtggtaagtacactctagaaggagaaaaggaactaaaagcgaaacagtgaatggttgctcacaaaagagaataccaacaaaaacaataacaacatgcatctggaatccaatgaagggaaaatccaatgcaattatgcgtagatggggttcacttgccacatacatccaagggagcaagcccagcatggctgcatgcaaggcaagcacaaattttttttgcttccaagagacagcagggccttccaaaagccagaccttgggtgcagccacacatcccctggccaaatccatgtgctccaatcccaatgccatactactactgcccactggccaataccactgccatatgctgatatgccccttgccttgatttccacttgcatgggctgccattttcacatcctaacctgttccagaacctgcaatggtcagctgttcgcattgcatttttcacatcctctgcagtagtgatcactgacagataggtccggtctcacatgtcagtggctcgtatcacaccaacagctgttgatatagagaatctctttggttgtgtgatcccttgcaggatgagataagataaagagccaagccaacaggagctaatgtgggcagcagcatggaaaagccagatgagttgtaaaatggggggtgatgcagcacacatgaagggggggggggggggttgtgggctggtgtgacatgcctttaattgggggtgtgtcaccagcaagacaccagggtttcttgagcacttgaaaggaacaatacattgaggagcccctcatggtgtccttggctgccttccatgaatattagtcatcccttgagggccaagctgtcagtgactgaacagtcctcctcttcctccttttgcatgggcccgtcccatcaccttctacattgatatgaggtgaaatggatgtggatgctgatatatgtcccatgttacttgtagatcaaagtggaacacaggtgttacacgcgttttttcccctttcctaaaaaacccctcggaattttctccttaattacaacatgtggtgtgttctggttcataagaacttattacataccgagaattagaccctgtttagtttccaaaacaaaattttcacgctcacatcgaatgttcggacacatacatacagtattaaatacaggaaaaaaaaccaattatacagattgcgtgtaaattgcgagacaaatcttttaagcataattgcgccatgatttgacaatgtggtgctacagtaaatatttgctaatgatggattaattagacttaataaattcgccacgcagttttctggcggaatctgtaattattttattattagactatgtttaatacttcaaatgtatgttcttatatctgatgtgataaccaaacccaaaaaattttcgcaactaaacaaggccttaaacaagaaactcgctatagattaagatgatgtagatcacacgatgttactaattaacctaccacgtactacctccgtccaatataattgcagttataggtttccgtgaccaacgtttgactgttcgtcatatttgaaaaaaatatgaaattttttttaaaaaatagtcacacataaagtactattcatgctttattatctaataacaataaaaatattaatcatttttttaaaataagatggacgatcaaacgttggtcacggaaaccaatagctacacgatggaggttgcatgatttaagaaagtttcgtccaccccgtttcataggacaaataaacaaattttggagaaactagtaccaatttgatgtcctagcctcaactactaaaactggaccaactaaagctcatcatacatacaacaaataaaactgctttttatctcacacagtttttttttctaacttataccagcaactaaggaatttttttttaaaaaaatcatatgatgaacgagcgagcctgaaataaacacggcgacaccgtggggacaacaacggggggacacgaagcatatataggacgggtttgaggccccatcatcagttgtttataatctccaagttaaaactctcgtttgcatttggaactcgcaataaaaacccccctctctcctcactacgcattcagacgcaggcgccactccgcccgcacgcaacctgttcgacctcgtgctcacactctgcagctgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12735 - DNA, 7874 bp, Oryza sativa
ttgctaattgccatcacaaatcattgcataaactaagtttcattaaccaaatgcgagttaagtgaaagaatgtgggaaggaaggaaagaacccttccggggccttgttgatgaggaagacagcctcattggaggggcggatggtggcttcttcggccccattatttgccgcacccgaaccatcgggaagctgccggcgccgtggtcggcaaccgcctccgccgccgccgccttgtccttccgcttcttggcgggcgtgggagagcttgcctggccttcaccggacggtcgctcctgtgggggatccacgtcgccgagcttcctcttggtgggcgtgggcttccccgctcctcctgtgtcgcgtttggcttccttgttcttcttcgagggagtcgacataggcgcggacgcttgctgcttttcgcgcttgggctccttgctgctctccttcttcttcttcttcttcgtgggcgtgggcttctccccttcgccggaaacccggtgcggcttctcgctcttggcccccttgtgcttccgaggtttgggctccggcggctggcgcttcggcttcttggagggcgtccccgcatcggcctttttcttacggttggatcccccttgggggttgaggcgcttgttgttggcgggcggcggcggtggtgcctcctccttggggttggggtttttgcggggtttcggcgtggagcggtccttggaggtggcggtggatttcttaggggtggaagcggaggcggaggcggagggagaggcgggatttgttagggccttcttcttcccggccatgtcttctccggcaccggcaccggcagccgcgaggttcctctggaaggcggcggccggagtccggagagttcaaaattatttggtttgggggcgctgatgctgaaactcaactgattccagtctctgttgggtttttgactcatccggttcacgtatttgcaaatgtcatcctcctggatcatttccatctttttatcattgaagagaaggcttttcccaaatattggggttattgctcgtgtgtcattttttaaatctacggaagccacgtcaccgcagtatgtgtggataatggatcatgagaagcctgattgagaaatgtaaatgaatgaaaaactgagatgaaatgaggtactatctccgtcttaaaaatataagtatttttagctaggaaattatttccctaacccattagtcatgtcttgagtgtaaaattactcatttatcttttttctttctccctgccatacaaagaagaacccaactctcattggaataattaactatttaccactcttacgagtggtgataataaatttgtcaataaaatcgcatgtcatatcattaggttactattttattgatttgtatcatcgagcttgttttattctgtttcaattaaaatgtattgtagtagtaattatttacgtctccacgataaagataagaacgtgcattgcaggtattaaagattctaaccttttctcattaaagaacaaatcactgtatcacgacataattctttttctaacgttcgatcttctttcaacaacttcacttgagtctcaaatttttccagtgcgtactacccttttttttaataactaaacattattgcaatccagattattaagctggattataataagttataataaaataagttattagctgtttgtttctttggattattagagacatatattattggtttcgaaaggctgatgtctctaataccctaagctattgtggagtgggagaaggatgaaatggcggcgatgacgatacggcttggggaagggttcgcgcgcgactagggagagaggaagcggatgcatgcgcggctgggggaggcgccggattcgcctgcactgtggagagaggaagcggatgtactcaatctattgggttcgatggaagtggtgggtaatttgcatacaaattttaagattagtgggtctttagccacctactaatttgaaagaagcacgtttagaggagattatcatattatactaatctagcttatagattattataatgatctacatgattgtttcagattattgctaataattcagattataataattctaagctgaaataaatagggcctaaacaatgtcatataaataaaaaatgtagggagtagttaagttgttaagctagtaagaaaatacaggagtagattgtaagtgttactttagtttttccatatactccgtataaccaattgcatacttacaccaaaacaatacaatatgattcctccgtttcataatgtaagtcattttaacattgcccatattcatatactccctccgtttcatattataagactttctagcattgtccatattcatatagatgttaatgaatctaggcacatatattatatgtcaataaatctagacatatgctaaaaagtcttactagtataatatgaaacggaggaagtagatgttattggaatccagacatatatatatatatcattaacatctatatgaatatgggcaatactagaatgatttatattatgaaacggagggagtatctattatagagaaggaacaaccacatataattaacatccacgttttatttttttctatatgaccacttgtaatccctggcttgaccaacaacatactacaacaacataggagtacataccaggtcagatttgaattgtcaacgaaacatggcgcgttgcaacgtgtgcgctgacgtgtcgctatcctactggaacacaccacgtcaatgccaccgactcgtggcccccacatgtcagtgacacccaggcaggcaggaaggcacccacccaccggagacaccaatgcacgcagctttccgttgcgagtttgcgacccatctccatctccatccatcccctttcccctttcgctgccaacatctcatcggcgattcgattcgggtcaattagggtttactcgagactcgagagaggagagctcgcccgctagggtttcgcgggagatggcgcaggcggtggaggagtggtaccggcagatgcccatcatcacgcgctcctacctcaccgccgccgtcgtcaccaccgtcggctgcaccctcgaggtctctctctctctctctctctctccgcccgcccctctttacatgattctactctctcctcgatctggtgcttgtttgagtgcctgcgctgatggcctaatgccctccttgcctcgcagatcatttcgccctaccacctgtatctgaaccccaagctggtggtgcagcactacgagatctggcgcctcgtcaccaacttcctctacttccgtaagatgggtatgcgcctcttacctttctcttacacttgcaagattgtcagtttacaaacagtatctacttatatttactatttgtgcggatcccaatcgtaatttcaccacgtttgcatagtagtaataagagttctcaatgataattctattattgtattctgagggtatcatttcagaggtgtgaagcatagggatgtgaagttagaacggaagtattgttctgcccatgactcattgatgaaggcttatgcgcctacgtgctacttagagaatgtacagtaaggtataaagcgctagtgccaagagtgctcatgatgaggtggaggagagaaggagctgcccctcatgcaagaggcggcctgtacatgtgctccatcaccaagagagggaataggaagataaccaatagattgatatcaaacaaataaaataaaattggtattgtcctaatcgatgagtagataatgtgggcaaaaatagaggcatcagttacctctactattaaactcgctctttagcgtccttgttggacagcttcaacctgtggtattgattagggataagtgcctttgggctgcattaggagtttaggtgggacctcgtcaaagaacttatcaagtggtatacaatttgcaactctttaattatgatcacaatgtatttcaaactcataatgtgtgaaagctccttatacccacccactcaaggtccttgtttgttttcattgaattaattgtgtctaccctgtattttgttcccctaattgtatgatcctgatgtatagcgcatttagaaaattatatctaacatcttaccacgtctccagttaccattataagttaacagcggatatagatttatgttatcgtgctaatttatgtgtcctcatgtgacaccatggaagtgcttgtatattattagttcgctacacgtgtgttgcgtatgtattgcattataagtagaacatgtaagcgctgttattctagcattattgaataatttttatgcataatttaatccctttactcttattcctgaatccatcttttgttgtttccagatttggactttctgttccacatgttttttcttgcacgatactgcaagcttcttgaggagaactcattcagaggaagaactgctgactttttctacatgctcttgtttggcgctactgtcctgactggcattgttctgattggtgggatgataccttatatttctgagacatttgccagaatcctgttcttgagcaattcattgacatttatgatggtacgagattagtacaagcattatacttggtttttggttttctacaccatcgttaggggtgcaggacaaatcttagggattttctgggctctgaaaatagtcttcttgggtgcatacttagaagttgagttttagtaattcctctcgtatggacctgcaggtttatgtatggagcaagcacaatcccttcattcatatgagcttcttgggtttgttcacctttactgctgcttatttaccttgggtaagtatttttagtttcctttccatgtaccacaacatgactacatgactaatgcacacttgattctcatcttaagttaacttcctagagcctcttcatataatcatttttttcatgcctgaatgttaaatcacacgatttgaaatctgtaattgatttcatatgttttatgcaatagaattatttaaaacctcttcaatttcaatatttttctttgtttgtagagcaaaatatatgtttgattttttcccctattagccaagagcccaaaagcaaaccattttttttcccaacagttgtccatttgtcctaagcattacccaacaaatgcttttctgttggtttgttttgtgatgaatgctctcactatttcacaacatgaagtagtagtaactttatgttttggtgcaagaatggtctatttagtgtgtaaaaacgtcacaggaacttggtgtaaaatgctagacctttcctttaccatggagccaatttgttgttccagtaggtctaggttcatcttaaaaatgaatgctccctccatttcaaattacttgtcgttctagctttgccactagtcaaacatttctatttttcaccatccatttttggaaattcgtgtaggttaacatgcaatatatattatggaagtatttctcatggtgaatctaaaaacataaaccttatgatgttaaactatatgaatttctacaagttgatgttcatataaacatttgatttaggacaaagctagaacggcaagcaatttgaaatgaggggagtacctcactagagtgggaataaatttctgtattcagtactgtgtgataaagtaaaatggggaattagcaaatgtaaatgtgctctctttacagaatgccttttggatttgctaagccttcaacataaactggctgtgacaatgtacgctgaaaaggttttgtcaaccaactcctggacatccttttgcatcgcgcacatatttcattgtcagaatgtattattacaaagtagagaaacagaaactctagtggctctgatcttgtttttgctttgtagtgatccttgattttactttttcacctgatatcacacagatgaaatttcactgaaattgttcaaagtttattcaactttatatcagagatgagaaacagctgcgtgaattgttctcttttaaattgcaggtccttctggggttctctattcttgtgggaagcagtacatgggttgatttgctggtatgtttcttatcgttatgatgaatatcataatagcactgtgattttttagtgtctgtgctgccaatgctgcagttaaagaatgccttgtagaattgcaagctcagtatggtcaacggttatttcttctatcatggttttgtatgaatattgtttgtttcgttttccatgagctacaagcctgtgactggtttttattggtcatcttgctgtccaacttttatttggcattgcttatttgcaagtgtgacataagcctgtgttaaaagcttgttccattgtttttgaatgcctgaacctgggctctattttgcattttctacccagcttgccaatagatgtttctgggttagtgagctataacctgatgtaggtttaactagctacattgagatggtactagctattttcaatggttaaccttggtgttgaagtatggaagctgaaaactttattttcaacatgttagcatatttttaacagaaataagctattggtctttttgctgtctatgtgtgacgatgctggtagacatagcagcatgtattaatggtaacttggtaatggagtgctggctggctcgtgtcttctctgactggtttgtatttgccaatatcatgaacttaaaatggatcttatttgcttgtttgtattaacagagactttttcctcagagataatttatgcctgtgtactctcctgaccatcattttcatgcatctgtatttttttaatgaattattagccatgtccttattcggtatgaatgcctgatgtattgactgaattaaaattgtcaatatgctgttttcttcttggaccatatctgtaattgacaaatattgtttctttcagggtatgattgctgggcatgtgtactacttcctggaagatgtatacccgcggatgactgggaggcgtcccctgaagactccttcgttcatcaaggcgctatttgctgatgacaatgttgttgtggcaaggccacccaatgctgggcttggcgctggagcaaggtttggtgctatgggtgcagacccccaggcccaatgatcaattgccattcgaaggcagttactgattcgagagttcttttttttttttcatctgttcaaattgcgaaattgtacaagcaatgttcccgtgtatttatacaggctatagatcagagaattattgtgcataagaaagcatttagtagtatctggggcagctaaatttcttaactggacacgaagggtgaaggaaatggtttacgagtttcaaccggctggacaatgccgccatccttggttgcagaaactgatcctttttgcgacgattgacatctgaccgggatacttttcaatgtggtagtctattggtaacgataactgtatcaatcgttgtgatgtttgtccttgcgatttatggtatcagaaatgttagaatgttttatatactgtttgggtttgaagaatattggtcgaagatgaccctcgaaatgtacagctatccgtcaaagtatttttttttaaaaaaaaaacatgagtggataaaataagttacgtgcaatgatattcataacaaaatattgcaagtacatgcgagtaatgattcttgcaaattacatagaaagctattaatgtaaaatatcacgtgtacatgataatattgattgctaggagatattagctgttggatatatattacaaaagacacccactagttaccaaatcgtccccaaatacatttcaccgatttgacttgaatacaacagatcaattttacttgaatgcaa

SEQ ID NO: 12736 - DNA, 11710 bp, Oryza sativa
  unsure (1)..(11710): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatctgatcgatcgatgtctgcatgctgttggtcgatcgatgagctgaggtagcagaaggaggcagctgctgggagcaatggagcccacggccggccatggatcacagttgttactcgatcgatcctacagtaaattagtagctagctgcaatgcaatactagtaaggtaggtcgattgatcgatggatcgatggagatcggatgatggatcgggattggcgcctggcttttgtgttttgctagtactgcatcatctgtatcatgtacagtctcatgcatgcagcagccaaagcaatgaagctgcgaaaagcagcagcgtatgctgttattatcagcagcagcatcagcttgagctgccatgattccgacacgtgggccacgcatccaccgtacacgcccgctcgcatccatcatccatgccctgggtagggttggtgggcccctacgtacgcctcggaagacgtgccaagcgagacaatggtcagtcgtctctcttgtagtcttgctgtactgtcagtcttctctcttgtttggtaatacctctggttgcttcttacactggcattattattaacctactatgcactacttcatccattcgcatatatatgtatttttatcatagaggggtatatattccggttgtatatacacactcttatgcgagtaattaattagggcagatagttaactatacagagagagtgactgcgcgcgtatatatatatatatatatatatatatatatatatatatatatatatatatatatatatatatatatatatatatatatatattgctcaatcgaaagcgactgacgggcacgccctctgatctccggccggccgaccagccactcatcctctctcgatcattactgctctgctcgcagcatcacactttgcttaactgtattattattatcgtttcccgtcctcatcatcatgtccatttatttatgtagctgcagtttcatttctctcactcactttttgtcaagttaattactaccgtaaagcaattaattggggactctatttacctagtttttctatatatatactccctccgtacttaaaaaaaaagaagtcattttgaacagcttcacggtctccaaaacacaactttaacttcttatttctataaaaatatttattggaaagtgatatatgtattcttttatggaagtatttttcaagacaaatctattcatataatttttacattttcaaactcaacaacttgagagttattaatgatttatattttaaaggtttgacttaaacattgtcctaaacgagtttctttacgagtacggagagagtataagactctgatattaattgccttgcgtgtatcatataaaaaagcaagaggaaaagctaggtgtatatatatagcaaactctaccgtccaaacagtgaaacaaacgatgtaaagttttgaaattaatcagtctcgagtatgtaagtagtgctagagaaccttcaaacacgtaggagtacatatataaggccaaatcaatcgatctagctagtgacgtagtagtagtaaattaataagttctaaacactactcattacgtaggagtacaacatctgcaggtactattatattgtacgttgtgttggattggtgaaatcatcgaatactttatatgtatatatatacagtacgtactaagtttttttcgcgaacgccatatacgtacatgtatatactgcacatatatgtgcgtagtacgcatctctgaccctgagtacgtacgtactcagttagcatttactagtaattttattttatttatttaattatgaattaagacagtactacccgattataattgaaggaatcgatggtacaggatcggagttaagtgccgggtgtcataacaaccctctatgtgccgtgatcaaatcctcgatcggcagatcgatcgatgtgctactagtaatacactgagcatatagtgtggctaattaatagtgtatatttatatagaaaaaaaacttgcacatatatatatatatatatatatatatatatatatatatatatatatatatatatatttgtgattatttatatattgcgcagctaataattaataaattaattaaagctcgatcggtagcctcaagaaagtaatggatggtacggtggtgcagatggttaagtaacagatgatagtatcgatcgaaaataagctggagtgcagatcgatggcaaacaagatgcaatgcaagcaaggtagcccggccggttgcaacaagaacaacaacaagaagaagaagaagcagcagcagcaaacaaaaaggaaggagaaaaatgaaggtatagtagtaataaattaagtaagaaattaacctgggaggtgagcgtcttgacggggtccctgcaggtgggcgtgtcgtccccggcgccggcgccggcgcgcggcgtgtcctggcggcggccgccatcttcctgcttgacgcaggcgatgcaggccagcatcgtctcgagcgcgctagctagctagctgtatgtgtgtgcaggcctatagcctagctagctaggtagctctcgctcgatcgatctctctcgactcgacctctctcgctcgccggccggccggctactagtgtactagtgagtgtatatatacaagggaggcgaggtgaggtgcaagtgcaaggccggcgtgctatatactccctgtaggagctagcttagcttgctttaggttaggttgtcttgtgagagagttaaagcacagcgcatgcgcgcgcgcagctggagaaaggagtgcgcgtcgtcccctcccctggaactggacctggatattcatttatcgctacttaatctagtaattaagtttgtactcctagctactcactgctgtactatttcctccgtcctataatatagcaacttatacaattaaataaaaaattttaccgtacaataaatctgggtaaaaaagtgttaagatttattgtactgtaaaatatttcattcaatatcaaattgttatactatgcgacggaaggaggagccggcgtaggagtagctagcagagtgatagctaaggttactcgagctgcaagcgtggccggccatcgccattcgccagcgatgcaacgcaagcccattcgtcctattcaaaattatcataatcttaattaatttaccgcgtgtcccgctcttaactctgtcccgctcttaattaatttaccgcgtgataactattaactctgtcctgctcttctctctgctccacggactctgcttttctactttcttctttttcttttcatttcttttcttatctcttctcttcttctgtagactgtatgtatgtactactatatttctttatccatcaaatttctatataagttatcgctagggattacccctgtctcgctgcacaagaatcctctgctctgaattatatccagctccatcaataatttgcattttgtctatctatattaacgttgttgtttctagtgttggcctttgtataaacatccttgattaaaaaaaagagagcatcgattgattctctagttttgtaagtgctccaaagtaatctcagttcagacttgaaaaacctctacagattagctatgaattgaacaagtattagtggcagtgccatagatgttattattacacacactcaaaacacaggtgcatggctattatgatgatggatcatatactctagtacctagtcaatttcacttcatttcaatgcagaaattagggggcgttttatctgtaatgaagggcccaccattgcttaatgatcaggtgctatgtgtcagccatacatcaatgttaacgctctcactgcagcataagaaaccaattaggccactctgtcaagtgtcaacacgatctccataacaaactttaaccacaagatcgaaattaagggctagtgccggaatgttcgcctgtccgggccacacacgaatcacgaatgctcgtgtttttctttttccgccacatcattaatttcctcgatcttcttgtaagttaatgcactgaaagttcgattttatagattcaattcatccatagccaatctaatagctcattcatacaatagttacatactacactattaatacctggtcccacctgtcatacaaacactgtgtctttgagtccatgctacagctggctataaatctgtagcccgctgctcttctctctccttatttatctccttaaaatatgtttgcagctggcttatagcttgctattgtacctgctctaatactgattggatttaaataattttatatagaatgattctatattaaaaagcttatagtataaaattattatgtaaaaacgtttcagggcaaagggtcagaaacatgtaggccaagccgaatgtgtttgcatacatctagaccgtgcgtggacgttctcccattaggcctatatatccaacagataaagaagaatattcaaattaatgttatcttggtgcgcgtatattttatgagatactcccatccgcctcatgaaaaacgaatatagtaccgaatgagacacatcatagtactacaaatctggatagatatataactagattcgtggtctatatctgatactaggttggttttttataggacggaggaaataatagacaagttgtctataatataaaatacaataacccaatatgaaatggtagtagtatatattaaaaaaaaagagattttctaatgaggagatggagcggctattgaggaacagcatgcatggtcggagagagagacagtaatccgagcacttataattactcgtgtgcgcacagtagataggcctctgcatcacgctatgatttgttttgagtggagcgtgtgcagcggcagcggcagcagctagctttgcacttgcacttgccattgatgaatatgcctaggttgcatggcaggcatccatcgagtgtttgatgttcttttagtacgattgatcggacattagctgcatcattactgatgcacgtaggccatttcacaccgagtgcatatgcaatatattgcatgcgcatgcacctccttttctaatcgtggatctgttgtttgtaatagttggtaaatactccctccatccctaaatatttaacaccgttgaattttttaaacatgtttgatcgttcgtcttattaaaaactcttttgaaatatgtaaaactatatgtatacataaaagtatatatttaacaatgaatcaaatgataggaatataattaataattacttaaattttttaaaaaagacgaatggtccaacatgtttaaaaaagttaatggcgtcaaatatttagggacggagagtttatgtacccaacacctgaggcctgtgcaacgtcccgcctctcgcagaccggcctgggcccgcttacatctggcaactttcataggccatagactgccctcacagaccaacacaagtcttttctgcaaccaagcacgcttaacctatgttctttcgagatcggcttctgaaaaagaagttacaaattgttgatatgagtatcctatcaatcctattaagccctgggcggagatgttacaacctagtacatttggtactagatccgttatctacttggtatatattacatctaatacacaccttatattatgccattattatgtaacgacacgacgaactataatgcccttttatataacctgaaaatataattctcgacacaaatacttgtcggcctagttataaaatcttgaagctctgctagtggttagcacttacagtataaatcgattcacggttttatcgggcgttgacaattgaggtcaggttagaaaggaacgctcgtgtccataagggcggcgaacacgggggttgatcgaatcatgtaagaaaggggaagctttgggttggtgcggtttaaaaataacacagatgaggtgagcgacgcagtttggtggcgcggcggagatttcgcctagcattcgacggagcggaagagaaaaagcaggcatgaagatgggaacatacaggggatcagacggtttggttgtggggtccgcaaagcgtattttttattcggaagcgcgcaggcacatgcagctagcgctggcgacagaatggtcgctcgcttccttctctcttcaattctctttcttccacgtaggatttagataatataaaatgttttggagcatgctgagtcagcttattgtacatgctcttagagcacccgcaatggtaaagtaaggtgctatctataaaacatgtacacctcaacaatagactagattaatagtaaaccatttcaatggtatgtctacatgggtatctatagctctctaatccattgcctcttttttctctatagactatctccatgttagtagatagctttgctctctctctcttcatttaatctcttccaattaggaaaacaagcatagtggcccgcgcagattgcgcggctagcatcattatattttctctcatataatagcatatatgttttctcattatattattcaaatatattaaaatgacaacataattttaaattttgcaataactttacaaaactactaatgtgtaatatttatattatattttatatacgtgttagttattaattatttttaatatcaaattttagttatttgtaaattatatatattcctatatggactctagactcgtcttttaatatttctttttttaattcatttttatttatgaatttttattatttctaattgtatttctatgtggactctaaactcatctttcaatattctttaatttttaatttcgaatttcagttgcttctaaattatattccaatatttgtattcctatattgaccttaaattcttcttccaatgtttttcttaattttgaattttagttatttgtaaattgtatttttatacagactctaaactctacttttaattttattatgtttattccaaattttagttagttttaaattcctatatggactctatactctacttctaatattccttatttttttaattccgaatttctatttttttttctaaattgtatttctatatatactctatactttacttctaatattccttatttttaattccgaatttatattatttcctaattgtatttctatatgtactctatactctacttctaatattccttatttttaattccgaatttcagttatttcctaattgtatttctatatgaactctatactctacttctcatatttctttttttttaattctgaatttcagttatttcctaattgtatttctatatggactctagtctcctcttctaatattcctttttttcattccgaatttcagttatttcctaattgtatttctatatagacggactctagtctcctcttctaatattcctttttttaattctgaatttcaactatttctaaattgtatttctatatggactctagtctcctcttctaatattccttattttttaattccgaatttcagctatttttaaattgtatttctatatggactctgtcttttctttttctccgattaatgtgagaatttctaggccatgagagcgaacttggaggttcctttttctattcctttaattatatatttaattccaaatttctttgtaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtgaaggctcctttttctattcctttaattatataatagatatgctgacatggatctcttgtagagagcttatagataaccattgtgggtgcccttagcctgtgtttggcaccctttttcccaacctcactccctcgatttttacgcgcacgcttttcaatctgctaaacggtgcgttttttgcaaaaaaaaatatttttatatgaaagttacttttaaaaaaatcaaattaatctttttttttaaaaaaatagctaatacttaattaatcaagcgctaatagaccactctattttctgtgattactgttccggatgggtaagtacaaggatgcccgaacacagccttagtctcctaggagtttttcctgatgcttagacataagctctttctccttttgtttacttgttgtttccaggagtgcaatatgattgtctttcaatctagcgtattcttcctttcctctgtaatccccataatctgcgtcagcagttgtaagatatagatatataataaatatcgatccccaaggcttttgtgaaaaaaaaagagggtgaggcctgcgagcaggacatggcgcggttagtcagcagtggcaggttggtcgatcggcgggtgggtcgactgctgaagcggcaggcaacagctgatacggatggtcggatatggaggaggaggacgagacagttcgtttgtggttgggtcgacgacggtgcggccaagccacaccgatggatcgatcgcggagtaggagtaggagtgtagcagtagcagagacagatagatggtcgatgtgcgacatgcagcaagcaaagcagggtagtactactggtctgtactcctatgtagtacgatgaacatgcaatattgcagcttgggttgtgggttgcatgcatgcttgttccttccttccacgacacaatcatgctgaggaatctctctcactttctctcttcgtcttcgctcgatcgctcgctagctccggccggccggcacaggtgtgatcgatgatgccatgccagttcatccaccatcgatcccctccccggcgacgcacgcaccaaaacacccaatgcattgcattgcaacacgcacgcccggcctctctgcctcatcctgctactatacttgtactacggagtactactctactaggaggaactagctaccaagtagtactaggctgcaggatggctggcttggccggccagtaggaggcagccatggcttgctcactgctgcatgcctacccatcgtactagctagactgtagccgctccaacacttaggccatactatcgccctcattgtttggcttatttgtaaaataaaccaaacagcatatttgtaaatgagaagtaattcgttaataaaacttttatatacgtgttattagcgacctaaaagtaaaggctaaaaaataaactttgatgaaaaaaccctcaaaatcagcttcaaatttaaagttgaaaattcaaattttgactgataagcataagcgaaaagatgaggccgtatatattgccagcggtctcaaaccttcactttggaggcgacggaacgcccgtggtagggggaccatggtgtggcttatcatgctcgcagaggtcacggttacctcaacgcgctttagcttgggaggtgccaaaatatagtggtattttcaaaacacaaaacaaaacatattatcaaaatattttaatattagatttaataaaaactgatttgatatttcagatattcctaaattttttttatgagtttaatcaaacttaataaagtttgataaaaaaaatcaaacgaattttaatataaaacggagggagtattacacgatgcagccagtagtacgaacttgctttgcttgcagttgcagcctactgccactgatttgccgggctgcagtatgcattgcgtgcccggctatggctgcctgcattgtaccacggctttctaggaccacccggccggccggatacgcctctacctctacagtacatacttcacgccgtcccatgcatgcctttaatttgcctttgatcgattcgatttgatagaatctagttcgtcctaccagaaaccagaacacggcagacgcatgcaacaggacacgatcgatcgatgacatactactactggccgattcagtggagtatacgtactgtctaatcttgtaatatactcgctccgttttaggttataagatgttttgattttgtcaaaatcaaactgcttcaagtttgatgaaatttatagaaaaaatatatttttgacccaagataaatttcttaaaaaactagaaaaaaaatacccgtgcgttgcaatgggtgaagtctattttaatctgttgtatggtttagttaagatgaaatttatcgcggggagttcgcttggatatatatttttttagaaaattatgagttacagttagaagtctaatcgtctcgagttagcatgtgagtttttttaaacagatttcttatatgattccttcagtattaccaaaagtgaacgatcttaaaaaccaactcaaatataaatatgtatttccaaaagcaagcgaacttaaaaaccgactcatacacggatgacgttgacggagctcgtggcccctcaccgggagactgcgcaagcccccctttgccggttcgaccaggggcttagggtgcaatcccaagctctctcactctctctgtctgtggaaagatcactcgcccgcaagacacacgagacacggcgatgtatacaggttcgggccgctgcgaagcgtaataccctactcctgtgtttttgtggatttgtgtatgaatgagctacaaagtgtgagtcgacttctcccccgttctcagctctcaatctggaaaagaatcaaccaaccacttctctatgggcaaggtcctccttttatacttcaaggggataccacatgcacccttccctttccaaactggacttttcttctctttatggacggagattggtatgattgctgtccgaatgacactccgatgggacagcccacacctacctccactcccggcggagacaggcgcaacgtgggatcgtggctgcccgtagctgacgcgaccagtgccagaccggtcattcttgtccaccacgcgtcagcttaacaacatgcatgttcgcccttctttgtgtaacaccttgcctgtaatggttaggatgaagcctggtataaat

SEQ ID NO: 12737 - DNA, 2480 bp, Oryza sativa
tatctctaagagaaacaccctagctccggcttgagacgagtgcctagaggctttctttttgacgggacggggcaaagcgtgcgtcagcccgtcagtcgccacctaacccgtgatctgaccggtctgtgactggtcacagaccggataaaggaacgcgctgtgctgcgttgcatgcagcgtgacacgcttgaccagactgcaataaatgctgttaggtgagcacagctgtgctcacttatcccatatatgtggcgcagacgtccttaaggggtcggggtgcctcggccctcggggccggggcaagcgcaacccgaccccccctcgggggagatcaggaggagggcggacacctcaccctcgggcccgacgtccccgaaggtgccaggccacgtgggcgattgcgtctgcctcaagcctctggccatgatactcccggtcccatatcaccgacagtagcccccggcgttatgccagagcaatttcccttcccaagggaagcggtcaggtgtgacgccacccctaaagcctggtgacaggtgggaccggtttccgtagctgggcaaaatacccaacggtctcaatccatgcacattggtattgataactttggttgtccataatgggcggtctattcaagactgccacaccacttgagcagcgcgcgaatctgggtgagcagatctgtctcgcccggagatacggtaacgccgcttcggtcggcgagcgtaattaacgcgcgcacgatacaatccatttcgattgccacaaccgcatatccacttcacgcgccgtaagcgggcgaatgggattagtggaaacgtgggcacgagaaacgagggagcgagatagcgagatacgagggagcgagatagtgggcgcgagaaacgaggagccaggcccagcgatggcaagggtataaaagcatcgagaaaaggatttgctcccttccttttgccattgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgaacgagaggcacgccggactgccgcgccgcttcatgccggagtccgccaccggtcgggagatagtgatgctgggcgaggggcgcccggcaccagactacccggggcggtccatcttcttcctccccttcgcgatggctgggctggtcccgccattttctcatttcttcatggatgtcctggagttctacgatctccagatggcgcacctcacccccaatgcggtgatgacattggccatcttcgcgcacctgtgcgagatgttcattggggtgcgcccctctcttcagctgttccggtggtttttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgacggtagatctgggggaggactacgacgccgtcctcgaccgcctggctggcctgcgatcccaggggctcaccggggccatggtgtacggcgattacctccgtcgccggaatggcccggttcaaagaaggggccggaaggggcttgggagtacactgggcctgaaaattacgtgcgggcccaccagggagccagatgggattgggctcccgaggacttcaagatcgtggtccaaagggtgctgaatcttagctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagctgggaggaacacctcccccatctcctccccgagggggcggggcggcgcgtgccacagtcggcgcccggagggggccgcgccgacgtcgcagcccgagggggagcgcaagaagaaacggctccgcaaaacgggggagacggaaccatgccggggaaacctgatttcccctccaaggtggtcattcaaccgaccccctcgcaggttcgtctcactctcattgcaaccatctttctcccaaaaagaagttttttcttactcattttgttcgtcttctggttttttcttctgtttcagcgatgtcccgtcgcattcctcccgtcactccaagtccggccagtccgaggccgaggatccagcggcc

SEQ ID NO: 12738 - DNA, 10997 bp, Oryza sativa
tgctggatgggttcaacgcccaagtggaggccctgcgtgcggaacgagcggagctcgaggccgcatgggcgcgtgttgaggaggggcggcgctcggtggacgccatggtggaggtgggccgtaaggctcaccgccgtcatgtctcggagcttgaagcccggaaagcggcgctggcagagatcgcccgtgaggtggaggaggagcgggcggccgccctcatcgccaccaccgcgatgatcgaggcgcaagacaccctccgccttcagcacgcaagctgggaggcggagctgaagaaaaagctcgacgccgcccaaggggtccttgactccgccgctgcccgagagcggcgggtaacggagactgaagcggcgtctcggcggcgcgaggaggctcttgaggcccgtgccatggcgctggaagaacacgccggcgccgtggagaggggcttgacggaccgcgaggccgccgctgttctccgggaggcgacgctggcggcgcacgaggccgcctgcgccgaggaggagtgcacgctccgcctccgcgaggacgcactcgctgagcgggagcgagctctcgaggaggctgaggccacgaccaaacggctggcggacagcctgtccctccgcgaggcagcgcaggaggagcaggcgctccgcaatctggaatgcgtccgcgccgagagagccgcactggagcagcgggctgccgacctcgaggcgcgggaaaaagagctggacgcaagggcgcgcgtcggtggggcggctgcgggcgaaagcgacttagccgctcgcctcgcggctgccgaacacaccgtcgctgacatgcagcgcgcactagattcctccatcggggaggccgaggccctccgcttggcgggcgagatggggcccgacatgctttgggactcggtctcccgcatggatcgcgccggtcggcaagcgggcctctggaaaggccagacgaggatgcgccccgccaacctggaaggcctcgctccgcacctcaacaggatggcctgggtcctcgaacaactccccgaggagctcgagaagaccattaagtcatccttgagggacctcgcccggggggcggtcgaactcgtgctagcgagttaccaggcccgggaccccaacttctccccatggatggcgctggaggagttccctcccgggaccgaggacgatgcacgcgcgcgcgtccgggatgccgccgaccacatcgtcaacggcttcgagggctcggcccctcggctcgcgttcgcccccagctccgacgaggagggcgatgccagcggtgaggacgatggtggcgacgaggccggcgacccgggcgcgtcagaatgagcccccaggcccccgccaatcttttttctttttctttcttctaaggccttcatgcctcttttttgtacaaattaacttaatctgcaatcagaaatgatgaaaaaaaatttttgtgttagttttattttgctatacatacgagatgaggatgatctgtgccatggtccttttgcgccttagcttgaaataagggcccgtgcccaagtcccagtcctcgaatggctcgggtcgggctagtgcctggggagatccacatgtcgagactggccaggccgggaacgtggtgaccgaggggtatgggtgacccgattgtgggtttttgccgattcccccccggagttcaccacgccccggggcacggctcggttctgggccccggttggcgattttagctgaccgaaccgagcccccgagggcaaggttgagcacgaatgactttatctcaagttaagattcttcagaaggaaaaacggcacagacacaacctttaggaaattgaaaacgtttttattgaaatgctgaaatgaaggaaaaaggaatatatgtgcatgtgtggtagcccccggccgatcctgcacacccgaggggggtgcggggttggcccgagccagaacctgacacccgacccccccttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccactggcaactcctcgatccatgaatcgccgtgcttcttgagaatgttgaaggtcttggttttgaggcctttaaggatttctgcattggcgcgctccacttggccattgctcctggggtgggcaggtgaggcgaagcagagcttgatgcccatgtcttcgcagtagtcgccgaagagttcactagtgaattgggtgccattatccgtaataatacggttaggcaccccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgacctgcagggcctgggccggctgatggatttgcctggcgtggaactgacacgctctgcatcgccggaccagatcgactgcatcattgagagctgtcggccaataaaatccttgacgaaaggccttgccaaccagggtacgcgaggcggaatgggctccgcactcgccctcatggatgtcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtatgtttggatctcagagatccaagcaatcaatctaagggagcttggagcgctcccttcaggtcccgaggcctggactccgacgggcctcgggggccggtcaggcgcatccgtctcccctaaggggtcgggtcgcgccgacggctgggtaagcctttcttcaaaggcgcccggtggggtctgggttcgcgaggatgcgagccgtgagagttcgtcggctatcatgttatcccgtctgggcacatgccgaagctctatcccgtcaaaatggcgctccatacgccgtacttggcgcacgtaggcgtccatctgcgggtcagagcaccggtactccttacagacttggttaacaaccagctgagagtcgcctaacaccaggaggcggcggatccccagcccggctgccaccctgagtccggcaaggagtccctcgtactctgccatattattagtcgctcgaaagtcgagacggaccaagtatctgaggacgtctccgtttggagaggtcaacgtaacccctgcaccggcgccctgaagagacaaagaaccgtcgaattgcatcacccagtgggcggcgtgaggcagctgtgaggggtccgcgctggcctcggggattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtaaacaggccgctgcacctttcggcggggccgatcctcttcgctaggggccgtatccccggggtgctcttcgtccaagtggcccctcggggcacactcgtcttctgtgccgatgacctcggggtcggaggacgacaggagcggccttcccacagtggcctcggggccgtcctgggggtcgggggctcctggcgtcgtcagacaagcgagcaaagggccagctccggtcgtcaggggcctcaggcctccgttcgactcgggggcctcttctccctgctctctcccgggtcgaatcagcacagggttagcctcggggccaaagggcgataagtgcggccttccctcagtggcctcggggccttcctgagggtcgggggcactcagcaccgtttgacaagcgggcagagggccgactccggtcgtcaggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgccgctaagtaaagtagcaggggctcatttggctccggggcgactagaaccgggggagagctgagatatgcctttaactgagtaagggcatgttcagcttcctccgtccaagtgaacggccccgaacgcttgaggagcttaaataagggaagcgccttctctcccagcctcgatatgaaacgacttagggcggccatgcaaccagtgacgcactgcacatccctaagtttgctgggggggcggatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctaaaagtaaagtttcttggttgcgcgtttttacaaccaagtcatcgacataagcctcaacattacgtcctatttggctacccaaagaaattcgagtagttcgttgaaaagtaggacctgcattctttaacccgaagggcattgatgtataacaataggttcctacaggggtaatgaacgcagttttttcctcatcctccctagccatgcggatctgatggtaaccagagtatgcatctagaaaacacaaaaggtcgcaccccgcagtggagtcgactatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgtatgtggcaatccgctgcctcggggcggtgggggcagaggggccaagcctctcgtcaccaccctcgggcttggacgcagcagcgaggcggtcggtgcgctgctccatgcaagcgagcgcgactttaagatcgccatggacagagatggggccaccggggcccggcatcttcatctggaggtaggcgtagtggaccgccgccatgaacttcaccaacgctggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgataatcggttgggacggtcggagcaccatccccggggccttgatggcatcaaaagccacgggggaaaggatgttgagggccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgagtaggggccatggccagagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccgggaacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtgacaagttcatcagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccagccgggggcacggagggctgatcctcacgtccatgtcgaggtgacactctggacgaggaggcgccctccgttgcacggggagtacgccggctattacgccggcgctcgatgttgaggcgggcatccggctccccatgctgatcctcccgagtcgaaggtgtcgacgagggagtggtagccgaatgccgtgcagccgccgccgctcgccgcgccctccgccttgatgacacggaaccggtggtagcggcgccggaagtcttggtggcggcggaccgtccaccagcacccaggcgctgctgggccgtcacgaccaagttggccacgtcgtccagccatcgctgagctggagactcagggtcatggacgacgggtgggtgacgtaggagcgcgctagcagcctgaagcgcgccctgaggcgtgctgccgtcgccgtagacgaggaggcaacgctccccatctcgccgttctcctgcatcacccgcaaccggtgacgctgcggatttaccaaccctctcgagcgcctccccctgcttaggactttggtgtggaggcgggggagtacgagctcgacggcgtgggtttggctccccgtcgtcgccgctcacactcggagagaggtcgtgcgcctttgcttgctcggccattaggcagaacaagaaaaacttggcgcacacggaagagtctgagagctcagaaaacacacgctgagccccctacctggcgcgccagatgacggagctcgtggcccctcaccgggagactgcgcaagcccccctttgccggttcgaccaggggcttagggtgcaatcccaagctctctcactctctctgtctgtggaaagatcactcgcccgcaagacacacgagacacggcgatgtatacaggttcgggccgctgcgaagcgtaataccctactcctgtgtttttgtggatttgtgtatgaatgagctacaaagtgtgagtcgacttctcccccgttctcagctctcaatctggaaaagaatcaaccaaccacttctctatgggcaaggtcctccttttatacttcaaggggataccacatgcacccttccctttccaaactggacttttcttctctttatggacggagattggtatgattgctgtccgaatgacactccgatgggacagcccacacctacctccactcccggcggagacaggcgcaacgtgggatcgtggctgcccgtagctgacgcgaccagtgccagaccggtcattcttgtccaccacgcgtcagcttacaacatgcatgttcgcccttctttgtgtaacaccttgcctgtaatggttaggatgaagcctggtataaatctgaccagggctaacgtgttatctctaagagataacacgctagctccggcttgagacgagtgcctagaggctttcgtcttgacgggacggggcaaagcgtgcgtcagcccgtcagtcgccacctaacccgtgatctgaccggtctgtgactggtcacagaccggataaaggaacgcgctgtgctgcgttgcatgcagcgtgacacgcttgaccagactgcaataaatgctgttaggtgagcacagctgtgctcacttatcccatatatgtggcgcagacgtccttaaggggtcggggtgcctcggccctaggggccggggcaagcgcaacccgaccccccctcgggggagatcaggaggagggcggacacctcaccctcgggcccgacgtccccgaaggtgccaggccacgtgggcgattgcgtctgcctcaagcctctggccatgatactcccggtcccatatcaccgacagacgtactaaaatactgacaaaaacatattcaatttttataatagtagagaagatatatatttataattaaactaattcggtaatataaatattattattaacttagctaaatttgaagcagtttgacttttactaaaatccaagacatgttataacctgaaacggagagagtaatatggggtatatcgttttgcatgttgtcccgcgccctacctagcttaatagaagtagcttccaacgaaacaaacttttttatttttgtctcttatctattgtgcctatcgccatctggtcaatgatctcatgccagcactgtagggcgtgttttaattgctatatgcatcgagtccagctcgcgcgcgcgtgctggtgagtttctccacaggacgtacgtcgtcgtgtcatggtcccgcttgagcaaaacagcctccgatcgcctcaccggcaccgcccgtcgttggccggccttctcctcactagctcactgctcgttgcctagtgagatgggaacaagggaggaagagagagagagagatgaataggccttgacatgtgggacccatgctgactgtcggctggctgcctctggctccaacccctcggcacgccgccgccaacgccaccccgccggagagaacgaggaggacgacgcaggcgtagttggccatggcagcaacactacaaactcaccacttctctttgctactgtcacaaatggacgaacacctacgagagctctgaagttaattggctgcggcagtgatcggatgattggatgatccgtctatgtcgtgacctccccggccgggggaggaggatgtgcggcggtggtgcggtatgtgatcgccgcgccgcctcctcgccgtcgcgtggatgtggtggtgccgattaatcccctcccctcccccgccgttgactctctgtcgtgccgggagaggggagaggggagagaggaggaggaagatgaagaggagtggaaatgtcatgtggggcccacgtggacccaccattttttattaatttgggtgtgaaactgacagttgggtctcactgggtttattatttttcgaatcgaattgtcacgtaaacgttatatcaatgccagttagatgaagaccgccacgtcagccaaaaccgctaagggatttcatctacactagtttaacagttgacagatccgttgtatctagtttttcggttgaaggacggaaatcgaattcgttgacaagttaatggacctcacatgaacttatcatgcgagcgacattcccgctccagcataataggccgcacgtacatcacaattacggtcgaccggcccatatatatacagcataagccgcacgtacagttcgaatacatccgatacaccggtgcgctttacgtatttacgtcattcattttgtcgttgctcgtgtacgttcctgaacttagagcttgtaatcagtgttgattgagctcaattattgtaacctttttattatcgcaggctataaaacctgggctagccgatgaataaagtatcgaagaaagaatatacctagtcttcttcgcttttacttactttacaaccttaattaattttccccacaattttctttcgaaaaagctagataccggtatcccgttctcaacacccgtgatggtatcgtcttcttatttgtcccagagcactaagcggggcagcagagcaacacaatggca

SEQ ID NO: 12739 - DNA, 33152 bp, Oryza sativa
acctttttattatcgcaggctataaaacctgggctagcggatgaataaagtatcgaagaaagaatatacctagtcttcttcgcttttacttactttacaaccttaatgaattttccccacaattttctttcgaaaaagctagataccggtatcccgttctcaacacccgtgatggtatcgtcttcttatttgtcccagagcactaagcggggcagcagagcaacacaatggcagcatgcggtagtgaaggaagaagggggcttgctaagcggagagagagagagagagagagaggagctcatcggagaaggcccccgctgcctcgcctcgcctcacctcgccgctccgtcagggagcaaatcgccggagaagaggaaggggctctctccgatgtgtggcgtggatgacgaagacgtggccgccggcgacgagctccgacgtggcgtggacgatggaggatgcggccgctagcgacgagctccggcgtggagcgtggatgacggatgacgcgggcgccagcgatgagctccgacgtggcgtggacggtggaggatgcggccgccggcgacgagcttcggcgtggggcttggatgatggaggacgctgacaccggcgacgagctccgacgtggcgtggatggtggaggatgtggccgctggcgacgagctccgacgtggacggtgggatcaccggcgacgatgctttggtgcccggctcctgattcctcgcaagtatcacctaatacgtggtaggaatagaaatatcacctaatacgtagtaggaatcgcacaggtatcacctgatacttgacaggtatcatatgatacttcgcgagtatcacctgatacgtaataggaatcgtctgataccttataggtatcacatgatacctcacaagtatcacatgataccggttagatatcaagacatgatacctcagaggtatcagaacctcatacctaaccggtatcatctcgtcacaacgggattccgttgtatagcagccctcttttcttttgggtgagtgatgaatgggacccacatatatgtttttaattctaataccacctaagcgccatatcaacaacatagaccaatgtaacactaccatgtagatgccacatcagcgaaaccaggaaaacctctaattattaaaggagttaaattgcatcggtttttatagttgggatcgagatatcgggttgaaggatacaaattagattggtcgatagttaagcgaacttattccccagctggagggctgtttggattgaccaggcctcacgtacactgcaagcccttccgggcccaacttaattcagcctgcttcaacttaattcagattttaaacttctctcctttctcttgaaacttaattagcaacaaataagagtagcatctcaaggtcctaggttcaaatttccatagaagcgtgaatttcggactgagctgtttgatggactaagttcccaatttagaaaaaaaatgtatatatccggttggatatagaggctggataaaaaaatcattttctatttttttttaaaaaaataacaataaatataatatgaaaactcttatgagctgtttgtatcccatctagtaactcctccaacctttttagataatgaatattaaatctggcttttgctttgagagaagctacagtctcctattataaagttcttggctcgaagcccaaacatgacaaaaataaacaaaggaacaatcatttattataaggttgttggctcaaagcctaaacatgataaaaataaacaaagtaagataacaacttattcatggagaacccctccatattttaaacctgaacagcatgaaagaatggccgcgatcaagcagaaaatgggaaagaaggcagccgagctccaggccttcctggtgtggtcgaggaagcctgccttgcatgaatcgcactggaagcagagcttttgttggtcgttgctccacctgctgcagtcgacgttgtttgttgctgctgctggtgttggtgtccacgtcgtcccgttgacatatgtgaatccacacgatgatggtggcttgcagcatccagactatatattcagttaattataataagctactagggagaggttccaattagtgatagtagtatgtaattgtaaactatccgtgatccatatatcccaaaaatacgtacatacctggataggtgacatgtcgacgtgccggcggccgccgtcggggacgaacaagccggagtgtgggtcacggaccagtttcgtcatggccttgcacccggcgcccctgtcgccgcggaggcaggcgctggttgttgcccagtacgcggcgtcgtccacacgagccctgagccacccgctcttgtagtcgtccagattgtactcgcgtgccttcacatcgctgaggtcgatgcctggtccgatggccacgtaaccgaagatgatgaagccgatgagggcgaggatggcgatgaacacgccgaggaggtggcagaagaagagaccctcgttgttgttcttcgcgccgcacaggcccaagatgaagacgaccatgaagaagaggccgatcgcgatacagggccacaagaagacgccacgggtgcaatgcgtcggggcacgggtggcgctacccagtattaggatcgacgtgttcaacgtcagcacaacacccatgcccaccaagtgcctcgctcgtcgttctgaactcattctcataaatcgcccagcttctatcacccccatccccatcccaatattactcatctcttctctctctcccaacaaacagatgagcctgccagggaatttgagtgtatgttgctcccaacgatgcatgctcggctgcttatatattgcaaccgtacgtttgtccattcgggaatagctagctagtcctgtgactcaagtggactgcatatgcattatgaatcgaatcacctttagactcagcttctgttagatttaattgggtaattaatccatttaaatcaattaaatcaaataaattccaaggctcattaggctaggaattcatgtgaattcattcttctatgggatatcaatgggatgaagagttttgagaattaatccattgattaaaggaatgggtaactaatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaaaaggaagacacactttcatccattttctaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcacttagaagttttactgttaatgttcatcgcaatgtcaacattgtgtcattatgtgattgttgatgcttattcaacgttaagcatgctcatgttgattacattcaccattatcactggatcaaatcccattataaatatcatgtttattatcttgttattttggattaaaatatgccgaattatgaccaaatttccaacagcttcgtcacctcgtctttttttttttctagagaaaaggtcaaaagactctgcttatattgaaagcaacacggtttttgctaggattcgtcacctcgtctgagctgaggtcaatgccgacaatgggaaagttaaaaattaatttaacaaaggtattctaagaaaatccgatgattttcttttttttaaaagtcatgtcgtttagcagaaatcgagggtccccaactcccaaacttttccaccgcatgcatagtgtttagggtccataaagtaacaaaaagaaaagaaaaatatttgtatagagactagtatgatactccttccgtttcaaaatatttgacaccgttgactttttagtacatgtttgaccgtttgtcttattaaaaaaaattaagtaattatttatttttttcatatcatttgattcattattaaatatactttcatgtacacatatagttttacatattttacaaatctttttaaataagacgaacgatcaaatatgtgctaaaaaatcaacggtatcaaacattttgaaacggagggagtatttccacatgagtatgtgacagaaaaaactatactccctctgttcactgaaatggagaaagtatttcagtattataaaacgagctcacgcgtctgccttaatttccactagtgcgcgacgaggcatttgacggtccaagtcgtcggtcaccggtaacacaataaagcagccacaagttgagcctctcatctcaattcacctgcaccggccgccggccggtacatgccatggccattggcccatggctactcacctccagcaacgtcagtgctgacctccaggctccttggcaggatgacgccactaaactactgtccccatcggttgcccacttacccatattttctaatacgtaaatgagccaaattaatttatatataaaactgttatatatttatttttaacgacttaaaaactaattttgaaaatattatgaaatcacattcaatggggctctactataccacctctgtctaaaaatacaaggatcggatgagatatatcatataccataaatctgaacgggacatgtctacgttcatattactagaacgtgtctcattcgattttagattgctatattttaagaagaaaaaactattattaagacattatagtgacattctgacatggtaaaaaaatatccaacttctaactgttgcagcttctcccagaataagaagctccccaaacagtccagctttttgtccagattctcagaaactatagttgtagaattcataaaataaactagatgctagaagctgcgaaactcagcctttttaaatttttaaaatctaactaccaaccagctgtttctcataattttagacaacagcgactagagaaggaaaaggtacatctggtagcagtacaacttaccaggggacgggccgaggctggccgttgttttctttgtccaggtgtttgcaattcggcgacgaggccaactccaaacctcaatgcctgtaagaacatcatgagcttgaaagatttgatccgtcttgtcttgtaagctggagttcccaacagttaccttgtagacactttatgctttctctataaagctcggcgtataccttttcttctttactactgctttacaccatggaaactgttaggaaattggcctgcctgcgaaggttctatccaggtcatacattaattaaccatcactaaatatgaaaataaataccgttatgcctgtaaattgaggggagcaggggaccaatttgtatattctggaaaagagttacgctccaatggctctctacttgaaatattctaccacaagtagaattaatcttgaccattaattttatagggatagattagtaatatcctaatatagtttaggggtaattttggtatgggatgttttcttcgcttcttcgcatcaggtccgacgcatcgcatctcgccccgacgtaggaaccgcatctctccctgatgcaggttttcacttcctcccggcaggcagcggcgcggcaaaaatcgttggctgcgcggccagcggctcggcgcagcgaaatcctcagtttgcagacgtgtttgatttggtaattgaggaatatagtcttaggaaagcatactagtgggctgcctgatttctctgttcagacagatgcttatgtttctaatctgatttcactatacatgctacgattgatctcaacaagaacgatcttttggatgaatgctataaaaggatgctggaagaccatcagaacgatattttgagagatgatatagctttagttagtcaccttagtgacggacgggtgagatagtgtaatgtcaggaacaagtttgattgtcaggaacaacctagctttatactctctctttggatcagaccgtaatactatgcaaagtgagattggttacgtcgcagacaactgcttaatcacggtgcgattagggctaatcttttgcatctttttggtgatccatagcttcgtggttttgcgattcaatagtgtctaccagatctttcccgtttccagatcgtcttgatggcttgcggatgtgtgcaatgatcaaatatttgctgtcaaaatatcacgcgactgaaaatgcagccaagtctgatcgctagcagtacagcatctctgattagcaacaaagtgtgcagtttgtgacatcagtgtccatgaaagcttccaggctttcccttagttattgccaaaaatatagtcctatttctccttagggtgtgtttaattcacgctaaaattgaaagtttggttaaaattggaacgatgtgacagaaaagttggaagtttgtgtgtgtggaaaagttttgggccttgtaattgtgtcgtgggcttagcccaagggggtgtgcgcgctagggcaaccctatgacgtccctaatcacatttattcagtagccgttatcttttagagtcaagttttgcttatattattctgtcaagaatagtttcgccgctagatcggtttgtagaaccccaaattcgagtgtttaatcattcatatgtaatttggttgcaatatatcttgttcttgcttgtgttcttcgatttgcatacagggattagccttctcggcgaggtcaaccgggtttcggcacggttgataaccagaggagacgtggttctgcgattgtgagcctcagtagcgtgttcgttcaaaagccggatcgagttgtgtcacgactccgcacaaatcgactgtttatcagtacctatcggaagatcgggacctaacatcccatatcaaggacagaggacaccacaatgtaaccatgatgacgacaaagcataagtgtgctgggagagtatagtggcaaggcaccatgaactcgttaagtttgatcaagtttctagaagagtatagtagtatttcaacgtaaataatacatattatcaaaatatattcaattttagatttaatgaaactaatttgataatgactagtaagaaaatcaaacgacttataatataaaacggagagagtagctagtttcagtaaaaacgttaacaaattaattaaggaccaggcctttatatatagcaccattacacaccacgcacgtgcatgcgatcctagtacgtcttttgtacgtacgtacgtactgcaggtaaaaggtaaatgaattaagcttcagagattttcacgcacatgtatatatataactgggagtagctgctagctagtactcatcgtgatcttccagtattattattcccagttgcttgatctgcgtagagtgcaagtgaggaaagaatgagcccgatgaaggcgagaacgatatagatggcagcgacactccaggcctgactggtgtggcggaggaagccagccttgcacgagtcgcactggaagcaaagcgtttgatggtcgttgctccaccggctacagtcgtcgtccttgttgttgttggttacttgggcaacggcagctggggcacctgctgatgctgctgtcgatatccacgtcgtcccattcacgtatgttaatccacacgatgatggtggcttgcagcatccagactgtagatgcaagtcattttttttaagttttaataattatattacatcttatttatacatattacataacttaattttccacatcaatgtaatagaatagtcatctaggtaaaataacaagagatgtgagttgggaacgcagggtaaagctaaacacaacctaataagggggagtttgaatagggctaaaatattttagtccttgtcacatcgaatatttgacattaattagaacgtagactaatgacaaaaccctagactaattcgcgagacaaatctattgagactaattaatccatgattagcttatgtgatgctacagaaacatgtgctaattactgattaattaattagtcttaaaaaatttatctcacggattagctctcatttatgcaattagtgttcgccgctcttctctccacgcgcgacacgtatccagtcgcgcggagcttctcgctagttttataggtgtgcatgcgaatgatactccctccgttccaaaatatatcaaccttatactggatgggacatatcttagtataacctgtctagattcgttgtattaatatgtgtcctatctagtacaagattgttatattttgagacggagggagtagagaaaaaggcggtacgtacctcgataggggacattacacgtgggtcggcgtccaccccgtgtctcttggcccacctttcgaaggaggatgggcggggaacaaaaatgccggtgtcggggttgcgtaccaggttagtcatgccgttgcagacgtggctgcggcggaggcacgcgctggttgatgcccagaaatgcgaggagtgggtgacgcgacccctaagccacccccgcttgcactcactgaggctgtactctcgggcattcgccgcatgccccgcgtcgatgcctcccacggcaacgtatccgaagatgataaaggcgaggaggaggaggattgccaagaacacgccgaggaggtagcagtcgtagaggtcaccatcgtttttcttcaggccacacgaacccaccacgaacatgacaatgaggaagaggccgatagcgattataggccccaagaacatgccgccggtgcaagtcttgggggccttgatgctgccggccgacagcaggaggaccgacgctaggcacgtcagcaccaccgacttgccctttatcaaccacgctcggtcttctggcgtcattctcgcaaatgctctctgttctctaggcccgatattcatctctctctctctctcaaccacacaaggaccaacgactcgacttagagacgatcgatcgatcgaggcgcgcgtatgtgggaatttgagcgtgtacgtcgttgctccgattttcctatgggtgagggattttattaggagtttgctcatgatcataagcttagctagacgatggtctgcttatatattgcttttaggagcagtcaagtggttcaagtggattggatgcttgatgaagcgcacctccgaaagaacccgtgtatcaaaatgatgattgatttcgttcaaaaaaaatgatgattgatgattccctggctagtctaatataatactagtatcttttaaaaaataaagttaacaaaatgtgtaggataggcattataagatactcacataatataaggtgctcgcgtatttcaagatttcacattcaaaatgaccaatatttagtacgatatgaattgaattttacttgctaaaagttgtatattgaattgacatttgaatttactttcgtatggctataattttgtcactacaaaccttataatatatgataaattataagagaaaagattagtttttttttaccgtgtcaagtttgaccatgtcttatattataggatagtagaaatatataatgatattataggatagtagaaatatataatggcctgtttagatctcctagcaagttttttttatcctgtcacatcgaatgtttggacatatgcatgaagtattaaatatggattaaaaaaactaactacacagattgtgtgtaaattgtgagacgaatcttttaagcctaattgctccatgatctgacaatgtagtgctacattaaatatttgctgatgacggattaattaggcttaataaatatgtctcgcagtttacgggtgaattctgtaatttgttttgttattagactacatttaatactttaaatatgtgttcatatatccgatttgatacggtaaaaaattttcaccctggatctagacacactaagtagaagaaacttttatgaaaaacacatttttgtcttcacctaaccctccccctgccatttcatttactagtgtacgtgtcggaacacattgacatgcctcctcggcgaccatggtgcatgattactaccaattttatcgtttgctccacgacttaaattgaactaaagcaactaaatttttttagaggtaaaatttgcatataggagtatgtgttttaagtcattttaaaaaataagtaaattatattcacgggagattgaattgacatgtgggtgcaatatagtcctaaaacttaaaacttaataggtgagcttaccgatacaacttaataagttaacctcaaaatcatcttcaaatttaatttttaaaatttaaattttggctacggctcgtaagccattgagggagagtctatatcttcttcttcttaataataaaaaaggaaactttgaaatagactatccacggcatgatgtgaaggtggtccttgtaaaagaatcgatgcactccccccggggggggggggggggggggcattgacgcgtctggtcaatatttgtgtttgtgttgtacccgtctatgtttacatttcaaggatctatatactctgttcgttccaaaatataataatttttaatctctaaaattcgttctagaatatgataacttctccatcaatattctcttcccaactaatcaaaattctccaccatttaatttccccacatacctccacttgtcactcaatcacgattttttctggttaagttatccctagctatttttaaataaccatgtacaatcctaaaaatctatatattttgggaggcgaggtaataggtgtttaataaattctaaggttaggctaaaagattccatatttgtcattcagttgttaatttttatatgtttgaatttctttgtaacaatcgatctgattgactctaagaccattgcaattattggagtaatatgaatcattacagaaatgcttatattatgcataaaattagtgacaccatgatgtgaaaaaggattgattccatttgaacgcgcctgcgggaatgcgctttattggcagccgtggagccatctatttattcctcttcttcgtttgtttttttttatagaaaaaacaaagactttgatacgaagaccttgaattaggtagtaccatatataatactatatgcgtagtttagtaacgccatgatgggtagcttaaagctgtgttcggtagttggaggtgagaaataatctctcgcgcatgtaatattttttaaagtaactttttcatagaatttctttttaaaaagcatacagtttaatagtttaggaaacgtacgcgtaaaaactgagtgagcggagttgaaaaggttgagtgaagatcacagtttagtgagaaccacgatgtgaacagggcaaccaacaaaggcacgtgactacataggaacattatattagtgtcgacgtttgatgtcgcgattccggtatttgcatagtatggggatcgttggtactaggatatacgcgagatttaggtaaaagagacggaggcaaggatttgtatatatgtccgggcccctgaattgtcaggtaataaccctactcatgttggccgaagccggtcgttgctcttatttaccatagtcacaccagtacaatatttggggtagcctatctaactgttgtcaatatggtggtctaaagttctgactcgtagtcgacaacagggtagccttcctcatcgaatccgcatccggtgagatcaaagacagcgctatgtctctcctaacagcatctgtagacaccataggggactagccatgcttatctcttaagtcgatatccagcgtcttgtcttggcgtatgttggcttgtatgttgatcttatgtcttgatctattgttccgtgtcccctctcctcttagggggccttgtatttatacccataagtgtccccttgtccaagtagaactaggaaaaccaatatggatactccgagtagtcattgccattttcatgtagaactctattcatccttccttatacggaactcctcctatatccgaaggttgtttccgtataagacatggtatatggtgggtcctgtcgagattaagtcaactactattaggtatgtggtatccataaccctgacaattagcatttttgtgcattggtttaatcggtttgaaggaaacaaaatggattcccaaaaataatttctacagttcccattcggtttgtataaataagttataggaaaaccaaacgaattttttcttttcctttaagttgtagagaaaaaacataggaagacttccgttcactcaaatcttttgaaaaaattcatatgaattgatacgtgcatttatttttttttcactttcctatttctatggattaaaattcctcaaactgaataaactagccctcgaatctaacgggttgtttggatcagggactaaaattttagtccctatcacatcggatatttagacactcattagaagtattaaatgtaaattaatgacaaaactcataccatacctggactaattcgcgagataaatctattgagcctaattaatccatgattagtctatgtgatgctacggtaaacatgtggtaattatggattaattaggcttaaaaatttatctcgcgaattagctctcatttatacaattagttttattattagtctaagtttaatacttcttattagtgtcaaaaacatccgatgtgatagagactaaaattttagcccttggatccaaacaccacctaagacacctatagatcaatgcaaggacggttgcgtacgtcaagcctgcacgactcaacttcttctccccattagtctagctcgatgggctagctccatgcctgctatcgaatttctctgggtctatttggtagagctccaactcctaaatttagctccagacgttaggtctagaatttagttgtggagcagtctaaacccagctctacatctctagttcattttgtgagagttccccatccaactctgatccatttaagttggaactgaaattgttaggctaggctctagctctagaagacgtgaagctggagctgagttgtgctaaagttatgctccagctccatgatatctcaaccaatataattcgtttccttcaactccaatatgggatatcttgatccctcaactattaaaaccgatgcaatttgactccctcagcagttttggaggacggtttcacggacgtgagtgttgacatggagtttagatggcattagaattaaaaaaaaatatgtgtgtgagccccattcgtcattcacacaataaaaaatatgaggcccccgtgccatctcccctctatccttcttgctcttccctctttctcccttctctctctatgtttctcttcctctccacttcggtgcaggatctggagcagtgttggcggcgaagggccgagggctagaaatcccggtaattgcggttcaagatacaaattagattggttaagggagctaaagtgaacttactgtccagctccagggctgcttggactgcaagcccttccgggcccaacttaattcagcctgcttcgagtccgccgtgtccaaagccctaaaaggtctttccttctccgctcgtcagcaagtgaaggggaaaatggcgtcgtccgtcgccgccgccgccgcaccgaccgccggggggccgccggggaagcggcaggcctccggcgggcgggagggagaccagctcatcatcactccgctgggcgccggcaacgaggtcggccgctcctgcgtctacatgtcattcaagggccgcaccgtcctcgtgagcatccaatccccccactctttccctccaaaccctagcttccactgctttcttttttatgataatttctgcttttgtttgtcatgtggtgtggtgtggtttggattcttggatagttcgattgcggcatccacccggcttactccggcatggcggcgctcccctacttcgatgagatcgatccctccaccattgatgtcctcctaatcacccagtacttattccccccactctcttttcaccctttttcttttattttctttgccccttctgtcaaatctgtgcgtctcttgcttaacttcgcccttaaaatttgcagctttcacttggaccatgctgcctctcttccctacttcttggagaaggtaatgttccaccatcttccgtttttttgcttcgacagtaagtgctcagctattgccctgataccattcagcatcctcaagttgctctggttttatttgcagacgacattcaaggggcgcgtgttcatgacccatgccacaaaggccatctacaggctgctcctttccgattatgtcaaagtcagcaaagtttctgtggaggatatgctgtttgacgagcaagacattcttcgttccatggataaaattgaggtattttatctccctgaatggatttaaattgcctatatagcagtacagcactttgtcgacccctttcaaatgcatatgttagaacaaatttgaatggacagaaatcctctagatggttgataatcaactgagaaacctgtaacatctgattgttgctttgtaaacattgaccatttccttccatatagcatattgttgattcttcttgtgatgatcgaaagcttgtatgtatttcatggagtgaatgaatacttttgttaacataaaaatgccttgcaggtcatagacttccaccagacattggaagttaatggcatacgcttctggtgctatactgctggccatgtacttggcgctgcaatgttcatggtggacattgctggggttcgcgttctttacactggtgactactcccgtgaggaagatcgccacctgaaagctgctgaacttccccagttctcccctgatatttgcattatcgagtcaacttatggcgtgcagcagcaccaaccccgccatgtacgagagaagcgcttcactgatgtaatacacacgaccgtctcgcagggtggtcgcgttcttatcccagcctttgctcttggaagagctcaagagctgctacttatcctggatgagtattgggccaaccacccagagctccataagattccaatctattatgcctcccctcttgccaagaaatgcatggctgtctaccagacatacatcaactccatgaatgaaaggattaggaaccagtttgcacaatctaatcccttccatttcaagcatattgagtctttgaatagcatagataactttcatgatgtgggtccatcagtggttatggcaagcccaggtggtctccagagtggcctctccaggcagctctttgacaaatggtgcacagataagaagaattcatgtgttattccaggttatgttgtggaaggcacccttgcaaagaccattattaacgagccaagagaagtgacactggcgaatgggctcactgctcctcttcatatgcaggtccactatatttccttttctgctcatgctgatttccctcagacaagcaccttcttggatgagctccagccacccaacattgttcttgtacacggggaagcaaatgagatgtcaagacttaagcagaagcttatttctcagtttgatgggacaaatataaaagttgttaaccccaagaattgccaatcagtggagatgtatttcagttctgagaaaatggccaagacaattggcaggttggctgaaaaggtaccggaagctggagaatcagttaatggcttgcttgtaaagaagggattcacatatcaaattatggctcctgaggatctccgtgtgtacacgcagctatctacagctaacattacccaaaggattgccgtcccatattctggttcttttgaagtcataaagtacagactgaagccaaatttttaagagcgtggagtcatcaacagaggagtctgatgttccaacattgattgtgcatgagagagtgaccattcgcctggaatcagaaagctatgttacattgcagggtcgtctgatcctatcagtgatatggtgtctgattctgtggtcgccatggtcttgaacataggccgtgaaggtcccaaagttgtcccagttgaagaagcagtgaagacacaggaagagacggaaagggtggcccagaaggtagtttatgctcttatggtgtcactttttggtgatgtcaaagttgcagaggaagggaaacttgttatatctgtggatggacaagtagcacacttggatgggaggagtggtggtgttgaatgtgaaaatgctacactgagagaaaggatcaagactgcattccgtcgtatacagggtgctgtgagaccaatcccgcttatatcttcttgagctgaaggcgttaaagttacgcttaaacgtgtccaatgtttcctagatgaacttagtagcattacctgtctgcacatgatgagcaggcattttcatcctgcttcaaatgcctgtctaatacagcatgatgtgttgtagatcactgctctgggccatcttagtgccgttgaaataaactccagctgtaacattttgattttgtagccatttctaactgttactcatttcctgtgaaattgttcttagcttctctgttcttttccagatattctgtttgcctgctattcatttgtccagttggtgatgtactatgcaatcttaatggaaacttttgggtctcaatgacgaatctgattgagctgaacttccagagttcttttctggtcagatcagcaggatcagtaaaccaacattcgtaatacaatcatcacatcaataatctacacaccacccataatcactctgtaaaatccggccttagtactgtactcctccctgcacaaccaaattaataatctatacagtaatcaacaagcgaaatgaataagcaattaatcagccatcttcactgactaattcttgttaggacgaccacacgcaaagcaagacagcaacttggaagcaaaggagctagagcctgaggacgacgtcgacggcggcggcggcggcttcaccaccgtggggatgtgggacccgtcctcgccgcacttcctgcagcggtcgcactcgtccatccatgccttgaaggcggcgttgcagtagctggccgcctccgccaccgtcatcccctccaccagcttgcgcgggtacacgtcctcgtcggcgtggtcgccgttgagcaccgcccccagctgcaccagctcctcctggaactccgtcagcgccgcctgctccgccgcctccgtcgccggcctcatcttcaccggctccggcagggtggcggggcagtcggtgcgcggcgcgtcgcgcgtgaggacgacgtcgaaggtgcccgcccaggcgtcgcggttggtcaggaagctcttgaggttgaagagcttcttcacggtggccgggatggaggagtgctcgaactccgacgtcgggtacggccccgacggccggtgcaccaccgtgcccggctcgatccacggcgagatgaagagcgccgggacgcggacgccgaggcggttgaactcgaagaagaatggcgcggcgctgacgatgccgtcggggctgggcacgtccaccggcgtcgggacgtggtcgtagaagccgccgtgctcgtcgtaggtgacgacgaggagcgcctcctcccactgcggcccgccacgcagcgcctcgtacacctccttgacgaatcgctggccctcggagacgtcgtgcgaggggtggtcgtcgttgccggggagcatcttgaggtcgaagtagcgctgctcgacgacgacgtagttggggagcttgccctcggcgcagtgccgccggaacgcgaggtcgaaggggtggaagttgccggcgtacttgagctggcgcaagctccggtagaagagcgtggacggcgggtactggtagtagatgccgaaggagaagccggcgtcgtggagggagtcaaagatggtgcgctgcgggaggccggcgacgagcagcttggtgtcgttgctgacgagcccgtgcgacgtcgctgagtggacgaacagccggttgggctgcgtcgacgccgggttggacgcgaaccagcggtcgcacacggcgaactgccgcaccagctcgcggtacaccggcacggcctccggccggaagccgttcatgacggtgtccgccatgccgggcttctccttctccgcctgctgcgcgaagccggccatcggcggcgaggggacgccgggaggggtgatgggcgtggcgcgcgcgtcgacgaacggcgtgccgtacacctgctcgtagatggcctgcatggagtggcccgggtcagggtcgacgtactcggcgccgtcgccgaagcggatggccctggaggtcgggtcggcggcgtcgaggtggttgatctcgtcgccggtgacgccgtcgatctccgggttgagagacttcatccagcccagcatgtggtcgaaggagcggttctccatcaccagcaccaccaccgtcttgatcttgccgccggccgccgccgccgccattgctacactactgtactcttgtgttgattatattcttcttggtactttcttttttcacttttggttttggtttggatcaatttctgcatgaatacactgtgacactatatagagagaggcagagccagagagatcaggagagttgagttgagaaggaaacctgaattatgctctttgagtgggatattctttgataaaccgatggacaagaaagagagatttaatttaggactgaaaatgacagggctagcatgagcaagagaagagactttactgaaagttttatgtgttgctgcttctcgtaagcaagacacgtgctttctactggaccttaatattactttcacaccaacgcttgaaagctatactagtacggagtaccgggtacatgctgcaagtagtagtatattcgagggaaaaattaatattattgtttcttcatccgatggaccggcttcagatatctctgaatccaagtcaaaacgaacttagtgatgattacgcaaatgatcaatttctgataattcaggtactggtaatgctactttgtggggcatgaactaatgcattttttatgcatattatgatgcgcatgcatggatgcatttaattaagagacgcaagcaaaaacgatgatttcttggatagcttgtggaatctggaagctaacgtatcatccggtcggttggatatgcttgcttgaattcagagctatccaaagcaccacctacctcaagatgcgatgcgatgcaatccatggatggatgcctcaactgactgaaccgaaccgctcaactgaaatgattttttgaaaagagatcaactgaaatgatcaatcggcaggcaactttcttttcgatttcgtgcagcaatctgcatcccctcatatccatgtatccgaattctttgcttatgcgtccgggaaaaccaagcctctaaaattacccttcattcagactgatgaccatcgttatcaactagcgtcaatcattctccagacacttcaactcatcatttgtacttctgtccagtgtatgatccacatatatagcacatgaaaagttcatctcaaatttctctattaatatgccaattctgaacaatacttttggcttaacaagctatagaaaatactactggtacgattttttttactgaatagtattttggagaaaaggcataaagcccagcttttataagaaagcataagagtctgatacagtagtgccggggatgccagcttcacaattaacagcgaaagagtctaagtagaagtgctgctggcacaacagacaagccagaaagctaatgcacagctagcataacagaaaacagcctaaaagatcaaggacacgaagacatcagctgcttgaatctcctgtctcgcggatattggcaagcagcgatcgctttaccttctccaactcctccttcagctgcaccggcgccaggtttttccactgtatcataaacgacatagctttgtgaggtaaaaacgtcacgttggtcagaagtttgtcgttaaaaacccagtcattcctcactagccatatcgaccaagcacctgcagcaaacaaataaaacaagtttttgttcctaactcccccatgatcttgaatgaagtctaagagttcattcctagaggtggggatcctatccaatggaaagcatctctaataggccccctttgattcaaaggaaattcataggaattctaaaggatttcatttctataggaatttttcctatatagccctttgaatcaaaggaatgaattttataggatcctattaaattcctatggaatgcctaatgctatgcaagttttggagaaaatctagcatgaggttctaccttatggaaactttcctatgagtcttcatctctcctctaattcctgcgtttttcctgcggtccaatcaaacggctatttctgtgtttttcctgtgttttgcaatcctctgttttacacttgcattcctgtcagaatcctatatttttcctattcctccatttttccattcctacaatttaaaggggccctaaaacaacaccataagaattgtgctggtaggtatctaaacattaggtgatctacatcttcctccatcccacaaagcttacaaaacgggctgcctgaccaattcatcttcttaagttgctttgccacttgaatcctccccttcagcattaaccacataaacacttttatcttcaaaggaaccggggttttccaaagctcctggagcttggtgcccttaatccctccaaagataatagccctgtatagagattttgtagtgaacgtccctgactgatttagtttccaaaacatagtgtcattttctgcagtcagctgtgtcgaagtaaagcatctcttgaagctccgaccactcttccagatcatttgggcctagagatcttctaagattaatcctccattccccatccacttgcatttgtttcgcactatcactaggatcagaacaaacactatatatgtatgggaactgaatttttagagggacctcccccagccaaatgtcctcccaaaatctaatattttcaccattacccacaacatatgcactgccaagcttcatccattttttgacctcatcagcagaagtttggaaaaaacctccaccgtttgacatatactttctcctaagcagatcacagcaaaggctgtttgcacccagattccaacttgtaaatccatttacataagagggcctcattcattatttttgtgttgacaaaaccaagccccccatcctctttgggcctacaaaggggggtggttagctcgcgcgcgcgcgagaactttaagccgcgcgcacgcgggcctccgcctcaagcgcttagcgcttttctggaagaaaaacagcactacattgctaatccaaataattagcactaatcacgaaatgctacagtaatttctcaataaaaatagaaacagatgattttgaatttttgagtaaaaagttttcaaaatatgatttgaaagttttctaaatattgacttgaaatttgaatttttttaagtcaaattttgaaaacttttaactttttatctcaaatttgaaaactttcaacttggatttgaaaactttcaacccgagatttcaaaactttcaacccgagattcgaaaactttcaaatccagatttgaaaactttcaaatccagatttaaaaactttcaagtttagatttgaaaattttcaactcaaaatttaaaaactttcaaactcaaaacatgctaaatataaaaaaaatcagaaaaaagtgggaaaacaaacggtaaaaaaacggaaaaaaaaagcgtggaagaggtgtgaaacacgcgccgccgtgcgctaactagttttcccgcatgcaaagagactcccatcaaaccatatgatatttttctcttccactctaaatcctgtgatggacttgtggtgtccatcttttactgaatagtatttcctccatatatttatttgtatgatgccgttgattttttttgtctaacgtttaaccattcatcttattaaaaaaaatgtaattatcatttattttgttgtgacttgattcatcatcaaatgttttttaagcatgacataaatatttttatatttacacaaaaaaattgaataaaacaaatggtcgaaaagtcaacagcgtcatacattgaaatacggagggagtatttgccacgagtagttctttttttggcgctaaaaaatgagactgcttctagaagctctgggtgtggattggtccaacgaaaatggcgctcccagcaaccgttagccacacgacctgcgccatccagcggcggcgccgctccaccgcgccagctcgccgacgaggcccaccttctcgccgccatccccactccggcgcggccctcaccctccgcgccgcgccgccgccggccacccagcccaccctggaccgcgtcctctccgacctcgggtcccacccgcgcctcctcacccccgacctcctcgactccctcctcgccgccctcccgctccacccctccccgcgccgcaacctcgcccgcctccgccgcctcctctccgtctccctcctccgccgctaccccgcgctcgcccgccgcctcctccacctccacgccttctctgggcctcgtctcctacgcccaccacctgttcgaccacctgctgcccgcgcgcgcccgggaggacgccttcccgtggaactgcctcatcgccgggtacgcgcgcctcggccgccacgaggacgcgctcgcgctctacctccagatggaggaggagaccgtcccgcgggaccgcttcaccttcacgagcgcgctccaggcctgcgccggcgtcggctcggtcgagctcggccatgccatccaccgtgacgtcgtgcgcgccggtctcgcgtccgacgtgcctgtgtgcgacgccctcgtggatttgtacgccacattcggcgacgtacggagggctctccaggtgttcgatgcaatgccggacagggacggcgtctcatggaacatcatgcttgctgggtgcctgcgacatgggctctcccagcaggctctggagctctggagaagaatgctgagagaagaacatgagcccgactccattacattatcaacaatgctgtcgatactgccgttggtttgtgacaatggtaaatggggactggagattcatgcctgggcaattcgtcatggtctcgagacagagctgtcagtagcaaatgctctgatcaggatgtactctgataagaacgaacagagccatgccctgttggtgtttgagtcaatgacgatgagggatctgcagtcctggaatgctataatctctgctcacctccaggactacagaattctcatgatcttccgtcgaatggtggattccgggatgcgaccagatgagaccacctttgcgttggtgttctcagcttgtgacaatttagggctggtggagggtggcatgagattgttctctgagatggagaatgagtacagaattccccctactatggaacaatatacctgcatggtgaacatgctaggcaaggctgggatgatccatgaggcttacgagttcatgtcgaagcggaagcctctcgacaatgaacagactgttttgagggctctactgcaggcttgcttgatgcatcgcaacgccagggttggagagatcattgcgaagaggttgatcgaactggagcctgacaatgagcacaattttgtaaagttgatggagatctatcaaaatgtgggaaggttggtagaggctgaaaaggtgaagaagacgatgagggatagaggactgtcatgtcaaagctgatgaattcaaatgatcatagtagcttttgaaccatatttcagagctcttttgtttagtggtggtgaacatagaactaaccccagttcattgtcaaacggttgtactttgtacaggccagtatcaggtgcaaaaacaattctttaattaatgctgtacaatggagtattgtgtatacaacaattgtaaggtacaatattgtatatacaacaattttaagatacaactactcttctttgatccatggctccaacttttggacagaaaaagttatgcggctcccccgggagtgactaaacaattgaaattgctacatcaaaatatcattggcatgcaaaagaacaaaattttaaaacctggagcagaagttcaccaaagactaaatatattgatatcaatgttgaatggattacaggattcaagaaattcatccacttcatacttaaaagaatccaggaacaatccaagtgtaaggccagctttccagtaattgaatatggtaatcatcttccttatcctaccaagaaacgcaaacgaagccctatacatcagagccccgataccctccacaatggcaacagcaagtccagcagacaatatgtcccagtcacctgtttgcccgatgacagtagcaaatgccgtagcacaataaaatccgatgagaaaaaagaggatcttcagcggcagccctttccttagtttcttgagcttgccatataacttgctcaaaaacgactgaattgcactaaacaggcgagtgttattgtcgcctgattggtcagcactatcatcggtcatagcctcaatggaccattgcatctgcctgcataaaaagaggtttctgcattatacaaacaagcaaaactggcaagtagagcaaacgctataggtaatctcctgttacagtgtggtatacgttcgaacatttcatgtcatcaacaaaaaattggcaacactttaaagagtgttaactcaagcgtaaagatggacaaaaatgccaacaatagaaaacacaaactgcctgaatgaaataccgcagttcacactcttgactccggttcggtgccaactctatatctgaagattgacgacatataaagagagtgttaaatttgagtcttccatgatagaattaacacagccaactgttcagaaaacgcaatgttttttacattaggtgcaaaaaggagagaaaggcatgtctttatactaactgaggtcactgctacggtgaatttggaaagagtagctttagatccccattttagcacaaaattgtctgtataatgtccaaacacttggtgtggcacgaaattgacttaagtactgcctaataaacacacagcggccaaattgacacattacacatcaggaatctagccatttccgtgcaaacgttgaacagaacactacctagaatttgtgcggaaggaaggacaacctcgcatcaagcagaaggtcgcttgcttcttttggtggggtgccgggattcccctccgagcgcagggcgcaccaccagcagcaagcttccgagcgcacggccactcgatggctccatggcataagcggacagctgacatatgccgcccgcgctacaggccactgccctgcaaacacaaggttcccagcaaaattccggtctttccatcagcgaacaacccaaaataaacccaatcaaaatcaaatcggatcaattgacgtcatctgctcatgtttccaagtacccccagcctcactcgctcccatctaggagggcatatagaatagaagcagatagataagaggaaagggggtgctgacctcgaatggaaccacacttcagccggcggcgacctcactggtcaccaccggcggccgcagttgccttcgcggcggagagatgaaaaggttgggtggttggattggggggaacccccgaaccaagccgccgctttggcctttttttttttttggcctggccccttttattctgcattcgtggcccttcgccttcttttctttttggttccggccccttataatttctcttctattggcccaaaatttttttccttcttacggcctacggttgaaaagggaaagacgggggcttagctgcggaacctgaactgaaccccagccagcgaaccaaggcggcggcggcggcggcggcgacatgcagttcctccgaggaggcggcggcggtaccggtggcggcggagctggagggatggcgtgggaggtgctgaagaggcacttctcgcggaagcgggcggtggacgtgcggcggatcaaccccaaggtgcccaaggaggaggccgtcgccatctccggtcgcctcctccagatcttcaccgaccatggccccctcaccgtcggcaacacatggaaccacgccaaggtacgttgcttctgacactggcactactcaccagctctatgtttagtgtagtctaccagataccggtgcaaatctccggctatgtgtgcattctacagtgaaacaaacctgctgcgtttccccctaaatcaacagtaggtgaaggtctaagatcaactgttatagacgcctacaagtattgctctactcatttcgttgatccaatgttctttacactatgaaattggtagcggctcctccctttttaccccctctagcttctttcatttggataaaaatatcagcagagtaaccgtccacttaggactattgcatagcccatttaagtattttggtgaatcaggcttaccagtgatccacgtaacccattttgccacatcatcttgcgattttccgtgctttgattcacggtctttagcttattcagtctggttaaagtggatttttttttatgtgcaatatgtgtgcgtgcctgagtgtttgtcatacactcatttacagagactgttactaggatatctaccagtatatccttgtgataagtctaggtttcttttgctaatgttcagtcaggcgccatgtgtaatgtatttcaactcaatggttatatcacaaatattttcaaagtaagaggaaagcttatgagtattgagtcaacattatgttgcctattgtgcttgaatgagctggtgctgtattggtgttatagataacctgaattcaaatggaggcatatcattgcctttggtgctataaatgttcaaggagtgatttttatgtcaacttatcttatgtaggagtatgccatgtgtttctataagtgaaaacataagccatatttttgcctctctctacgaggcacgtgtagttggtctaaatctcagttgctaatacgctctaccattctggctgacctgactgcttgcccgttccatggcacctgggaacattagcagtctgcatcctcacatactgcacagtaccttttaatctacaactagcagtttaggatttggttatttcttcatgccattctgtgaattcagctcatgttgattgcaaagtggcatcagacttgaagatagtataccgggatttggttatttcttgatgccattctgcgaattcagctcatgttgattgcaaagttgcatcagacttgaagatagtatacctaacacaattattggttcacatgagcccctactcatttggagtatgttacaacaggatgctggtatcagtggcctgaatagcaagactcacatgaagatcctgctgaaatggatgacggggagaaggatcgtgaagctgaactgcgttggcacgggcaactcaaagaagttcctgtattccccgtattctgcagatgcagataaatccgaagaagcagcagcagaagagctgagtaaggctgctgcttcacaagggggaaaagctacaaaagggcaacagaagaaacgtgccacagccctacactgattgtcgctcatcacaatcttattgttacgcttctgggattatttttgtttttaatcttagtggttaggcagggcgaaattctgttaagatgattccatccaaaactgtgatgaacctttctcattgatgatgcagttatgctggcaggccagcattttgttgtagtagcactgtctgtatgttcgctaaggagcagcaataatttgatgatgcttctatagtttgagctacggctaataagccctagaagatatgaagcaactaagttatatttatgtgtaaaacttttatacatgtgttattgatggtttagaagtcaatgattgaaaaaagactatggtaagaaaaaaaaaaacctcagttaaactctaaaatgaagtttcagtatactccaatatatactggagtagtagtagtagtttgttgttgtggctgatgagagtaacactgttgtgccatccgtgagtacagcagaattaattgatggggcttctgttttgagttaaaaaaagagtacagtagcacttaaattacgtactgatgcatatagttatctgctatcattatgatgatgatataggaagtaaagagtgtgaccacgtgcacgaatcttgaagcacaaacaagcggcaggtagaggtggaagatgggccgaaaacggcgtaccaccggcctatactgcgttgccggcgattggactcttctactctctccctttcctttgctaccgcccgccgcaaccgcatcgccgacgtggcaagcgaagcgagggatccccacccctcacgacccgagtataaaacccctccaatctcgtcaccaaccaaaccacctcgccgcagatctgcttccgcctccgccatggcgtcatcggcattgccctgcgccgccgcgctcttcctcgtcctcctcctcgcgccgctgctcgcctccgccgagtcgcccatctcgctgccgcctgcgtccgcgcccaccgcctccaccccggctgcagacgagcgcctccaccccgccgacgccgccctcgctccgtcgcagccgccttccgaggcctcctcctccgccgccgcgctctcccctcccgcgcctcctgagacctcccctctccccgcgccctcccactcgccccccgtcccgcattccgcggcacccgagccgtcgcccatggagcattccgccgcgtccgcgccggccccctccgccgccaaggccaagcagggcggcgacgacgaggaggacgacgacgataaggagaaagacaaggaggagaagccgtcaacaccgtcgcctgcccccgccgccgaggagataaaggccgccaccgcgggcgacaaggcgggggaggaggacggggagacggagaggcacgagttgaacggcggcaagaaggccggcgtcgtggtcggcgccttctcggccgccgcggtggtgggtctagccgccgtcgtgtggaagaagcggcaggccaacatccggcggtccaggtacgccgactactccgcccgcctcgagctcgtctgatcgttcgccggagctcctcaccggagtagtacactacatctacatctacagtagcatcagcagtacaaccccaccatatacgttcgtcgtctcagtgcagcagctccgcagatacacagattcgatgcatgccttccatggccgcgcttcaaattgctcctgtgatccgcgagatgttagattcttcatttcattcttgtgttaattattcttggtgttgaaaccattaaaattctttttctgtgaaaaaaaaagaggaataacgtaatggagtgatatggagatggatacacgcagttttgtatacctagtagaatgatatactgctactcctaataattttgattagaaccaactccaagtgagctgtgagccgtgatgcattggtgtgaacagtattcagatccagaactgcgagcctctgcatggttggttgggatgtgcgagatttcaatatttttatcaccgtcggttccttctcggatcacgcgcccatgaggccaggccatgggatgatgggatgggagaagaaaatgtggcacctgaacctattcctccctggccagtcgctcatcaaatgtaattttgttactagattactttacttattattattattactactcctaatttctttttgttagactagcttccgaaattattttacgtggaaaaaaaatctgttactaatttaatgcgtcgtcgttttctcaaatgagtggagctaatgctatagccgatgcgctgatgctaaagcttaccaaacaaataattaatctggtggtccggacttctttcttggcgtttttattctgccaaattaagcttggagacacttggcaacaaaagtatctctttcaatttttcatccaaacacaacagaaaagaaaatgtgttttcactaacacatatatacatatacatatgtccggagttcattagttcggcacctgcccttggacacatatgttcagatatactgacatgtggtacaactcgtgctatagcagcagctgctcgagaacagaaaacaatgatcgcgtggattttaatgttacgacaaattaaagaggttgacttggatgtttaacgatagctttaatttagggcctggagacagcagtttgattatttcaaacatgagcggtactgtgccatttatggcaaagggcatgttaggtttgcagttgaagttttgtcacgtcaagtattatatgtgccataataaccaatttgttggcaaattgatgtttggctgaaacttatgactgactcgtttgtatattcattttttctagcactttttagcaaattgttcgtggcaaagttgcaccgaccaattcaaagacactactgtttgcgttagggtcagttgctttcctgagaattgagatgcaacgaaagtgagagaaagttacagatggtaccgttggccttacgcattatttacagctagctattggctgttgctaatctttggcggcataagcaagtcaggagcccatgtgcagcgaatgaccggcgaacacgcgtactgcatacttggatcttcgtcccgaacaaagccccagcaacgatgcgttgacacttgacacacaaatctcgtagactcaccgtgtctgctcgcacttgctccctccgttaaaaaaaaaatacaattctatatctagattcctatacagaattagattttttttatgaaacaaagcaagcactctcttggttacaaaataaatagatctaatatgagatattatacattataatactcatacccagattcatagttctaaaatatatcatatctcatactagttttatttattttgaaacaaggtacaaatacaaatcctccataacagcctactcgtggattccataggagataaactccagtgcaagacaagcatctcatggtgctaggcattcatatttgcaccagcaagtaattggtaaagcatgcacctgcgaaaatatatgtaatgaactagtacatgaacaagtcagaactcacaaatgtatactactagtaacgtattatctaaaaaaaaatacacagtaacatttagcctaagctacatccacctcacacaacccacagcttacacagccaaaaaggtgatcctgatttgaggctctaagcaagcatatttcaagtgattctcatgacaaaaagtttcatcatgcttctttcatatgtagattactcaggtttccccttataatcttcttttaagcctccgattctgatcagaatcatattgaacatgtcgcaagatgccagtcctgagggcaacatgagctgcacagctggcgtttacaattgcagaaccctcccaggagataactcgtgaaaggatgacctccctacaggatggagcagctgaatgctggaactttcacaacatggaaaactaatttccagtaattcgctccttaaaaaagctaggaagtagtaaaaacatagcagcatacctcgcggagcactagcaacttattgtggttggttcacttggctgctaactggagccttcaaagcatcttcagctgtaactttctgtggaacaaaatctgagcaaagaccacagaaacgatttgtaaataatgatattgctaaaaggctaaggcatatgaagagcctttgctgattaaaataggcttccatgggtttgtaaaaaagacaaatattgacctgagagaaacttgtatcttttctggttgcacactgctgttgctgaaaaggaaggcagatgtgctgtgagataaagaaaaataaaaggacaaaagaaatagaacattaactatatcttcaacctcacggaagacaggatcaatgaactttaattgcaattcagagatgagcccatccacaaaaagtgtatgtctatgagttgagatgaaagatgttaaagctattcacatgttggatgctgatcttgccatcacagatcataagaaacatgttttatgattgtttttcctgagtcaattttacacgataactctgtcaggaagttggaacatttgcacaccccccccccaaaaaaaaaaaaaaggtgcaagtaggcaaagcatagacgtttaagtatatgaattcctgaggttattttgtaggtcactggttataaagaatttatcctatgacctctgaaagtctgcatcattgagagaaaaaaaaaagaagctggggcatatatcaaaggccaatgtcaaaaaatatggctcaaaaaatgatatttgagatgcaagtaatgcaacatctgtactgaaagtgaaatccctaatttgatcaacttaataagttattatcactactgacagagaaatgcagaagagttgaggtctctctgaacttctcatttgcctctctcacagattcagaaaaaaggaggaagagagcctctcgatgggattgattcccctctgtccagtttcagaacatgagtggacttcaactatctttgttggacagtctaaaaaatatcagtacatgttacactggcttgtatagaaataaaaatgtttcatcactgcacaaatgcattagttttatatatatatatatatatatatatatatatatatatatatatatatatatatatatatatatatatatatatatatatatatgccaacatcacagaaatgtgtgtgctatgagtaaa

SEQ ID NO: 12740 - DNA, 1557 bp, Oryza sativa
ctctctcacagattcagaaaaaaggaggaagagagcctctcgatgggattgattcccctctgtccagtttcagaacatgagtggacttcaactatctttgttggacagtctaaaaaatatcagtacatgttacactggcttgtatagaaataaaaatgtttcatcactgcacaaatgcattagttttatatatatatatatatatatatatatatatgccaacatcacagaaatgtgtgtgctatgagtaaagttatgatcattagattgatagttggacacattttatcaagaaaaaggggggacaggcaagaatattgacaagaccataacaaaatatcctatgtatgtaaccatttgatgttgcaacttgtaggactcaacatctgtacccaatctttgagagagtatttatcttttggctcttgtcaatggaatctatccagccagtgatattggggcattgataagctgaatcgcaactaaatgcagttgccctcttacacacaatggtcctactatagctatatactaactgctctttctctcctggcttgacaaacctgtctgcagaaatggaaatatcatctacctatagatgggataactaccagactatcattgcaatcttggaaggttcttcatctcttgagagattgaaaatgaaaatatgaacactaaaagtaacaacctcaggacatgtgtagtttatatttcactaaaaaaaattctaatgagacagcatacagtttccacaaattgtgttgttttgaaacttgatgatgacgtgctggtacattagtagaatagggaaaccctctttcacctatctgagatttctcatttttctatgtactgtttgaatgtttcaaacatttttttccaatcttaataaatgcagatcccttagcttttctatacaaagtgcattttcaacatagcaacaaagaaagttttgaagtgaatgggaatgaatgtgcaacttacaaaggttatcatacacaattgacttcttccgatccttcaaagcatttcgataagcatcgtctgcaaacctcttcaagaatatctcctgcagttacagatttacaggttcaagtgagcgatataacattaaccaaatcagctttggacgaggaatggaaaaaataatgaaacactggtccgtaatgaatatcacagtaatctgacagaataactaggtaaatcatgaaaatatattcttcagattctatcttaatatgccctctataatattctcattgccagtatgccataaaccagtaacatatgcctaatgcatcagagaacagcaacattttagcgagttaccaacaaatacaaacataaaacaatcgtgcataaaccctcctgccaaaagtttgatggcagcagaagcagagaaatcaagctttggacttctgagacaacctgtaacatctaccatttggaggtagaaaacaccattcgtgatctgtgatcatatcagacaattcatcaaacaccttgtgggcgatcacagcaacgccgacctaaatctcattagcttaactagat

SEQ ID NO: 12741 - DNA, 557 bp, Oryza sativa
ctcattgaagagatacgggcgatgtggttctctggctggcgcacggaacgtgtttgaccaggtgcaggagcgcgatgtgggtgtctggagctctattgtatcagcatatgcattccatggccacgcagatgttgcaatgtcgcttttcaggcatatggagctggacaatgtccggcctgatggcataatgttccttggcgtattaaaggcttgcggccatgctggtcacgcagatgatgcattgaagtatttcgatgttctaaccaaaatatttggggtcgaggcctgtggagatcactattcatgcttggttgatgtcttgggccgggcaggaagactacgccaagcttatgatgttatacagacaatgccagttaaagttactgcgaaagcctggggtgctcttcttgctgattgcaggacatatggggaggtggggttggcataggttgcagggagagcattgtttgacattgaaccggacaatgcaggtaactttgtttcactcgcgaacatctattcaagcatgggtatgcatgacaaggcataacaggtga

SEQ ID NO: 12742 - DNA, 618 bp, Oryza sativa
gatcaaaatatataaaaaaaatacagatttaaaatattatattttaaaattatcacaaaactatatatgtagggcctcatatatttagatgcagtatcaggagatcggtcccttgtgcatcttccccgtcttgacttgctccggttcaattcaaatcacctcgctcgccgtccgtcttcgtggagctttcgaatacgaggcggcgatcgatgcattcccgccaccaacgcctcgcgtcgctgacgaagttgctcacttcccacgtcaacgtcggccgtcaccgggatgctctcgccttcttctcccgcatggtctccgacccctccctcccgccgctctccgacccctccttcgcctacgccttcccgctcgccctcaagtcctcctccgccctccgcctcccctccgccgccgccgccgccgactccctccacgccctcgccgccaagtgtggcttcctctccagtccattcttcgcctccgcgctcgtcgcctcctacggcgcgtgcgcctcccccgccctcgcccgccgcctgttagacgaattgccccaccgcaacgccatcgtctgtagcgccatgatctccgtccacatccgatcgggcgacctcgccgggg

SEQ ID NO: 12743 - DNA, 8631 bp, Oryza sativa
atgacaaggcagaacaggtgagaagggagatggagcagcgaggtgtgcggagattgcctggaagcagttggatgatacattgcaagtcaaggtgctagcatcatttccaatgaattccttttgcaatgcccagttgcctatatgaccattacagctttattatcacccaaagcatgaattaactgactgttctgtttgctgcagtgaactgttctgaaaggggaaacacactttgagaactgcatcacagactcacaagaaaattttatcaagatattcaaatcgtttcgtatccatgaaaggtatctgagacatgccactatgtagaacacattttacttgggtcaggttcctaactctatttatcacaattgtgtcatatttaaatcaaaactaactgcaaaatagcaaaagtaacagaaacatagtgttgggtgaatgttaactgtacatccagcagaacatcaaatttccccatggtaatgttgggaagtcaggaatttgtgctgacagctatggttttgtttggaaaatatcatttgcattaacaaaggaaaaatcacacgccctttcctgtggccctgttctttaatttcacttgctttaagattgcgttacaattagtttacatgttctttacatttcagttaagccactcattaaaagatcactaaggttactgcttctatttttcctctaaattttttgggcttggttattgggaaattagaatgatatgaattggccaatttctggacttctgaactacccttttagccttttaaaggcccttcccctattatttcttttcccggttcatatgatgcttactttaatgcacccttaccaaaagccttgtttattaaaaaaatgccctaaccagaacccttatatctttcatgtattctttttctccatctcatctagtgatcaaaaaatattattttataaaggtgtcagcccctgttatgcttccattagatcagtcggtacagtgccttgggcttgaaaatatcaagtccttattttgcacgagtagtgtgagttcattaatactatgcattagagatgttattcctcagctaaacttcgtgcaaatctaaatatccattttcagtatgtctgtaataaacaatttcaccatatattattaccgcattttgttttggcggagggaaatcagttgtttccagtctctaccctgaaagcttgacaagagttagtatgatcaatcacttatagcaaaatgttttttgtctttttacataatcagacaaagtgaatacaaatattgaagagcatctagataaattgcaaagttccaatagttggaactgattaccgtcaggttacttcagttgaggcgtacaaatgatggatgagtacagctaagttttgcagttacattataaatatgaagtttatccatgattgtaattttgtagaatggattatgtactactcactgtgtcgtgtaacatttgggatctgacgcctgatttaccagaccatgactgatggtgagcagtacagttttcttgtgtgttctgtaataatatggaagagcacttacctaaagtcttaccggagaggtccctctcaaatagcttcgttgtagccttgtaggtgggttaggagcctagggtgcatcactattgctagtggtgctaggtcccagtacagtggcatattggctggatgatgtggaagtaattctataaacctaatttatccaacatgtattgttcaacttctgcactagagagcctaaaattgtgatgctgctaactgctaagggtatttagctacccacacgattatattatgtttccttcatgaattggagcagaatctgtaaatcatatatgtatctgctatagctacccacacaattttcttccaccgtacacattttctgtctgatactaatttcatagacctctcgatacatcgtgcttgttttgatcactaaatttgcttgttcccatcagtatctttttctgtaccaaattcctcgatctgcttctacaaacatgtggtgagtgtatgttccagattcgatatactaggccacgaaccattgaagaaaaaccaggaagcgagcccaccaatgtgcataacaatttttccgacaggatgtagtgcgatcattaaagttgtttatctctgttattatttatgcatgtgggaacctccaagtgggaaacaggtgaattggattgctcatgcagctcaactgatgccaaagttgaacctagctagctaacatattagtaactattggttgaattgaaaacatgcttgacacaccgttttggataggaaagactggacctaagaactagttgccttgtgctgatctatttgctaactacggatttatttatgattacaattcttttgctcccggcggtttgcttcttgtgtagaattgtaaagctgttgggtcattctaatgtgttgcagtgtcctattatgactgaaaaaaacttgttcatggcacttggtacaccatagagtgaagtttcccttatttaggctagcttccaggcttaatacagttatggtcagcagtcacattttttttgacatcacaagagcagccacattttcctgataagttgacatgtgtggcatccgtacacaagtgtggatttcgtccaggatactcaatctgttggcactttatctattgaaaagcatatagtattcaaaaggtgaatgatgaagaacacttagataaagtgatgcatgttcatctcctatgtgctcttgcatagtaggttcatgttgtatgtcaatctttttgagcccactttctgattcctctttactcggttaaagctgtaaactctgagtctcagtaattttttttccttagaaaatccgcatggagtgtttcattgccaacctgctgccctgctaggctgatatgtttttgtccttctgaagctgaaacatttcagtacatcagtaaatcatttcatcatcctttgcctaataaacatttgcttgtgaacatacctgtagtttttgtccgaagtgaaattcattaccttttctcccaccctataaagctatgtgttcatataatttaaacagcttctttttcttggaaaagacaggcagtgagatcagcatcaagcactaccagcgggcaccagcagatgcatgtgggccacagcactagccagtaccacggatggttccgtcttcctggccgtgcaagccagtccacttctcatcatcctctgtccgtgcaaggtgccctggctgcaagtataaatacccagtctccttaccttgcaagtctgggctcttaaccaaatgagcaggagccaactgatgcatatgtataagcttggagatctgacgcctgctccatccatgacgattccaatggcacattcctcaaggccaactctgggttttcccctagggacggcgctcctgatctttgttatcttctccctcagtggcatcttctcatgttgctaccactgggacaagctccgtgccttcctctggtctcggcatcctgatgtgatactccaagaaggccagcacaccgtcatctccattgcgtctccgagcaagacaacatctgatcacaaggtactacagtactaacgatccctattcatatcttactttgatcttaacctgaaatgatcgtttcttgtagacttacagaaatctaagaatgatccccatgtattgttgtttgcagaacgagaaagcagagaaagagtgtggtttgcccgttattatgcctggggacaggatccccaaattcttcgccaggccgtgcccgcatgagaagtgtttgcctgcagcagaggaggaggaagctgaggtgcaagtcaaatgttctgttccacaatctagttagtagctgtaaatgaagccatacagagtgggtgtatataagcttttattagaacctctaaaaaaaattccatttcctctttggtcctatgaaaatattcaatttcttcattgggtatctttatctttggagttagaaaagtaaggattatttcattctcgcaaactttatgaattcatggcatatattctgaccagacccaaatctatgagctcaagactaaaccagaaaaggtcgataaaataatggatggagaccatattctttctgggtcttatgaaaactgttgtcgatcttcaagcccatcccaggtgtggcactgatgcataccagctactggtggcatttggctattctgaagtatgaaccaggtaaacaaaaaaggctattatcactccattgttcaacgatgagaattggtgaaaacataagaggtctgaattataccatttactactagtatacataatttcagaattctgacgaacgtaacaggacattttcatatatattttttgcctggtcggccgatgagacgatcaatttcattaaagacattttcattttacgttctgatttttcttcccccatggaccatggtcgtcgttgtattatgtccggagaacgatttactttggtgtgattgatcataggaaattaagctgctgctattactcatgagctagagatgagttaacatgtaattaggtgatcttttgtttgtgtaattaacgcgtacgatgtgggccatattagcgatcgatggtgcgtatcgtgggtggaggcaatttggatggggttttgctgttgcaatgcgtgctgatggttgcccactttgctggactgcaatccgtgtgcagaccgtgtacgatgcatatggtattttgccgtgggttttgcatgcactttcttttgctagagccagtgccgtgcacataattaagtgggatatatataagtatgattgtatgcatggcacataattatggatgttgctggaaatctgaaacgagatcgcgatggcaaattggcagtgtcatacagtaaattaaacaatccaattgacactgtatctgtatatatgtgtagtatggtagctgattaattattttctcatcgtccatgaaaatgaaatagggcccacccttgaaattttaaattaacctgaaactaattcggctgcaagtttaatcacacgatcgaattttgcgtttagtgttgagaaacatccacgagtcttccggctagctccacgagatggtggactagatgacctggattcgaagcttcaccccttctacttatttgatattatatcattctctaatattcgtgtcttttttattttgcgtttagtgctaaaaaatcaatcagttgcaattggacggtatagacggggagggggacagcgacctaacattcttggttatctgcgcatgatcgattaatcgatcgatgttcgatggatatctatgtgcgcttgcttttcggctttgagggcatgaagatagaagtaggtaaagtgcaagtactacgtagtaggccaggccagcaaggtcgtgcgtgtatatatactcctatacatgacagccattgattaattcagcggcagtatgcatgcttgatggtgaaacgtacgctaatgcatcgtacgtacatgtacggcggcttagcagctggctatcgtcatttgcaagactctaattagcgatcgatcgggacgtgatcctttaacttactattctctgattttgagaggttaatatacggatccaatagttaatggattcacatatatcagagattcacgtcaaaaggcagtacacgagaggagctctttccgtatcgatctaggtggacatatgatcccataagctgataggcatgccaattaacgtttacgtataggcttggcattaatagccttggctatgcctatgctttgcataatagagtgagtacttactattacttgctacaggaacaccacggcacagtattatttttgggcctccagccctccaccgtgccaccgtggccgacggatgaaactccaattaggcccacaaacataggcccatttataataggctaatcagcccattaaaagtactttttcttacatgggccgaacctaacggcaaggaaggcccaggcccatctgagggcgagcggtgaggagagatgccgcgtcacctcccctcccgcccccgtcaccggcgacattattactactccggtcgaggccaacggcggcggcgccactgtccctctccctctagctccgccctccaatcccccgccacccaccgatgataccccgtctacaccgtgccattgcccgccgatcactgctaacctccaccgccctcctccccgccgtcgcccgccaccgcgatgcgccgctgccctccgcccccggcctcccccgtctgctccaccacgcgccgggggcgtccgatcaagcccggaaatcaggtaatcgccctcccgcgtgatccgatcccctaccgctccgcctcttcctgatcactctcactggcaaaagtgcctgtacagccgtagcatcttaagattttttcctcttttttttccccgtaagcaagctgccgatcattttatctgatggatgtaattccacatcacgctaccgttcgcgatccataatttcgttttttcgtctgaaatccaaccgcatatgtgacctttcttcttaattttggttttctcataccctttgtgttctatttaagggtcctctacggcttacagggatctggtagccaaggggaactccaacatgacatttccaggaaaatgtaacaactcagctggacaacctttacttaagacgacttgagcaatactagatggaaatggaggattaccatgtaagctgcatgtgccttgtgttcactactactagttactagtagtacctttttcacatttttttcaataatattatttctgcataaagtgcaggcaagactctctatgtgggaaaatacccgggagaaacaaaggcgaaggcttcttgttcaagaagctgaggataaacagcgtgatggggtgtggatagatgagaaaagggggtttcttgacaagttagtgtcaaggtgatattttttcttctaactgaaatctacccattgttccccatgtggtattttcactaagtcattcttgaaattagatgaagttccactatcccttttatttatctatagacttctcttctgacttctgactaccaactccttcaataacagtagcactaaaatgacgataaacaagtatcatgtacaatacatgcactgaacttctgacttctgactaccaactccttcaataacactagcactaaaatgacgataaaacaagtatcatgtacaatacatgcactgaactttgcttgcgaaaccaagaacaatgtaactaaacagattgttcaacttgttgcatggtgttatttgacttttcgtttggtgattaattccaggaaaagaagaggaaatatagaacctggagttgggaaatgggtctcatatttgaaccgagaaaagaaactggataccttggttggccagaagcctgttgcacccattgctccgaaaggaatatatctttacggcaatgttggaagtggtaaactaatcaataacttcattataatagttttttgatcccatcattcttctaatatcctaacatggcctgcatatgaataactaattctttctcctggttcatatttttaatcaaacactcattatttatcatttatcgtgttaatgttgtccttttggcaacataggaaagacaatgctgatggacatgttctatggggccacagaaggtcttatcaagcacaggaggagattccactttcacgaggtaattagtttagaactatgcatggtagtgcctgttcattcattggaatgaacgcgcaactattatatttgaagaacaattgttaagaagaaaaatctgatctgttgttcatcgagcagtgtgcatgtccaactgaactcaagttcctagctgcactttgtgtgctaggtggctaggaatagcagaattctgtgaactaacttgttgaatggttaccaacatattcagttggtgttctgttgtttagcatttttctgaatagtgttgagttcctttttatgcaggctatgcttgaaatacatgatcatatgcatgatgtatggaagagacgtgatgaggacaagtctattgagtcgagtgctttcagttggatatcaagcctcccttttgatgggaaaattaaggagtggctaattggggaagagaagtacaaacaaaatacacaacaaaaccatatccttttagctgtcgctgacaaatttcttgttgatagacaagcaaataagagtggagcaagcattctatgctttgacgagatacaggtacatgaactttgatattttgaatattcaagtcattttcctgtatgttattatttctaaaaacgagaattggcattcctgccacagataggatcttgtttaccagattactcctaggtttagcaatctgttgcaattacataaaaggagtaaagaataatcttgttgaatatttcttgtgaaatctaattttgcttatcttggctgtctcttcactaaatcttttactttacatagtgtatgttatatagcacgtgtgctatatagcatctacataatcacaagtatatggaaaaataattg

SEQ ID NO: 12744 - DNA, 9813 bp, Oryza sativa
ctgcacctgtatgtatgtaatagtattagctttcaaacaaatattttatttccattgttaatgtaataatttctggtatccatagtatttttttaatacactgggaaacttcatctatgcagacaatcgatgtatttgccgttgtagctctgtctggtattctcagcagattgttaagcacaggaactgtgcttgtttcgaccagtaataaagcacctgaagatctgaatcaggcaagtcgttttttatgatttttttctacttttttatcaaatacttcatattctggcccaaaaaaaactttaacctggggatgaacttcagtaggtgttttcaactttactcctagagatcagaacaacttgtcacatatataagatgatggaaagagtatctcaagtagcaatcttggatttttagaggagctaaactagaattgtccaactaagccaagaggtgcagacactaaataattcctgtaatgcatctttgtttcttctagttaatgatgaatttagcagttaaatttcatcaaagtatcattccatggcttaaactactactacctatttatacatgaatatcttcttgtgatctaactgttttcaaggcacaacattcatctactagaaattacaaggtgctgacttgaagttaaaacaatggtgtgcttccctttcaccttttgtttttctcttggttttgtaggatgggatgcagcgggaaattttccttgacttattgtctaagttggacgagaactgcaacaaaattcttgttggaaccgaaacagattatcgccgcctaattccaactgacggcttaactcaggttaacctctacctgtttgtagcaataggagatttatgacacttgtctgcataaaatgatacacctctagttttcatgtgctagagactaaaataagtagtttatatgttatcttatcacttccttgcacactttttagattttttagaaataattttgtgctgataagctgggggtgagcagatcacatgatcagtacctcaattttagtttgcaaaatcttctagttgactgttgacattcttttaagaacttttggtttgtattacggtggccattggacttcatcatattgtaggacactaggacttcgctctcttgccattcagtgcaatgtctttttcttttttttttttttttgaatctcagtgcaatgtattggtaaatggtaagatagcactgctttgcttcagtaacctgagtttgataattcaccaatcatgtattcatctcttggtgactatggcatgagttatcatgtatgttgcaagcatggaacttcaatctacttttgcaaatctcgcggtataccataaaactacctttttgtgggtcctataactaaaactatcttgtactgtaggactccataaaatgcaatgcaattgttaggtgtatccttttctataactggattgtatcttcacaataagttcatcttcatgtaacaactaatggttctccatcttatctacagattcactacttttggcctctcacttctgacattcggagtatgtatgaggctatgtggcacgatataactagacaaacaggaggaaacattatttctgtcaccattccagtaatgtttgggaggtgcgcacatagcataaagcatctctatactgttgaaaatgaactgaatttaacattgatattatgaataggtatcttgagattcctaaaagttgcaatggagtggcaaggtttgacttcgagtatctgtgtggccgcccagtaatatcttgtcttcttaatttacatttatttagtatgcaagtagatgaggggaactaattggttcatgatcaggcacttgtggcttgacaaaaaaatgtttagtatccatcctttaaaccgtctaaacttggaactgaattctattgttatatacaggagtatttgttattttgagctgggatcatgtgatatattgcagctcattatataatccactgtttattttaattatcaggttggagctgcagactatatagcaatagccaggaactaccatacaattttcatatcggatattccagctatgagtatgaagattcgtgacaaagtatttcttcttctatctccttttctgattcttttagtttgctaaaatctacttaattgtgcttccggagtgtgaatactgaattgaatataaaacattggaagatggaagagatcttataattcaaaagtgtcaacacatgaaaactgagaggaaataattcgtcaagacaagagaaatggaaactatcttagtatatctcatggtttcaagctccattttttttattttctagaatcatttggattcgtgtggtgtctgtactatttaaacatggtgatgacattgagaagttaacaattataccagatgcttgtgttttctgtgtttattttgatgctgaatgaacttcttggtctcattcaggcaagaagatttatcacccttattgatgagctctacaatcatcactgccgtcttgtatgtctagctgcctcatccattgatgatctttttcaaggaactgatgaaggacctctttttgacttggagaggtaatatttgcatttatactttgttgtacatggtgcttccagctgtctgcaatatttcgcattacagaagtttttaatttgcaacataattcagagtgatttttgacatgggaggtcatgttatgcagttttcagttcgaaggtgaagctgaaggggcaaagcttaggagggatgttttagcagaaggtaatgttggtgcagcgccttctcctacaggcctagtggcaattttgtctggccaagaagagatgtttgcattccgtagggcggtaagtaaatagcatttttactttctgattgtagctacttgcttgagttcaaacgcactagtgaagtatcattagcactggggagttgaatttcgttcagaacttaccttattatccagtttactgaatataagctcacagtaactccttctcacagtaactccttagaaggtacactcgttaagcaatatctgcattctaaatgcatgaaaataacacatgctccctacgtttcaggttataagatgttttgacttttgttaaagtaaactgcttcaagtttgactaagtttatagacaaatatagtaatatttacattaccaaattagttttattaaattaataattaaatatatatttataataaatttatcttgggtcgaaaatattactattttttttctataaacttggtcaaacttgaagcagtttgactttgaccaaaatcaaaacatcttataacctaaaatggagggagtataagggcctgtttactttgatgccattttcaaccataaattttttttggtaaagttgccaaaaaaatgtcaacgtttagtttgttgctaaatttggcaaatcataagaaatcctgccaaaattttgacaatattatcatcttgctaaaattttggcattgctaaaatttggtaaggtttattttggctacaatctgaacaaaccctaagatatgagcactgtccatgagtcatgactttgtctggacctatatttctttccaaaatttctggacatgtttgtattcaatttctaacccgtgttttcatgtcggcggtacaccatgtttgagttagatactgtcatcattcttctttgaattaataactgcaatgttcatctgtttcacagatatcccgtctcatagaaatgcagacctcactgtatctggagcgcgtcgagcgtgtgcactcatccctccaacagcagagttcggttcttacaaagagcagcactgtttcgcagtctgctccgtccgtttgacagacgagacccttatagtaccattatttcatttcttatcgtggaaaaaattgtcgaaagcactaataagattggagaacctacttgccgtctgtacaatgcactgaaccgtacaaaacataagtgattcgagcaattgcgtcgcacatattcttatgacttcctaattcctatccaattatgctcaaggtttttttgttgatatggttatgctcgtcgactggatacctggtcagtgatgacgggagattagaaggaagatgacagggttggtgttataagtattacatgattcttaagacaatcttagccaaccaaagtaacttccagcgaaaaaaaaaataaaatatcaatcgaaaacattccatgttcatacaaaatccatgatgcgttccacgatccacatgatgtgttctagaatgaatgatccagaccatttataaatcacaatgcttagcaatagccctgtaatgttggtataaaccatatcggatcctgatgatcactgtacctatctccataaaacaatgcaagcacgtcttgcatagcagtatagcacaatatcttagagatggcgttacgacggaacatgccgaacgattcgatattgggtagggtggaggctggcggcaactcgatccaatcatcggtgcaagggttgatgagctccgtattgcaattgtagtaatctttttcgaaaagatcgtattgctttattgtaagttcggtgtacaggacggcagcggcttcggcgacaactggagcatggaggagaagccaacggaacatttctgtgtttgctacattagtgtattggatttccatgcttaattttgggaagcatacgttcagatatactccctccgccgcctctaaatacttgatgccgttgacttttttaaacacatttgaccgttcgtcttatttaaaaacttttgtgaaatatataaaactatatgtatacataaaagtatctttaacaatgaatcaaatgatatgaaaagaattaataattacttaaattatttgaataagacgaacgatcaaacatgtttaaaaaaatcaacgacgtcaaatatttagggacggagagagtatatatcacggaaattagagcaatacttcagcggaatctgtaatcaacaagcatgatttcccctgttacagcatcaggcctctacagtttgtacttataaatttgccttcagtcagtgtactcctgcatattttctctctgtgattgttacagcgtacaacatgacgcgaatcatcacgcgaaacaaaaggtatttcaaacgcaatgccaaggtcacagcagacagcaagtgaatccccccaaaacctcaggatcgtgtatcgatttcgatattatcgatcagcctgacctttccaaaccacgccgcaacgcaaatgaccacagggccgtcgatctgttctacagggaccaaactttcttgctccacgatctgcattgcaatcagaaactcgttcagcagtatgccagtatgttgttcacttgtgctagatcatagaaaagataatgtactgaattttgccgtctcatatgctacaagatattgcaagtgctagattccaaaggctctctagaagaaagccagcatcaacaaagtaacgggaggctctaagaacagaagccagtagcaattaaacaacaaagagaggccttccacattacctcaacatagtcaacctgaccgccagtttcagttagtgtctgtactattttgtttttgatttgtttgcaatcagtgtttcccttcaaggcgccagttctagcatcaaccagtgatctactgatggataatgcctacaaaagaaataatacaaccattggcaaagttcatggtgagctagcgaaaaaaaaaaggttctttctgcagttctgcaaggtagttataaatacagcaaaactcaattgaaacaagaggcagatatgacacctcgaaactgtgcaactggcgaatactcaaaagaaaattgtgcatttacaaactatcatcatcttgctggttatttgtaatacacaaggaatactgtaactgaatcacacaaagcaaacttttgttgcggaagctgtttctgaaatacagtgaaagagagacaaaccttttccctctcctcgcgtgataggtgcacattccgggagctcatggcaagaccatcagcttctcgcacaatttctgatcctattatctctatggcaaaatcaagatcacgaacctggaaacagcatgagcataataatcaactaacattagcaagtgaaagatactctgaaccaacaaagattacaggttctcctggaaaagaaaaactacaggttaaaaatgttactgaagcatcaaaacgggaacaaaacaagttatacctttggagcatcaattgaaaatacacattatggcaatgaaatgaaagcaaatcccgttctctaaatagttgtagctaagcataccaagttggcccatgaaacgaatcactaactagtaactacaagaagaggtgcaatcatgaaaaccaattatcttgcaccaaaaagttgaggggtaaaaaggatttttttttcttccttttaaccacatgcctcatcttttcgtttatgcttatttttatccgccaaaatttaaatttcaactttaaatttatagttgattttggaggtttttcatcgaagtttatttttcagtatttgcttttagatcgctaagaacacgtatataaaagttttattcacaaattatttttagtttgcaaataagctgtttcgattattccccgaataagcgaaccagtgggtccgctagactagactaatttttacttcaggcttcttatcgatgaagccaaaattcagtcttgtctgttatcattgaagatatcctactttgttcataaagctgtccttttgttcctaactcgctatatgtacccgtaaacacgcagccttagaacttggtagtgtactagaacaaagcaatgcgtaaaaacttactgcacatatgtaaaatggaaagataaaaaagagaagaaattggcagattttgttaccatacggcagatgacgcgccactgctgataatccttcttcccgaacacagcaacatccggctcgatgatgttaaacagcttggagactatggtggccacgcctcggaagaacacgggacggctggccccgcacatccccttctccaatcgctccacccgaacccacgtctcgtgcccatccccggccgcctcctccaggcaggagatcgcgcctccggaggcggcgccgcggcgaccggcgccacggacgtagaggtcaggggggttgaagacggcatccacgacgccggtggaggcgagcttgcggaggtcaccggcgaagtcggaagggtaggtggcgaggtcctctgagggcgcgaactggctggggttgacgtagatggtgacgacgatggcgacgggatcagcggaggcggcggcggcggcggcggagatgagggagaggtggccttggtggaggtagcccatggtgggtacgaccgcgacggtcttgccctcggcgcggcggcggcgcgaccatgcgcgcatcgccgccttgtcgcggatcacctccggctcgcgcggcgccgccatggtcgtccaatcgataagaggtgaggaggaatcggacagaagtggacagggagaaactgggacaaattgagactttgacagctttagtctaatacgatgtactactacatgggagggaaaagatggaaccttttaaaaatcagagccaacggagaagatgccatctcgtacgcaagaagatttttaaatactcgcaagatcaaattcttttatcaatgaaatcatggagaagagttcatatgtcaaaagggacaaactgcaaattgcaatcacgccactcattccgtcgaacaacctgcgtgcatgcccgacgcggccagccttcccacaatcacaccatgcaccgctggatccgtgaagaggcgcgcccccccaaaacaactgggggatcacagggaacagcgcctccacgcacccggagccagccgcgctacccccaccgccatcgccatggaagccggcgatggtattggcggtggcgtgtcgacggcatcccggtaatggccgtagagtagtagagttgaaggatacaattaaaaacgcccccgaataagggattgagatcctccgacgtaacttccctctgacttggtggctaacatgtgagcccgaaaatagtaggaccatgtgagcccgaaagtagtaggacccatatgtcagttacggtgaacagtaacgtcataggatctcaatccccaaataggatagctatactatttcagttggaagcatccctactcaatttgaatctgttttttggaattaaggctgtgtttagattcagaggtgtaaagttttgacgtgtcacatcggatatacggagacacgtttgaagtattaaatatagattaataacaaaactaattacagaatccgcatgtaaattgcgacacgaatttattaagcctaattaatccgccattagcaaatgtttactgtagcaccatattgccagatcatggaacaattatgcttaaaagattcgtctcgtaatttacacgtaatctatataattagttatttttttcgtttatatttaatactacatatatatatatatgtccaaatattcgatgtgacagttaccaaggcatctaaacaaggcctaaaagtccaacattttgacggatccaaatccaatgagagatgtcaaattcagacataaacagttaaacactgaaatgaaatttacttttcttccttattcattaaacaaaactctggaaggatgaatagaatagcaatccaatctcaccttaaccttgctcccaagtgaaataaaaaataatctagtgcactcttcgatacatacagaagcatacaggtactcatttgcggatgaacaggagcatatgcagagcagaaatgcagcatttgtctctgaattgagagagaggagtgtggctggcctggcctggcctggcctcgattgtttcattctatacgaaggcgtgcttctcgagcagcttgaggacttcctcctggttgttgagtttcgccacgtcgatggccgtcttcccgtccaggttctgcaccgtcctgcacattgcataaccaaaccgggttagtttcagtcagatgtccattgatggatggcatgggcatatgcatgcagaattgcagatgcgatggacttacacggcggcgccgtggtcgagcaggagggcgacgcagtccttgcggccgtagccggcggcgtagtgcagcgccgtgttcttgttcttgtccaccgcgtccacggccgcgccggcctccaggagaacctgcgcgcatttcagctgcgcaaacacaagcaacgaatcgatcagataactgaacaagatgttcactgagaactgcatgcatgatgcttacctcgccatagccgcaagcgaaatgcaggcctctcctcccttccgaatcctcctcgtccttgtccacgccttcctccaatgctttcttcaggccctgaacgatgccaatgcgtgttgaagatgaaggaaaagatgcagattttacttgagcaaatgcgcataattagtactccctctgatttcagattataaaacgttttaaatttaatcaaagtgaaacagctttagatttaaacaagtttatagaaaaaaataataacattttcaatcttaaacaaatttattatgagaatatattcaattattgattttgtattgtaaatattactctataaataatcaagaaaaaaactaatttagtattataaatattactatatttgtctataatttagttaaatttaaaatggtttgattttgaccatcttgtct

SEQ ID NO: 12745 - DNA, 4705 bp, Oryza sativa
ctcaaccagccatggcgccaattgcaactatgcttacttcatcatggcggcggggccgccgttctcgatctcgtcgaggatgggcttgagggaggggtcgtccttcatgcgggcgatgcgggcctcgagctgctccttgtgggcggggttggtgaggccgccaagcatggacgacatggccgggtcctgcatcagcgcgctgcccagccgctccgccatcgccacgaactgcgggttctgcatcagctgctgcatcgtcgacacgtacttgctcgggtccagcgccggcgccgccgccgccgcagcctcctgcgccgccccccgcgccggcggcgactgcaccgtcttctgcagctgctccgccatctccgtgaacgccgggtccttggcgatctgctccgccatctcctttatgctcggatcctgctccaaacaaacaaattaccatgcagattattcatatctaattattttttctgctcatcatttcatcaatggactcactaattattactagtaattgcatgaactgtataattaatcaatccagcttccatctcagctaataagcaacaacacctggttggttatatagtgagttgcttaattaactcaatcttgaacaggtagctgctaattaattaattatcggataacttaggttcaagaggagattatacccaaaatatagttgaggaaattacgctgaaacgagtaggcaattagtgaaataagtcggcagcgaggtaagcttacattgagcaagttcatcatggttgagaagtcgaaggggttggccggcggcacacccctgcgcggcggcggagctgcagcttgaggtggctgctcctccgccgccgacgaggcctcctccgacttgacgctcgtcttctcttctgcgcacacaattactcatgtcgtctcttatcagtatcagaaagaattgagccggagcaaatcaaacaagaaagaaagaattgaagaaataaacagcaaatcagttcttttgaccttgagaagccatgtcgtgtggaggagggcagtgttcttggttcaggcagtggcgttgttgttagtggtggtgatgatgataaggtggaggagtatttgagaggagaggatgcgagtgagtgagtgcgaccaaccagaggcttggtttcccggtgtatttttcgcctgccggtttatatagccagggacacagacaccgcacatcgatcaaacgcttaacttaattgggtgactgcaatttgtacacatcgatcactctctcctgcaaactagcgtttcttgcgactacgaacagctgcggcaaatacaggatcgctctaatttttcttttaaagaaaaaaatgttgttgcataaatacatagtaacagttatcttgttaatcagtcccaaggattgacccggcaaaaatcagtctaagtattgcattgatgagatgtatttaagtgtttagttgatagtgattatgtgtaagacagtaggtagttgatggttaagttgttctagaattttcattcattccgtaaggtgtggtgcatagtatcttgagagcaactttgttagtagattggtgggggagagaggtgccatgcttgcatgccatgcaaggtcgaaagaaagcatggagaatccaggagagataggtgtcagatagggatgtcgataacaaatgtgtggatggaattgcttctcttacaaatgcattggttgctaatgcgacaagatttggtttctgtccagtgacaagtacatcttgcatgtcccaaatcagattattgtgatttcacttaaattcagtcaatttgaaagagctttcaatgggtgtgttttctttgtgaaaattaactcaaaatattttctacatcttcagccaacatgtcatacttggatgcccagtactgtatatctgtaaggtagcatttggcgactgactgaaagaaaatgaatgtcaagaggcatatgatgtgccacatcaaactaaacaacggacgacgtgtcagcctagtcagcacatcacataggaactactagactttgccaacgtagttgggcaagtgggcaagtgccaactgccaagctttggacaagtcagtacacacaaagatattcagaccacagaacagtttggttcctttcacttgatatcatcatttccaacttacagccaacacagacatcatgaaacagtagctttctttcaacatatatgggatgggattcccccatctagtttgcacaagtaataacaggagcaaaacattcagatggggactcctcggagtatcactccaacaaggcaacaatggctgattggaaagctcatggctaagcatgcacagtagctcaaaaattgcacatgttgcaagtaaaagaagcaatgttggaagccaagcggctagtaggctaagtctctccatttggaactctactgatgcgcaatatgtgaacaaacaaaattcctatgacttgattctctgagagttctacttccctacaaaaaggtttgcctctccattgcatcaaaaatggcaccggaaagatagttctctcatgaatatttgtggattccaatgttaaggtccgatgatatagaggtcagaactggggccgttcggtgccaaagggccttaaaaactcgcttctggtgcgcttgaactgactggcagggattctgcccattgtgcctgatgtcaaagatgtggatcatagggtccgcagagccagatgataagtaccaaccatcaggagaccatgactggtttataagagctgactgagactcgctgctctcttgtttccaaccgagtgtatgaacttcagtctgcctaagcctaacgtcaaacaaccgaagctgcctgcctggtgccctgtaagggaaacaagaaagaaacgcacatacaaggtttcagaaatgcagcacaagcatcaaaaggacatacaggaaatgactcgacataagaacatgataattacatgatttcagttgatagatttgactaaaacaggagcttgagctctaactggaatgctaggactatcacatgctagtttatcagcatttttacttccgctgatatgtaaaacgaaacccaaccaaccagtaacacagaaatagcatttgagtttttacttacgctgtttgcaccatgtacaagttgaaatcacatggatttggtaatacactcatgcatttgtaatcaattaggttcttggactctgtccttccagctgccagatcaaatgatataatcctcttgtcactgccaactgataatattgtacttttctgctgtaatccagcaacacccatgacagcagaagaatgcaaatccttgtgcactttcttgtggttccatgaatcatctttttcttgccaaagtatgacagcatggtcacttccaccagtcacaaagcatacatcagaccatggcatgaaatttatgttgttaataattcccttggtatgaggcttcactggtagaaaactaactttcttctgtttcaggggattagttaaagaaacaccttttagtaatgatccaatacacacagtcatgtgttactcttaagaaaaaggtaccctaaaaacaattatgatggattcctcagtatttcaaattgacatgaacacattacagtagcccttgatgcatccttgcccgggggaaatagcacaagatagtcaaatgatttatgacttttgtgtgatcatttagaaagatttaatgtgatgctactgttaatacaatgaagaaagtatcagcagccaatcatgataggatcaagcaccaaaaacagtacaaatttagctggcaataagttgcatgttaagaggtgaagctctgagcatgattacatgaataacttaaaagactacctctctagtcctatcgtgtgataacctggtttaagatgattagacgttcagaatcaaatttgcagatagaatgccaccaggaaaatcattcaggtgtcattatattttttttatcagtttgcacattcaagttaagctaaactgatagtacttcatgcaactatactgtcggtggaaccaatttagttggattataacaactaatgacttttctcgtcgcatggagaaaaccttgcaatgggatgtgaagaagtgagctacttctagcggagttcttacttgtcctgataagttgcgattcatcactgaaacttgagagtcgccgttatcagcactgtacacagcaaaaattaattcaccatgtggatgccaagctacatcttcaggccacctatgcttaggagaaaagcaatctgttgtgctgagcaaggagatgacgggtctgcaagtaaaatatatgtgattgtaaaatcatgcttaaaaccaaatggacaaaaaaatgtggttatggtaggattatcactatagtttctacatcaatttctagttttatatctccacataagagtttttttttgctacatgtccaatgagattcaggaagcaagaagtcatttagtgccaacagtagtgtatgaagtcatgacttcaatgtccatacgccacaccatgtttaagttaggtattataatttgcttaaattcataagccaactgtttgggggatttggtcatatcagtgttaaaaatgtcacttggtagaagtgttggcatattcttttacagccacttactgtgttgcaattacaggttttccat

SEQ ID NO: 12746 - DNA, 10614 bp, Oryza sativa
  unsure (1)..(10614): unsure at all n locations
actttcaggcctcatgccaaaataaccatggagtaaaaacattgcctagagctcctattcgcagcaaagtcagtcaatagcaacttaaactacagtatgataagaaatgagtaatatgaggcctacccttttggctgcacttgccacagagtaacaattccatccaatgcactgcatcacaagaatgtgtaagattaaagttcttaaaagagaaaaggtaaggaaacaagctatggcgattaaattaaatctaccacagttcataggtgactggagatcaacacacacacaaaaaaaggccaccatttagctaagcatatccgtctaaacagatagtatatcactcggaactcctaatctacaaacacatcattgctggcatcctgcactgaaacaattccattccatgttcatactatccagatagttgtgtagctatccttttaaaagatcggtactgttagttgtttggacttaccaacctcaaacagactgtaactttgatagcttgttagttcattaggatgtaacgtcaacaaccaattctttggttgttggcaaacacccaaccaaagacatatgtacaaaacatgactgtgcacggaaaatgcttcatacttgtatgttcgaaaagaagaaataaatagatagaaacagttgatggagcatgaaacacaactggaaactgatggaacatgaaaggtcagctagagatttcattcaaaactgatggaaaatggaagatcagctaaatataagattgcatcaatgcaagagtccaattttagattcactcatgcaggaacgcaagcaagaagttatgacccaatagaagattgctctgtattgaaaataataacaattcaacaagtgcgtgtacggctgtcaaattttaaaattctggacttccgggtgataaaactgataggatgaacaatgcggaagccaaccagacaaccacaacagatattggttctctgtgcatgttccatccgtcgttctttccaaattaacaagaaatttgactgaattgttatggaatatcattattttgcggagaacttggcatcgctaacctctaatccgtaatcagttgcattgatggcatacattaaacagcccatgaaacatacctagtagcaacaagctgatcattgacagggcatagctcaagacacctaagcttcctcttgtgttggctacagattacggtaccgccatagaacctaagcaccgttgcagatgatttcttcacgctctgaatcaagttctgatgctccttctgttctgtaaagagaaaaacgcagcctgatgtatgagcacatctgaggaaataatttcatcatggtagtggttctcctaaagaggaaaatcaaaagaaagtaccgatcttaagcttgggcttcttctccagtgccctgggccgctccggcggcacggatgcggaggaggatgatggagcggcggtcttcttcaacccaggcatgggctctgggcgcgggggtggccggttgtttgcccccgggatgacaagctgcggccgctccggcgccttgtgctgtggaggagatggcttggggtccctctgggtcgtcgtcggtggcagcgacggcttggggtccctatgggtcggcggcggaggcggcttgcgatctcgataccgggcgagccgatcttgcgcctcggcgagcttcttctccgcggtgtccagctacggcggcgtaccgggaaccatgagaatcgatcaagatcgcaacatttatcagacaaaatagcaggggaaaggggggggggggagtaccagggactggtagtgcgagagcttgagcttgcagcgctcgacgtcccgctcgcggtgggcgatgagggcgaggaccgcctcctccgcgatgtcatcctcctcatcctcctgcgtggcggcggtggcggtggcggaggaaaaggattgggggggtttggatgcggaggaggcattggaggcggcggggcggggccagtaggcggattcgtagtcgtccttctcgagcttgggcctcttcagcgccgggggatcgcccatggccggcgagcgagcaggcgggcgggcgggtcgaggaaggaagagaggaggggagaagcggcgcgtgtaccgaccaggggtggacacagaccctggtctgccaatagtcgcgtcgcgcactcgcgccgcgccgcacgctcgctcgcctctcgcttgcctctgcctctgtatatactgtaggagtatgctgctgcctgcacgggtgcacgcgggcgcacggcacagggccaagaaattcttgtgtccgtgctccgttcactcatgaatttcgttggagttgcagctctggtttaagcttgtgattcccgatgatccgtgtttacaacgtgattatcaaatgctttcacaagtcacagacatttgtaacgccacaattaaaaatcttacattagttcctccaaaataacaaatagtaaaagttgtcaatttggcatttgttatttagaaatatagagtagcaaattttaccaaaaaagtgcgttgggagccgtgctctctctcactttactaataaaatgataaaactttaccatgcatctaaacaccaactagcaaattttcaatgccaaaacttttgccacaacaaattgatcaaaacatgcccatactactacttgtttaaacggcttatttgcttcatgattaaaattatttttttcttaaaagaatctcttcaaccatattgcttgcacatcttaggtttatttattaaaacatttaatttaatttatatttatataattaaatagataatccgtagcaacaatcctctcagcaatctatttcaaacggagcctaaggcgttaaggattgttcaacttgtgcaagactttgtccattttttatccgattttggtagaacaacaaattaagcattctcttgccatgatcgctctttcaaattttggtatttttgaaagtttcttctcttataagctctaaagtttggtaaccaaacacatctaacactatcaaaatttagtacttcctccgtttcataatgtaagtcattctagcattttctacattcatattgatgttaataaatctagatagattcattaacattaatatgaatatggaaaatgctagaatgacttacattgtgaaacagatggagtaacatgtaagtgcctcgaaattgattgtagcaacacactgaacatccattaaatctatatcaagcgccaaggaacttaactgtggttcatggattttatgtagccttaatctattgcacattactccctccggcttcataactcttgacgttttgaaaaagtttagatcagacaataaaaactttaactattaataactatatagtttaaagatattagaacacaatgtatagattagtcttaaactattaccatgcctcacgtctaaacacgtgttgttgttcaaaacatcaaaaattatggaaccagaaccgtaggagtactcgtgtatttgctctttataacagtgccaaaaaggaaagaagtggcagacggggcctcattgactcgtatctacaagaaaagaggttcagaagataaagagaattccagtatgaatgatacttcaactcctgatacagactgaaaaccttgataaacagagagatggatcaaccacagccttttgaaccaaatcaggcgagaaccaacgcagaacttatgaagtggatgctgcgccacttccctacggagtctcgtcttcgtggtaaagatacagaccaaagccaaaccttgcgcaggccttgcagaatgcggcctcttctgcagcagccacgggatcatcaaatcgtgcatcattcagtgatgttgttccagctgcctccctatgaacctgcatccatagaaacaattcacataaaacaaacaaacaaaggcaaacttggttcggtgccatcattttagttttatagcacccgaagattatggttcactttgatatagcactgaaagttatcacagttctcatatagcattctgttaaaccacagttaaatctctaccgcgttcgcgaaaaaaaaaagcgttcgcgaaataaatctctaccacacattacccccttctacctttctttctgccccctcccctccccttcttccatgtgctagagatcggcggccagctctattgcagacctgtggcactacccgcttgggagaaggcaggaagcgggagagcttgaggtcacagcagcagctgagctcaagctggagcctagagggcaccggcagcaagcgagctcgaggacaaatgcagcaagatggtggtgattgtggtgtgtgttggtgtgcataggtgtgtgcgtacaactctattcatatgatgattatcctgtaataagaagtgttgggctgtaaatagactagttatgtgtgtgtgtcttgtgtgctggcccatctattgaagagggcccatcccatgtatatgtaagtgagaatggcaatagagaaagtgaagcttccagagaaaaaatcacaagacttcatggtatcagagccaaccggctagtgactggcgatggctaaaccctagcctcgccggagctcgtcgaggagggagacgctggtgttggggaggacgtgtggcggcggcgctgtgagcggaagagtgctgcacccgtcgactgctgaggcggagcggcggcgtcgacggttgaggcggagaggccacgtcgacgccggagacggcgacggctgctgcagtgcggccggtgtgaaggagggagcagggttgcagtgctaggtgtgcttgtgcttgtgaaggaaggagtgagtaagtgtgcttgtgctgttgctgctgcttggatttggtacttgtgctgtgagaggagacagagaagagctgtgcgacggtggtgcttgtgctgttgaaaggaaaaaacaaaaaaagggaggagacagagaggaggtgaggtgcttgtgctgttgctgttgaaaggaaaagggaggatttggtgcctgtgtagctgctgctggttggagtagctacaacttatagaaggtgagaataaggaactttctactgcaagtattgcttgattaaaatgggggaaaatcagggactggaacaagtaatggtaaattggtagagatgcttgcaaagaagtttaatgaggctccaactacgagtagtgcagtggttcctcatactgaatcggtgcaaaaaattgagttgatgcaaaatgacattaagttggagggtgtaaaaaattatttgagttggtcaagaagagctttattgattttgaagacaaaggggttagaaggatatgttaccggagagataaaggagcctgagaacatatcaagtgttgaatggaagacttggagtactaccaactcgttagtagtagcatggttattaacctcacttatccctgctattgctacaactgttgagaccatttctagtgcaagtgagatgtggaaaactcttactaatctctactcaggagaaggaaatgtgatgttaatggtggaggcacaagagaagataagtgttttgagacagggggagcgttctgttgcagaatatgttgctgaattgaagcatttgtggtctgatttggatcattatgatcctcttgggttagagcaccctgattgtatagcaaaaatgagaaaatggattgagcgtagaagggtcattgagttcttgaagggcttaaattcggagtttgaaggaagaagggatgcaatgtttcatcaaaccacccttcctagcttggatgaggctattgcagctatggcacaggaggagcttaagaagaaagtattgcctagtgccacaccatcttcaccaagccccacctatgtagttgcacaaagtaaagagaccagggagtgcttcaattgtggtgaaatggggcaccttatacgtgattatcgcgctcctcgcaagcctagttatgggagaggaagatttggtgataggggtggagcaagaggtggaagaggttatgcaggtagaggtaacagaggtagaggctatgagtatagaagtgatcacagagctaatgtggtcacgcttgaagagagttgttctggatctacaaatgttgatgttgccaatcttgttcattcttcctcaggtaactcaaaccaagcatttatgtctatcaatagttctcattcaaattggatacttgactcgggtgcatctagacatgtcacgggtatgtgtggagaatttgcatcatataaaccatacccatttacacgaaaagaaacaattcaaactgctgatgggacatcatgcccagttaagggagagggtacagtacagtgtactccttcaatcactttatcatcagtgttatatgtcccttcttttccagtgaatttggtttcgataagttctcttgttgatcatatgaattgtcgggtctcccttgatcgtgagaattgtttaattcaggagagggaaacagggaagaaacttgggattggcgtcaggcgtgatggactttggtatttggatcgaaaggagacaagtgaagatgtatgtcttgcattgatggctcctacaagtgaagaagaggctaaggtattacttttgcattgtcgactggggcacatatcttttgaaactatgagtaagatgttcccagcagaactaagtagagtggataaacataagttagtatgtgatgcatgtgagtatggaaaacatacaagaacatcatatgtgagtagaggactccgaagtatgttaccatttatgctaattcactcagatgtttggacttcacctgtggtctctatgagtggaatgaagtattttgttacctttattgattgctactctcgcatgacatggttatatcttataagacataaggatgaggtgcttaaatgtttttaaattttctaggcaaccattaaaattcattttaatgctcggggtccagtttattagaattgataatggaggggagtatataaacaatgaatttagtagctttctttcatcagaaggaatattgcatcaaacttcttgtcctgatactcctccacaaaatggggtggctgagaggaaaaaccgtcatctcttagagacagcccgctcattgatgtgtgcgatgaatgtacctaaattcttgtggagtgaggcagtaatgacagcaacttatcttatcaaccgcacaccatcaagaatacttggaatgaagacaccatgtgagatgatatttggaaagaatgaatttgttgttccaccaaaagtgtttggttgcacttgttttgttagagatcatagaccttccattggaaaacttgatcctcgggctgtcaaatgcatctttgtaggctattcatctggccagaaggggtataagtgttggagtccatcagaacgacgaacctttgtaagtatggatgttacttttagagaatctgtcccattctatggtgagaagacagatttaagttctttattcattgatcttgatgattcaactagtggtcatgatggtcaccaaatgaaagatgaaatattgggtccaaagggagatgaacaaccaaagaaggaaaagcttgtggttggttcaattccatgtcccatgggtggtcctgttgcacaggagcaagaatggaagaagccacatgaagagaaaaatcttcaagtatacacaaggagaacaaggtgtccagtaatccaacaagttgaagaggataatcaggtagaggaagatgtaagccgtgagcaaggatctttggagtcagggggagaagaagaggaagttagagaagaatctgacttaccaattgccattagaaagagtgtgagaagcaatgcaggtaaacctccactaaggtatggttttgaagctcaagatgagggtgatgatgaaaataatatatccaactatgtttcctatgactccttgtcatccacatataaggcctttatagcatcactagattcagtgcaaatcccaaaggattggagagaagcaaagcaagatccaaggtggcatcaagctatgctagatgaactagaggctcttgaaaagaacaaaacatgggatcttgtaccatttcctaaagggaagaaaattgtcaactgtaagtgggtttatacagtaaagcaaaatcctgatggaaaggtggaaagatacaaagcaaggttggtggctaagggatatagtcaaacatatggaattgattatgatgaaacttttgcaccagtagcaaagatgagcacggtaagaactcttatatcttgtgcagctaattttgattggccattgcatcagttagatgtcaagaatgcattcttacatagagatcttcaagaagaggtgtatatggatgtcccacctggatttgccacttcacaaactaaaggaaaggtgttgagattgaagaaatctttgtatggtcttaaacagtcaccaagagcatggtttgatcggtttaggcgtgcaatgtgtgctatggactataagcaatgtaatggagatcatacagttttctatcatcatagtggagatcatataaccattcttgctgtctatgttgatgatatgattatcactggaaatgattgcttggagataactaggttgaaacggaatctaagcaaagaatttgaggtcaaggacctaggccagttgagatattttctgggtattgaaattgcaagatctcctagagggatagttatttcacagcgaaaatatgtattggacttgcttagtgaaacaggtatgcttggatgttgcccagtctctacaccattgatcaaaatcataagttatgtgcggagtctggagatccagtgaatagggaaagataccaaagattggtgggaagactgatatatctatgtcatacacgacctgacataacatatgctgtcagtatggtgagtcgatatatgcatgatccaagaagtagtcatatggaggcggtgtatagaatcttgagatatctgaagggaagtccaggcaaaggcttatggttcaagaaaaatggacatcttaagatagaagggtattgtgatgcagattgggctagctgtcttgatgatagaaggtcaacttcaggctattgtgtttatgttggtggcaacttggtatcttggagaagcaagaaacaatccgtagtgtctcgctcaactgctgaagcagaatacagggcaatggcagcgagtttaagtgagttgttgtggttaagaaatcttctagttgagctgaaaattttggggaacactcccatgaagctattgtgtgataataagtcagctattaacattgctaataatccagtccaacatgatagaacaaagcatgtggagatagatcgtttctttatcaaggaaaaattggacgagggagtgttggaattaggatttgtaacgtctggtggacaagttgctgattgtttaacaaagggcttaggtgttaaagagtgtaattgttcatgtgacaagatgggtatgatagatatctatcacccatcttgagggggagtgttgggctgtaaatagactagttatgtgtgtgtgtcttgtgtgctagcccatctattgaagagggcccatcccatgtatatgtaagtgagaatggcaatagagaaagtgaagcttccagagaaaaaatcacaagacttcaagaagaggcaacacctttaaacttacctctccatctgttcctcgtactgtgacacgatatatcactgtcactttcccattgtcagtgtaaataacatcacggacctctccacaccagcctgatgtttccaaaaaaaacagtgataatatgagtggaaatccaagaacggtgtaaaagactgaagagttggcatgaccagtgcatttcaagtagataaaggatagatcaagcaaggaaatgtgactatcatccactggaaatgattaaaggtgttaaatttggtagtcgttggagtatttcaacagacataggacaggtagagcaagtaaatgttgacaatcatcagaaggaaacaattataagttgaaatgagagagaattcagcatcccggaagctgcatatgcaggttatgtgtacaaaacacactacttattcagcacctggaagcagcatttgcaagttatgcgtacaaaatacacttattcatcatgacagcatcctttaagctgcctataaaggttatgtgtacagtacacactacatattcagcatcctgaaagctacatatgcaggttatgtgtaccaacacacactacttatttagcatcctgaaaacggcatatgcagtttatgtgtacaacacacggtacttattcagcatcctggaagctagtacatatgtaggttatgtatacaacacatactacttatgtaactttatttgctcatgttgctttcaaaagagcaagcacagaaggggtgaaccagtgactggcatcgattttgtgattacaaattaatgttcagcaccgttagctcggtattagattcaggtatagagtacacgagatatgcttacctggagcatnnnnnnnnnnnnnnnnnnnnnnnnnnnnnnnnnnnnnnnnnnnnnnnnnnnnnnnnnnnnnnnnnnnnnnnn

SEQ ID NO: 12747 - DNA, 156 bp, Oryza sativa
cctgtgatgaatgctaatccgggaagaagaagaagaagaagcagggattgatcgccgattggccgtcgctgtcgatcggtcgatggtgaggtccaaatcagcgtcgttatccgccgcacctccatctccatgcacacacaggaatcgacaggtttg

SEQ ID NO: 12748 - DNA, 994 bp, Oryza sativa
ctttctaagtgaaatgatacttacttccgccgcatcagcttctccttgtagtagttcttcttggacgacatcttgtccaataagccctagaagccggcggtgcgcagggtcagcgacagggcaatgaaaccgacgtggttaggaggcggcagcgcgtagccgccggagacgaggcaagctcatgggcaagggggcttctcgctggcgctgaagtagacgagacgacgacgacgacgggggaaagcggtgcggcggcagagaagagaggtgggggagcgcagcgccgcggcggcttggaaggcgagtgcgtggaggagggagagggaaacgcgcgaggttggccgcggcggcgcaggagtagcaaacggtagtggatgggagccgaggcgggtcggagggaggtggggaaggaagtccgtatgatttgcgcttgggccggccgcgagcctgtggatgagatgggctattgggccctttcatctccaaagaaatcggcccgctatccgaacgaacggaggattcgttcgcgcgtttgtttggaaaattgcctcctcctcctcccatctgccttcccttgtcgatcgcacatcacccccacgaaatcagctgtcatccgacgacgaggaggagatcaaccaccaccccacgcacgccacatctccacccaccaacgcggctgcctcctcctccgcctacaggcgcgctggattggacaatattccccgcctcgactcctcgagccatccagggcctgtgtgaggtgacggtggccggcgcgagagaagtcgagtgtgccgtgtgtctgcaggatttcgtggcggtggacaagctcaggatgatgccctgctgccacaccttccaccagcgctgcatcttcgactggctccggctggcggctgcgatgcatctgctctctctgccgccgccccctctgcccacacagcacaacaggaggatgataagattgggtgcccggagccagggggctgcagga

SEQ ID NO: 12749 - DNA, 1299 bp, Oryza sativa
gtaactggtttaattattattcaccagctctccttccatatatgatcatacaatagtttagaagcagaacacaagcatcatcggtatgtaaagtaagagaaattttacggttggagcatatcttgtggtagataaagtttacaccagaattttgatacttgaggatactaataaagtatcttgagataccaaatcttacgctaaataatatattacctttatatgcttaccaaagatgataaaattacctataaattaaacgtaagaatttcttaagaaatctttaggtagctaaagtttacacttcaaattttaatgttaaagataccaaattttacattagaaaattgtatattacttctatatacttactaagtgttaagaatgataaaattacgcgtaaattaaactgaagaatttcttaagaagattgatcgatgggagctgcagtttgcattttgacagccgaaatattaccgtcggatagaaacgagtttaccgtgcatcagaatcggttgcttgatcagtagagagagctgctctctgatgagctcgtgagaaagcatggaaatttttggctgctggaacggctgagcttgatggaggagaggaggcgacaggggtcacatggcatctgctgcctcgggtggcccccgcacatgccattttgctgctgccctgccccacagtaccttcaacctccacaattgcccgttttacatgtcagtttttacggcgttgtaataatgcgctgtaactcgtcaccgcattaaaaatttggttaaaattaggatgatatgacgaaaaagttagaagtttgtgtgtgtagaaatatttcgatgtgatggaaaagttgaaagtttgaagaaaaattttgtaactaaactcggtcgaaaggaaaagaacgtgggactatctattaatcttctgatagattcaggggtttaaatcttattcaatttttaattaatagataaaattcgttttgaatgaataaaaaaacatgttaaaaatcgtaaattcagagaaaaaacagtcataaaatctaatttcgatatattgtaattgagtgtaagtgctttataattaagtctaattgtaagttgaatctacatgaaaacgaatcttgatgtaagattatacatatgaaaattaaaatgataggagtaaaaaaaaatctatcttaagtgaaataacaaaaccaaaaagagcattcggtattagaccctgtttagatcccaccgcaaaaactttcaccttgtaacatcgaacgtttgaatacctgcatggagtattaaa

SEQ ID NO: 12750 - DNA, 1978 bp, Oryza sativa
tttttgagttccagattctatgtagtagtatggtgtcatgaatttttgtaatcaaaacaaacgactgaagtcgttgttcttgcagttaattttatagccaccttgttagacagtgattagggtctaaagaatcatgcaagtgacctgactcactgaaccatcccacttaactagatctttcgttcactttcaatacactgccttgcattactataaaaagaaaataattaggtgcagtggtgatttctttaccaatctgaaaaaaattacccgactgcccttatgtaatgtctgtattgtagacttgtagtagtactagtcttctatatcatattttgttgtaggagtatatacatatcacaagctgttgatccagaagaacagcgtttaaatggtaaacactaaagtgctaaaccaaggaagttttggaaatctaggattcatgctctccttacacttaggggaagtggctattggtactcagatccattgtagtcataggaggataatccatgcccttttggctgcatttcaagtcaagtttgcagaatctgtaatcatgtcaaagcaggaagtgataaactgattgattaatagaaatcttcttcttcgacctagaatgagtttttgcacacccgtgggtctggctaaaccagagactaaacctggccacctaagtaccagttttttgtgcacttaataaaaatccccattttttttactggtgtggccctgacaccctgtcatctcttgcactgctccactaggatgggaaccccccactgataaatcagatgcaactaaaactacttccggcattttagggttttagggagcaagtcaatttggctaacctaattctcccttattttcccatgcagagaggagaaaaaggaagaaccagagacacctaggtatcgagatcgtgctaaggagtgccgtgaagatcaaaaccttgactatgaacctacagagcttggttcatttcatgctgtggcacctcccggagcagatttaaggtaacagaccacaggtctcatttggctgacattttctttgcttggtttattatatgctcttctggaactcaacgtctgcaatttttcgtattacaggctagcagatgtacacaagatatctattgagaaaagcaaatatcttggaggttggtagtgcaacagtgttatactctttccttgtaagaaaatgcttttcatccttttgggaacaatttatgttgtgacttgtttttttaaacacttcatttatgtatagacaaatgctcatagatctgcacaaacggttaaaattctaacatagtttggttatgacatctgtggaaatgagaatttgaatctttctttggaactgttttatgtccacaaacttgtcgcggtttcaaatagctgcttgatttttaggttcctttttaatttgaaatatatagagctatcatatacttggtattttgacctagtcagtcagtagtatgcagtcaaggaatgaggttcgatagctcaaaactaaaggtggatagttcagttggacatgttttttaagactatgatatattgttgtagatttggagacttagatggctggcactttttctttaacttttttttgtctttcttctgaactatcatgttgattgatatttaatttcactttgtgtcttaaaggtgatttggaacatacacatttggtcaaaggtttggactatgctctacttcacaaagtacgaagtgaaatagaaaagaagcctgatgcagaggatgggaaggatacacagacaaggtatttcccacaatactgcagttttagtttcataccatttgatcatacctttttcctggtagttttgtactccctccatcccaggtaaaactgaatcctagaagcccaatgcagttttagtccaagcaacaaaagaccaaaacaccctcatcaagtacaaccatgattagcacttttcata

SEQ ID NO: 12751 - DNA, 5281 bp, Oryza sativa
aatactgtcgggcagaattattctgtgcattggaattatttataattttgctatgctttatagtggccgctggatcattctcagttaaacatgatttcctgtacagtattaaatctggatttgtattatcttaaaaaaatcaggactgtcattggaataatacaataattgtttataagcatttcatgatttgggatgtagcactatgaagtttggcctcatgtccttcatccttgtctggatgcacatcgtaagttagtatttaactaggatacacatatttgatatttaacctgtgaacttgtgttgtacaggtcaacaaaagaagatcaggcagtctcattccgcactgcaactgcaaaggtggatttccttttaatttataaaagaattggtgtttgcttcttctattatcgaccatgtaatggacactaaaagcaattattggttcattgcagtctgtctataaatggatcataaagccacaaagcatcataaagtagaatgaaatgtttcttcctggtcggatggcatttatttacaacatggtacctccttcaaagttccccattttagtgctttctgtatgttaattacttttatttttgtggtggtggtgaccattttccttaataaaatgatatgtatattattttattttcatcactcatcagaattcatccgtactaaacatgatgctactattttgtaaaaaaacgttattgttatttcaatttctaatttgtcaactctatgctatgttatcagctaatttgtcaatttctactattttatcagcttttataatatgcgtgatgcatgcctatgtttcatgatatattattgtctgtttctctgctcatcatctggagtacagtaatcaacatgctcaagctctcaattaacttcgcaatatgcaaacaagagaagaaagagaggaaggatgaaaaaaactcttccaatattatattaatagactatatagtattgctgttacatgcttacatatctgcaatgatttttatgttgtgcacatttaaattgtgattgtgatgcatcacagcttcaatgattactatatgcagaaccttcattatgaccacaatccaacttacatgtctgaattcatcactagatcatatttttgatgctaatggtttcatttgctggattcacccttccaaatgattttctgagagtaagagtaatggtgtttcatcacctattctcatcatctcgtagcatgtccagtactattgattgatgctatttgcaaataattttttccatcattcctgctttgatttgaactatgggttttagcggaagagtaattaatttcattaatgaaaccaggaggatggacttaccaatgatatcccaacaactcttcacaggagcaaagctgattgcgctgttccagaggtattatggcaatacatcatataccacattgaagtttcccgaaacttatcattttcctcagtattcttcttgcttctgcaggagatggtaactgtcagtgtggatggttctgtacttgataggattgctaaaatcatgtcataccttcgacttggatcatctgggaaagtcttgaagaaaaagaaaaaggagagggacacaaaaggtatgttacttgaaaattgaaatggattttgtgcagtggaagttgactgaaaaactaagtgacatcaggaaaatataaaatgatttgtttggaagctgagcacttacattgtgaaaaaatagaaaagtattatttggtactttttgccacaatggttgagtcttgttacaattgatttatagtcttctgtcaataatttaagtttgggtatttaagttatgaccatatgttacacgtttactttagattctgaacggattaattagttcacttaatgtatttgcatgtatgtactctctcatccatatctgcacttgctttgctcgatgaaattagattatcctgattcttgttatgcttgttatattgcagggaataacagtttagcaagtggtgactatgatgaggtagccagacctggccaaacaggttcttctctgaaacatcaatttcaaaaggacatgccgccgccgccaccccctcgaaataataacttaagcaagaatgaggaacagtctattcctgttgctagagcagatgaagatgacatttttgttggagatggagttgactattctgttcctaacaaggaaatgagccatagccctgtctctgaagatatggatgagtccccacataaccatcaaaagcagtcctatttcactgaagagaaacctgtctatgggcccatcccaccatcggaccctgctcaagcttggccacaaacggtaatccagctagtgtttagtaactccggttccattgtgcttaaagtaaaatttgaggctatgcatgtccaatgttcaagacaaactaaattttttttttgcccatagttgtaccttctactgaaatagccattgaattattaggtatgtctctatctcttgacctgctatttcctaaaagtcaatgcgctcttatgatttcagaatggatacgatgctattcaaggctcaaatggtagctgctggatatcaaggggagtggtcaggctatcagtatggtgaacaacagatgccttatccagaacagtacatgcaacaaagcactcaggactatgatgtattagctgatccaaatatagcccaggatccaaggttgatgactcaagcagataaagatagaggtcttggttctgttttcaaacgtgatgatgaaaggcttaagcagctgagggaaaaagattcacgggagaaagatcctaattttatctcagatagttactccgagtgttatcctggttatcaggagtataatcatgagattgcaggcagcgatgaagaagatgatttgtcgaagatggacatgggtggccgggtaagtgagagtactgtattctgaatgctttttttttcctgtttcccttcacaatagcagacataacttgcttttgcggaattcttgagctcatgtttactgtactttttaaaaaatattttaccatctatttccaaattcgttataatatatttttcttttatgtaagaaggtagagccagctctacctcatagccatttcattgatagaaatgaacggttacagagttgcctgaagaaaggtgaagcaggaaaaaaagaaaaaaaagggaaaggagatagaaggaggaaaatatacaaaaaattacaagaagctaaaattacattaacctcatctgattgtctcagaccagagattgatttttgctctggtgttgggattggcccggttactccatagttctagagcatcgatgatttgttgaattatgtctgaaataccagtttgccatctttaaaaaatcctgctgtttcttgatttccaaagtgtgtgcataggctgcaaaccaagtgggttctatgccctgattgttatgatagctgacagtaactttctccaagaaatttggggctgactctgccaaattacatagatgtaaaagtccaaatttctcctataagcttgtagctgccttgcatctcttaggatgatatggtccttgattgactctgccaaattcattctaatgtatgatactatgattcctttgcaggctaaggggcgtcttcataggtgggactttgagacggaagaggagtgggccaaatacaacgaccagaaggaagcgatgccgaaagctgcattccagtttggagtgaagatgcaggatggcaggaagacgaggaagcagaacaaggaccagaagctcacgaatgacctacacaagattaacaagatacttgcgaggaagaaaggtgacaaagatggaggggatgatggtgggcattatgatgatgatctacctagtggcaagaagcagcgcgcctgatgcaagccactaatagtttatcctgcgagaggtgtaaaaatgtatttgtactaggaattacagcgccatgaacaaacgacagttgtaatgttcagcgttttggccggtgcagaagggaataagaatggggagctggaacggtgaaaatatgtagtttgtccatttttataacagaacaatcggtaatttgctttgttctactatgaaaagagaaaacatcaacgaatgcccaattttctgacaatgtacgcgttaagtcatatcctttaaaatggaaaagtgatttcatccctcgaggggatatcccctcatttcgtgcatgccacctaagggtgtgtttagttcgcgaaaaaaaaaatttttgggtgtcacatcggacatttagccagatgtcggaaggggttttcggacacgaatgaaaaaactggttctaggactggtagccatcctccagggcctgcttacctgagcatctccgcgctggcttcgactccctggtgctcctagtctcttggcaactgtggaaggaacataaccatatgtggcttggtcatatgtggctttagctagtattgctgcttttgggaacttgtcaggagtgtagcgtggctcggcccattctcgttgtttggagtttgtgtttagccgccgtagttttctaagcttcagccttttattttgcattttctcccttcctctggcataagccggtctggctgattgtgttgtgtaactataattgttttcttctaatatattgacgtgcaatccttctgcacgttcgcgaaaaaagtatttcacatcaacctgttaactgaacatcttagtgtcagactcggatgaggaacagcgaggatacgatccgtatggtttcatccacaaaatgctcacactgtaatgcagaggcaattagcgcccaattatctttcatgctgcgagtttgcattccacatttggaaaaactttccagggttgctttgcctaaccaccctctgattaacactcacctagtgcctaattcttttgcccttcatgacaacctaaaccccagcttcagagttggcacaaacgagtcttctccctacacgtaccagaatgccatttcccagctagtatatgcacggtaatttggcacgtgcaacctctgcaatataatcatccgaattccatcacgtagatttctgatttatcacatattttcacacgtgcgaagcatgccggaattcattttctacgcacgtttttgatttttttttttcatttttaaatttatttttttaatatttacagaaatattatatcagcggaaagatttacaaaaatggaccttgccgccctccat

SEQ ID NO: 12752 - DNA, 932 bp, Oryza sativa
  unsure (1)..(932): unsure at all n locations
aattaggctcacatttcggtacggcccatttgtccattcggcccatgtccaacacgccccacggccctctaaaactcacgtgctaaaaatagcccaattcgaaaatttccccacggcgtcgtcgcctccgccggcgaggtgggagatgaatctctccgctaccttccgatcggcgaagatccctcgcgctcttcctcccaaatccggcgagcccgccgccgccgccttggcctcggcctcgtgcgcgcccgggaatccgtcggcggaggccgcgaaggggaaggcggcgttgggctggtgcgtctacctcatcgcctcctcccggatctcccgcacctacgtcggcgtcaccaccgatttccctcgccggtgattccccgaatccctttgattcactgtttctagagctgtttcagaagattctgtgggttatggtggctccgccagttagtgattgaaatactgcccccaatttatcgctattgttttgttaacactatgagatgtgatattaggcctgaaagttacatgattcggatgacaattggactgaaatccttgcgattttcatatatttagtacttttttaggacttgggaaaacaaatgaagctcaggttattgttcagtccctttagtgaagataattgaacatggattgattcctttcaaaaaaaaatgagcatggattaaaccttaatttgttctacttttagcaatgtatgttaaacatgcataatattttctactgaataagctgttgcctgctcttgtttctacctatcttcaatttatgacgctgtgatttacaagcagaactgtgttactcgttgggcataccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12753 - DNA, 544 bp, Oryza sativa
actggttgactgatcctgagcatctctcatctcaaccatgatgatgacgatcacctgtgacctgatgagcttcttcctccttgactcctggttggttcactttgttgaacaacagaatgaccagaagcagcagcaggaggaggaagaaagcaaaccggacactggagacctcacatcaccgagcagctgtttgggttctcgtcgctgaagtagttgtagggatcggcatgcgggtggggctgcatcgggtagtgcatcgggtacggcatcggcggccggccgtacccgtaccccatcgccgggtaccccgccggagcagcgccgccgccgtggccatggtgaccgtggtggtggccatggccgtggtggccgtggccgttcatcatcatctgctgctgctgctgctgcatcatggccatgtactgctgctgggccatggggttgccggccgccgccgcggcctgcagcatctctgggccggacggcatgccgccgccaccgccgccgccgccgccctggtagaacgccggcgttggcatgccct

SEQ ID NO: 12754 - DNA, 7047 bp, Oryza sativa
ccagggcctattaacctgagcatctccgcgcaagcttcgactccctggagctccttgtctcttggcagctgtggaatgaacggaactctaaggttttcgactttgcactattttcagtcaccgtggttctggagtccatccactcggagggtcatatgtggtctttagctggtgtagccgctttttgggacttgttaggagtgtagcgtggctcagcccttcccgctacttggagtttgtgtttagccgccgtagttttctagcttcagttttttatttcgctttttctcccttcccttggcataaactggtctggttaattgcgttgtgtaactataacttttttcttctaatatattaacgtgcaatcttttcgcacgttcgcgaaaaaaaaactgtaaatacgagcattgcatcggtatactctcgatatttgagaatcggtacctatttaaacatttcgaagacaatctaaaactgcacccttcgaggaagaaaaaggcatcaaagtaaaagaagaacattttattacttggcgaatggggatgtgtgctgaacaagtaaaatatctgcccaagaggccaaaatggccgttgagcgttttcctggcttgcgtgttgttcacaataaatcgcaataaatcaaataaaaataaaactgcacacgatgcatcatccgtcaccatcttcacacctcactaattcattacatgcgtttgtttttctctttttatcatcaatatagctaaccggtctccgtgcacacaatattttctctagaaatttctaggttccgtttcttgtaatctcacatccattaattccataaatccccaattgtccatatatactagcaacagaaagttcagacttttgtttcagaaaaggccataaagttactcattttaatttctccagggaaagaaaaagtaacaaagctctaacttcccgtgtcaaatatgtgcaccaatacccacagattatacaagacatgattagcaccggtaaaaagtgggcattgacacgtccaaatgcacgagaagtttgtactttttttgttgctgttttgtttcgtctatgcaaaaaccaaaaataaaaaggaatttgtacaactgaaatgatgatgaaccacaagaaaagaaaaacattggtgtggtccccacgtaattagcaaaaaaaaaagaaggaaaaaaaacaaaggctttgtggctatttaagccgcttcttctcctccatttctccatccatccatccatgtcgtgttgttagcttcgttttcttcttgtttcatcaatccaaggagtgtggaaggccacacgccaagattatatctatgctaatttgattagcagtaggattaattcagtggctagcgtagcttgattagttggtttaattagttggagagtaaagaagatgttgggagtgttcagcggcgacgtggtggaggtgccggcggagctggtggccgccggcagccggacgccgtcgccgaagacgcgggcgtcggagctggtcagccgcttcctcggcggcgccgagccggccgtgtccgtgcagctcggcgacctcggccacctcgcctactcccatgccaaccaagccctcctccgcccaaggtactaatcatcctgttcctctgaataatacagcttttgattaattgtagctgaatttgcttaagttctactgttcttcaccatggatttctcaagatctaaccaaggacagaatcagtgattgctttcatgtgttcttcctgagtcagagtcatttactatatgcttttactctttggttagtgaagtcttctttagctagtgatgatcaactgatcatgtcataatagctctcaatattttattttattttaaaggggactcccaaatcccaagatccgagtgtctgactaaatcagagaaaaaatagtttcttatcgtaacactttgctgattgtttcgaagggaaaaaaatcacggggttggtaaaacatatgcttagaatgagcgggtgtttgggatgtggtacccatctggggaaaaaaatgatttcatctcaagtaattcagtaacttaaacaggcttttaccacaaaaaaaaacacaaaatggtttttttttctgggtacggcacacatcttgagtcaataattgggcagtttttctcctcatataaaggcaggtttgctttcgtaagacaaactgaacaataaatacaactccataatccatttctgtaggttgaggggccaagctaccaaacctcatattcagttcatagattctcatccgaattatgggtcgcatgtctgagatgataattacatgattaactatggtatagatttgtttgtttcagaagtagaatgctaaacaaagaagaatatgcagagattttttgagaactaaatgcacaaaagtaactatcaaaaatagtagttttgccttggtgctacgatatctgaatctttcttgccatggcactccggtaactaggactctcttgccacgtgttacggtatcctggcatcaaatggttggtgccttggtataaaaaacgagagcagaagaagacatgaaagaaaaaatataatcaaaatgtctatgtcgatgtggacatcatcacatatcaatggaagaagtccacatcatgccaccttccacaaacaaggtgttaattgacctaacaacgaacaagaacttatattcttcactaggaatctaatggtatttcaatgtattagatatagtttaagaaaagggataggccaggatgatctatttccaagtctttcaaaagaaaaaggagacaagatagtgttggttgttggacaacttactaggttgcttatgaaaacctctcttgatttatgcatttacctggtattattgtgctgttcacatggcccagttcatagtagagggcactaactttgcaatcagttgctaataccagaagtctatccagttttgatacccacagatctgaaaggaaaaggctggactaggtgacccatatggtcaatcaatccaccactatgatttgtgggcctggttagctctttgttcatatcgttactctagtgactacgcacagattcagctgtaagaagtagctatccaaggcaattccactccattgctccaatttttccagtacaagcatctttgtccttattgtaactagtagtagtacaatcttcaatgtagtacaattcaatgttaggtacatcttacccagatcaaatcattgatgttgcacctaattcttttcactctccaattattcttaaagagtagaaatgctgagcactaatcaagcatactaatgctgttcctgaatgccgatatatgttcttttctcctatgttactattaagatgcatgcatcataatacagtagttatgtccttttcctttctgtaaaaacctttattcctcttaatacaaagatacacaaatcttttgcctattcctgaaaaacagtagctggttgagtaacatatgcagctgtcttgatttgtgcaggtcatttgcagcaaaagatgacatcttctgcctgttcgagggagtcctggacaatcttggcaacctgaaccagcagtatggtctgtccaagggtgccaatgaggtgctccttgtgatcgaggcgtacaagacgctgagagacagagcaccttaccctgctagcttcatgctctcgcagctcgccggcagctacgcctttgtgctcttcgacaagtccacctccaccctccttgtggcctctgtaagttttgttcatcactgaatgctgttgctgcatcacttcacttgcattgtcagtgcctgaagatttggttgattttggttacagattatgacgtgttcttgtgctgtgatttgctttttcaggatccggagggaaaggtgtctctgtattgggggattactgctgatggatctgttgccttctctgacaacattgacctgcttaaaggatcgtgtggcaagtctcttgcacctttcccacaaggtaatgtttaaactttgaacagtaatgcagcgacgaaagatgaagcatttactataaaatttgatctctaactattgatttagttaggcacaattgaccttttctttgtttctgttcactaattcatttcggttgcaggctgcttctattccaatgctcttggagttggaggcttgaagtgctatgagaacccaaagcacaaggtgaccgcagttcctgccaaagaagaagaaatttgcggtgcaaccttcaaggtaaaaaaataataataataattgatggcaacctaaatacttaactgaatacattgtaaccgactgatgtcaaatggtgttttcaaccctttcttgggtcgatgtgcatctcttctttatcaatgaaatgaggcagagcttctgcctttgttcaaaaaaaaaaaacattgtaactgactattttctcctgcatttcgtctgaactcaatagacatttttgggtgcactgttaattaacacttttgatttgatatatgcaggtggaaggatctacaatcctcacagcgctgcattaggagatttttggatctccagctgttgttgggaaaggaaaactctgtagtctgtaaatggtggtgtaacatagtcgcaaggcatgcatctgatctgtatcatcatcttccgtaaagactagtgctgccagcatggttagcacttttcagtgtttgggtgtgtgtatgatctgtatcctatgctgttcaggcggaaatgaacttcaggcccagctgtgtcagttgaatgtagttgtgttgcaaataagtttttcttgtttgttatcactgtgattgtgtcttatgcagttatgcttgttgccggatactattcataccacaaccttaaccactcctattttaacaaaaatattttaaatgtttaaaaatgtattatattattgaaatatgttacatgctaaaaattttctttacataatgatatgatctagtagtaccacctaggaataatatgatcttaccatagccatgtaagtacaccaaaccagatttacttccatattgggcattcaaacaacaagtaatttatggtttccagattccggaaacatagctggtagaaataattatttgaccatcccttaagttgcaaacgatctattgtccatacccgattttgtagcgcaagccaactaaatatctgcattttgctagaacccacgccttccaaatcaactctgcggatggcgacgctatcattccgttgaattgaaactgataagcggattttgtgctatacttcccattggctgtccttttctaaaccatagagttctctactacatctgtcaattctaaagattcatgcgttcgagcccctcatacttgaaagaactctctgagttaaggttgtgacatatgtcatttacccaccttcttgttgcaagggctcctggattgtgtggtcttcctcttggtgcttctgtagaggtctggagctaagttttgaggctttgaacactaatccaatttgatttccaaagatcgcttttcactcatcactatccagtactttggtcgatgctgcaaacaaatttcgaaaaattataggtcaggttgacacgagaactgggccagctcttagtcggcacagaagctttttgggccgcagaaatattttcgtgggcctgattcgccgatcaaagcctagcagaaatttggttgggctggtatatatggaccgctacatccaaattcatgtgagccaacatggcccgcaccttccatcaggcccatactggaataaaacccaagtgaaacaatgggcttttctcaaccagccaaactcgggggaggaggctatgtgggctgtaaggtggccggacagtggacgaatcgggctttaatttgtcaaatgtcgttcatgcaaataggctacagcccttacatgcttccacaccaaaaagaaaaaagaaaaaaagagagagaaaatttagagggagagacattcctccaaacaatttttaacaagaaaaattgtaaacgtgttagagattgaatatgagacttcgatattgaaaccacacatctcttgtcaccaggctttactaaatcatttgggatggggttactaccacctcacgatttgatggttaccgtgctaaccgcgcaattactatgaaaaccgcacggttaacgcgatgtataccgtgattttaaaaactaaaaaggttaccgtacgtgacaaccacgataactatacggttttgtaaaccttacatgtcaccgtactatcatgcttccacgctttctgatgttcgaaaggagcaaaaattttcttcattttctaaacaaaggcagaacccatgcttcattttatattggtaaagaagaaatacacacgaacacagaaagcgttcacgccgaaaacacaccatcggaacttcggaagaagcagaaatttcacccctgaattggagtagtactcttattgatcaaacaaacagagaaaatcgaacgtgagaatggattaccggaaatactagcaaaagctgcgacgaaattttcggtgaatgaaagaaatgatgttcttgatcgacccagctgggctgaatgctcaagtagccgaagatcgtcagcgaaatgggtcgacaccattgtgcacttgcctgcaggttccaatgttcagtaggcctccaaaatatctagccttttgatattctgatctctgaataataccatccccgctttctgacgtctattcaccaccatcagaaatttcctttttgaaagatccagattagtataaatcctctccttgtcttgaaagatccggatcagaaaattctcttttcagttcattattccatacctgccgaatctcaaatctgtgcttagattcagcgtaaatttttttaccgtgtaaaatcggatatacggacacacatttaaagtattaaacatagtctaataaaaacaaattaccgattccaccgatagatatttactacgagatgaatttattaagcttaattaatccggcattagc

SEQ ID NO: 12755 - DNA, 2309 bp, Oryza sativa
ggtgtaaactttatctaccacaagatatgctccaaccgtaaaatttctcttactttacataccgatgatgtttgtgttctgcttctaaactattgtatgatcatatatggaaggagagctggtgaataataattaaaccagttactagctagctaaactgaagacaaaacaaaagggaaaagatcattgcgtgcaggaaggttcggattattctagcagagtgctctttttactctaaagcagcagtagtagttagttaaagacagccttttctttttctccttctagatcgtgagaatgtgatcagatatattcatatacgtagacatcactttgcaaagtgcagtagcttaaagtatgctaattaagcggcagcatggaggcataatttgctcgatcagtgataggctgatagcacgtgatcgatgctagtcgccatgatttctggtgagttgattactccacactaatactgctgctcaatagtggtttgttcaggctgattgtactgagtacgtactctctctgtttaaaacaaaatcaatctagataaaacgtaggaaaatgaattataaggttatctaaatttattgtgtattgttacatccaaacctactcatgtaggttaatttttttagatagagggaatagtctgttcatattgcttgtattagtagactatagtaagtactttcttttgtgtatagagtagggttctatgtcggctgtaagggttgggttttgagcaatcccggctgtacattctttcttgccctaacggtggccagtcacgcttagcgacggccggtccggtgctagccttctccagggtctgtgtgttggtgttgtcggtgcgtgggtggtggtataattttctttgttttcaggttacaactgaacgcgcaaagatgtagcctagaggggggagtgaataggctttcctgaaattcacaaacaaatcgcagcggtaaaattcagcaggaccaaaacttccgggtgtggaataccggaacttccagtctgctcagattgtccggaacttccgagcaaagaaaaacctgaagatctagcagagacttaaactaatttgcatgaattaaactacaggaagacagagcagatacacaatcacagcagcatgcacagaatcatcacagagaagacaaggggaattttttcccgaagttcggatctttcaattctactctccgttgagatgctccaaagagccgggtctcgattaaccccctgcctcacctgtgcaaagaacccagaagaagtccaaggccttaaacaaaacactcctaggtcattttctagaatttgaatgaccaccaagatccaactcacaaatacttctagaaaataccacaagtgcaagttgttctaccaaggagaacctctgaaatctttgcacaagaatctttactcacttacctcgtttccttgcggaggtgaggaaaaccttcaccaactttcccgggacatccacaagattttggaagctcgcgggcaacacctatccgtctaggagaagatcttcaagagtaataagcccaagtgacaacccacaagatatccaaagtactcaaccatacctagtcttcaaaccttctccaaatcactcctacactctcatctattctctcaatctcacaagaatggctttagatttgagtggaggaagcaaagggatcttgggagaggctagaacaacctaggggatgaaagaactgaagtggaatagccaaaaagtgagctgggtgcgatctggatatatataatggctaggtgacgtctagccgttactcacatttttgaactggaagaagtccggaagttcctgaccctcggaacttccggccaacacttaggcaagtttcattcaatgcaatgtcagggaccggaacttctggccagccttctctgtccggtctggacccatttgcaaaaatggctcccaaaaatattctatcactaagaatccactaagagcactttttatatctcagaaccacacttagaacccctcttaatagtacggttttttctaagactcaatttcaaaaattaaactatcctattgaccttcgagcttcaaatccgcataaaagaatgttgtagggggtctccaagcatctcttgatcacctaagatcaccttgggacactggtggagaaaccatctttacttccggttgggaacccccctttaatcccggttttccaaccgggagtaaggatccgggactaaagatgtccatctttagtcccggttgaaataaccgggactaaagatacatctttatt

SEQ ID NO: 12756 - DNA, 1614 bp, Oryza sativa
agaagtacataccccgcctgccctacatgcatagagagcgagtagcattcccttccatccggctccatcgcttgccccactataagatccttcctcctactccatggatcgctttggagaaagctgcttttgcctacttggacaaacacaacgcaactgaaacaagttcatattaacaaaagaagaggaattgaagctggctggcttgctcgtttccaagctcatgatggcaagatgggcctagtagtttaatggaggcgtgtgattaatgatggtaatctacggcacggcatgtttttggttccaattggggacagcggattaatctaatccggagagggatgattgctgttgctgctgatgctgttggtcccaacagtggagcgcccctgatacggagcagagcgtgagtctcctgcgcgaaatccagtggggatggatccaccattcgcgacaactaacatcgaatctcaagcatcgagtgtgcggcaaataccatgccaactaaacaaaaactttgtactactatctctgtataggtgtagccctctaaaataatgacagtactaagatccgtttaggtgaagaaaaatgtggtcaggacaatggtagtatgatactgtatttacaattccaaggcttgattactagcagtacaatagtactgcatacaaaagttcagacaattgttgctctgatcatgagtctgaatgctgcatatactgcgatatttttctcaccttttaccgcggtagttgggggtggaatcaatcgttgtgagggagagggaccaagcagttctatgatcagggcaggcagaagcagtggtgcttactgtggtcataggattgaaatgtgcaattctggtgtaagggcctgtggtcattagttggcgaaaaaatttgcccccctgtcacatttaaaatattaagcatgatctaataacaaaaacaaattacatattccaccaaaaaactaacagacaaatttattaagcctaattaatccatcattagtaatgtttacagacaaatttattaagactaattaatccatcttaattcatcattagcaatgtttattgtagcatcatattgttaaatcatggagcgactaggcttaaaagattcgtctcgtaattttctagcgaactgtataattagttttttttatatttaatacactatgcatatatacaaatattagatatgacaaaatcatagagcgattaggcttaaaagattcatctcataatttcctggcaaactgtataattgatttttttatatttaatacattatgcatatatacaaatattagatatgacaacctgaaaaattttgtttgggaacccctaagccaacctgaatgcagcagctgctgctgctacgggacagcgctatcttaccccatcaataatgtaagtgcagggtgcaggaaaaggttgcaaccatggccaaaactgcagcagctcctctcctctatgacttccctcttcctcctcacataacacatggaccaccaccaccaccacagccatcatcatgatcatccatcccctctcctccattgcattgctcccacaattatcattgttatcaccttcctcacctt

SEQ ID NO: 12757 - DNA, 13939 bp, Oryza sativa
tgcggcagcttcagccccttcatctgcagctgctgctgcagctgctgaagctgctgcggcgtcggctgcggcatctgcggcggcatcatcatcttcacgtctttgctgccgcctccaccgttgccgccgccaccgccgccgcccttctggcccttgccgccggcgtccttgggatgccccttgccgccgccatccttgggctggcccttgccgccgccgccgccgtcaaggtggagcttctgaaactggttgttcaccgccgccaccccgaccttggaaccccatagctccgccggcttgccggccttgttgagcttcttgataatggtggccggatccaccaggccagacaccgtcaccttcccctgctcagcgtcaatgctagtctggtacacacctgcagacataaatccaacgagcgtttcacccagaaaatttcaaaccaccatataactaaaagcaatttgctcataaaaaataatctctcttttttctgttaccttcgatcttgtggaggatcttcttgaccttcttctggcacccatcacagtggatgttcactttcagcacacaagtctgggaatttgggaggaacagagaaaacacaggtttaccaaaacagcaaaaacagaggcgttttcgaagaaaacatagcaggagaggaacacaccaggtgaatgaaaaagaaaagctagctgccctgtcttaccttctgatgaaaatggcagcaaaaacaaggagaaaaacagaatgtctgtatcatggttttgagttgagaagaagcaaaaaagaaaaaactgacctgaatcttgaggacttcctccttactcatccctgaccacctcaagtgcggcgccccccaccaacacaagcacaagaggaggcctcctcacagatctggtacaaagagtcctcaaatcagggacagaacaacaacaacaacaacaaggcagcagcaaccagtaaacattgccctctctgaagaaagggagaaggtatgatgagcaaaacagacaagaaaaatgccttctttctgaagataagttaatggcctccaatataatatctctcccttcacacactcacaccaagagttagtgctatggagagagagagaaacatataggcttattagagtttgcgtgtttgcagaaaaccaagaaggatggggctactattaagccggtggtccagagaagaagggagaggaggaagaagaagagagcttaatataaacacaggcagcaccatctcctcttacccttttgtatttgctttcgccttcggcactgcagccttgcctggaagaaggcctttctctttgcaccctccacagattgtgaaggaagggaagcctggggctcttgcaaaagacttgaagagaagagagaattaaatacccactttgtcacttgtcagtaagtacagggagatgttcaacatgtgaggtactcatcagatgtttacgccgagctcgcaatgtcggttttttcttgcttttttgaaaaagtgtccagaaaatcttgtttttctgcaaatttcatattagcccttctagcctctgtaacttgcagttaagactgactctgcagcattttggtcttcggggttcttaaaaaaaaatatttttgaatgtttctcaaaagacttggtgaaaaatttagcaaattgtacgtaggatgacaccgacgcatgaaaatatgtttcatgcaaaaattaagattttacgtgaaaaaacatgcaaccaaaccatccatgcacgagcgcttgtcctattcggtcgtcatgtattccatgcattacatttacagtttatatgacaagagcaatacgacgtccgtacaaccgacatataaagaagcttttaatgattcaattgtaaacgagtagtcttggccataacgtattccatgtactccaatccattgtagtttgtgtgacgagagcattagaacgtccgtataatcgacaaataaggaagctttaactacttgcaacgcttcaaaacgggtagcggttatgattctccgacgtttattgcaacactcgtacaacaagatatacatttccgttttgtagcatatcacattatttaacgatgtagacattacatgcttgaccttacaagctatattttcggttacatacgacaacggctagtcagcttctcagactcaacaaatctgtttttgtcgagaacagaagaaataggcatatcacgttttctccggtctatcaccctatcaattcaacgtaaagataaaataggcactaaggtagtgcaaaataagaaaaatacaactactagagggtttttaccggcgaagtaacctcaaccagaattactctcttatgaaggggctaatatgcaaaacaaaaggagatgagaaggggttccctgtgctgtgctgatcacgcgcccggtcaatcgtgtaacgcgcgtagctttgggcatcgtcacgctgtgcaggcagggcaaggcgatgtggtccgtagacgcgccgcggccacgccatctcatctctatctctctctctatctatctatctgtctatctcccctggctgcgcggcgcccgcgccgtgctgccgtggcgagcgagccgtgtgcgtgtgcggcgtgggctgcgcgcgccgcgcggtgcgcggtacgtacgtcgtccactgcaaaccgccgcgagccaagccgcgcgagacgacggcaacaacaacgtacgcgaggcgcgcgcgcgcggtcacgccatcctcgcgctcgcgctagctagcgttggcgttggcgtggcgcgacgcgcgagcggcagcggcagcgcgaggcgagcgctctccatgcatgcatatccccatgtctgtgtgtcagaggagggaggtgagcacaataactactcaggctcttattgatgacgccctcttaacttggcctttgcctctctctgcactgcacctgcatgcgtttcacctcccctgatttttttgtccactctttcccttccgttactgtcttttactactactccctctctctttttttttctttttgtttctatacgcactcgtctctccaaaaaggaagaggagaaaaaaaaacgtaaaagggctggtcacaaaaaaaaaaaacggaagggaagggatggtaaagtcttggtcacgctgacctcgcgcggtgtgacggatggatggacggttcacggctcatgcgcagaattgcagggtagtattgcagttttttgttgttgttgtagcagatcatcgtggtttgacgtcgctgacggatgaggaaggcagcagggagggcgatgggtgacagtttgcgtgtcgctgtcgcagctcctgctcctgcatgccatgccactgttgcgatcgggtgcacttcactgttcactcgtaaaacacagcaccatccagcgttcgatccattatcatctactacgtgctcaattaccctggaaacagttcggttaattcagagggattgacacaaacataaatttgttaaatatttggagatatatactgtactccgtattttacatttcaagcgaacaattaaaccaagatatgtgcagttgagctgaagatatgattgcaacatcgtcatcgtcgcgagcaaatcgcaaatcgaggttacagatttgttcgtatatgcactctcatctttttgacgaagagaggcaccgcaccagccttgcatgcatgctgctagtgtgctggatcaagctagattgatgtcaggtagccaattttgaacttcagtttctcgcgaaatttgctgtcatccatgggatcgatgcagtgacctgtatacattggaaactcgcgtatatggatgcatgtatctgatgaatttctttgtatgcatttgctatctttgcatgcagtgtcttaatgccatgtctactttgattgctatgtgcctatgtttgctactgcaagaggacaaggaggtagtcgacatatatacacgtacttgaatttgtactcacatgtagtagtaattgttcatctctcgcattcaggcttactgtacaatcacaccttgcaggagtaccgcatccgtgtgactctccactactagtatttgttctatctcccatatgaaaacaagaggctttttgatcatctagtcattgacacactcgcaataaattggcttgacgtattttgcagctgtggtcgcgttaacttatcttcataaaattccaacagccaaacagaaaaaaaagataccacaccaggcacaggttcgttcttgcgtgccttgtgagtgaagaagatgtttgggaagatgaagatggcacttcgaagttttcttttggtgaaaccatgaaagggatcgatggctattgtgctgggaacaagttcctctgacatgctgttctctaacgcgtggatcgttaacatatcaatcatttaaattcagaagatagtagtaataagttagagcctcattggttactcttacaagctactccatccgtcccattttaagtgtaaccatgagttttcgcgctcaattttgatcattcgtcttatttgatttttttatagttagtattttttttgttgttatgagatgataaaacataatagtacttaactcgtgatttatgtttttgttttttttcaaataagacggacgatcaaaattgggcgcgaaaaaccataactgcacttaaaatgggacggagggagtaaagtcgaagctaaaatttgaattatcaaattttattttaaagttgattttaaggtatttttaattagtttttaaataactaaaaacacacatatataaaattcttattttctaataagtcgagctggggctggacggacggcgccaactcgtgggccaccttgtgcggcctagcaaacgtttgctaccttgtagagatgtcactagtgatcgacttttgcaggagaagttttcgtggagaagcatgcatgggccggatggattagttggtacagtagaaaaaggggcacacaagaggccagaatgtgaccgatttttttgttgagatcgacttgaggaggaacacgttgcatcgcatgcattttggtggtgtttgccgggccacccaccgccatgcatgaatcagtcggtcggtgtgacatgattttgatggatcatgcttgtcctaattaatgtgggtgccatattgcatggcaaacttataaggttgtgtttagttccttccaaaattgaaaatttgagttgaaattggtacgatgtgactgaaaagttgtgtgtgtatgacaggttgatacaatgaaaaaaagttagaagtttggatccaaagtttgaatctaaacatagtctaagtaaatcactgcagttttgcaaccggcatatatcctgaactctgcgattgaactagctggactgaatatgatcagtcgatcatgacttggctaattcggacaggtagggaaagcaaaggtatatatggtatgatggaggctggccttgcacagttgcactttccaagtgacagcaactgaactcacaagaaaacaatcggggctactcctaagttggactctgatcacgtacactacggaattgaagcaaagaggttacttgcattgtcctatataagcttggcaaatggcatgcaaatgtttacagcatatataatagcggagtggattctaaaactctaagagattccttacttgcatattatttaaatggttataaaaatattagaaaattcaataagatagttaacgtatattcaacaagacaagttgaaaaaaccaaattaaactatgactaacgtatattcacaatcaaatttgttttctttcgttacatcttatataagttgaatttgaccttgtatatttttggagtgatttatcacattttaatcgatcttgtttaatatttttacaattatttggattaaatgcaaatattattagtagtagtacattggatatgcatgtcggcacgtctggttcatgagaggccatgttgattgattatgaaagtaggaaattaaagctttgattattgttgcctagctggtttcatccatttgtagcgatcgatggcgtttgagatcattaattctttcaagctagctagccatcggtgttttggctacttttgtgtgcccatctgatgtaaacctgcgatgtataagttgtctagaactctagattcagcatgcatgggaagcagacttgacattatatccaatccaaggacgacatcgatcaattgatcgacataaaaaatactgtgcaaaacatgattacctactgctcaatagtatgatataatgaaccatattattaccctctaccaggtcccttttgcaaaagacgtgataaattcttgcgcgtaataatattaatgttgaaattacttgctttgacgttaaaattaacaacataccgagagttatcatataattaaatccacacaatacgttcgcaacacatctatatactccttgattaatgaatgactttcatcaatcaggattaaggaccggtggtagtaccttgtaagcattgctaaagcaaaattaaaggccatgatgcttatcttgaacccagcacgtgattcgacaatagagaatccccggcagggatctacccatcaggcagggtgggtagaccgattcagctacgactcgtgtcaccccacactcttaacacccccttatagtagtcatggactatcaaaattaggtataacaaggtataaacacataacaaattaagacagttataagaatgaactattaatacgatatgtattgtgttcgattgcttttatcgagtgaacttatctgttctccgccccatctatagtttagagctgcgtccgccactaatccccggctatctcgcggtagtgaatgcttgcgaaatgacccatcatgtaaatgacgagatttcaacagacttagcagtcataattatgcacatcaacatttgcaagtacaacgtttatactgcttagatggcactttacaatagatttgtttttatagaaaagatttgatttaatttagagcatctccaatagaagccgtatatgttccctacagtcaaatttgaggatttcaagtccataacccaccttaaatgactgctcaaaacaactcccgggttttacagagccccgaaaacacctcaccctcgctagttttggggcgtttttggagcccatgatccgtccctaccctcattctctcgtccagccttgcaatccgtgatgtggcactggtgcggatcaactagagctagctcctcgatgaggctttccaccacatccatctactctgcccaccggccacccacaacatgagtagccatgccacgggatctatggcgttaccggccagcacctaaagtcattgttacaatcgtccacaattgtctctgtgtcttatttattatattatgtagttatgttgagtaaaatatgtgattttgtagtcgtctaacattttcaacatacattactagtttcggattgatgtagaaatgtttcctccatatagttttgtctcttatactgtttttgattccatatcggaggaaatatatgattgatgctgtgttctccggctcgagttgggaacccttcccccattatacacaaaacaagtgacggttttacatatgattaatcaagtaatagaaaagaaaaataaaaaattgattaatatgatttttaaagcaacacacacacacacacacacacacacacacacacacacacatatatatatatatatatatatatatatatatatatatatatatatataaaacacattgtttaattggaaagcgcacacgcgaaaaacaagggagatgatcaaagttgggaaagtagactaaatagcacatcctgagactgtttttcgaccatttcgaacccttttttttcatagttggagatgctctttgatgatgtgattcggttattgggtttatcgctctcttttacaagcttcctttaaaaggcgctaaaatttcactactacaaaatattgaccaaagaactattccctccgttctaaaataagtgtagttttgcactattcacattcaacgtttgaccgttcgtcttatttaaattttttttataattagtatttttattgctattagatgataaaacatgaataatactttataagtgactaaatatttttaaatttttcataaatttttttaataagacggacagtcaaacgttgagcacgaatatctacgactgtacttagtagttcagctcatccccaaaagattctctaaatttccaacctgccgaaggaggcgacggacgattttcctcttgccgattcggaatgatttgatttgaagtgtaataatggaagcggatgattgttcatgggcatctagcagggggccctggcctggaccagctgctaggctgcccagtcgatcggccggctttgggcgctcaccaaggcccgtggcctcggcctcctcgctcgtttgggccacagtcgtacgtacagctgatgagcgccttctggtcttgtcgtcatgggcctcagggaccacgcgtatcggcgtatgtacgtacaataatacgatcgatacatacgcggcgggacatcaaattatgtttcctgattccgagtgtatttatatacgtacgtacgtacgtgtgtgggcctcagcaaacagcagtacgttcgtgtgtacaatatcgatcacacctgtatttgcactattgcagtgtgagcacagctgggaacagtgtgtgattcggtactaattaactaagggcaccaaccaaaaccaattgatgtgatcatgatgatgatggtgatcatgttttataggtacgaaattaactgatcaatggtttgttaagatgagaaattttatagtagtacttaaaaaataacttgagatatctacattaaaactgttagtatctcaatgtacattaaaactgtttgtaggtactaaattttataataaaaaaattgataccttttgatattttctcaagaacagtaaaattagtctattcagaatggtagcagcacagaaaaccacggttaatacgtccgcctgatttatttgaggctacaaatggaagaacaatcagccccaaacctgtacgtacacgcgtttaattagtattccctccgttctatagtagatgacgtttttgactttttatttgcaacgtttgaccatttgttttatttgaaaaatcagtgcaaatataaaaaaaaagtcatatgtaaagtacttttgataataaagcaaatgataaacaaaataaataataatttcaaaattttttaaataagacgaatgataaagtacttttgataataaagcaaatgataaacaaaataaataataattctaaatttttttgaataagacgaatgatcaaacattgacaaataaaaaatcaagacaagtaatatgggacgaagaaaatcaagacaagtaatatgggacgaaggtagtataattgtgaaaaaaaaaagagaattgcacgtgacaataacgtccagatcatcgagaccacgagctgtcttgactctgagtctggacagaaactgtgagagagtgagtttgtctgttttgttttgttttccgcgcgcatgtttcccaatctactaaacggtgtgtttttttgtaaaaattttctatagaaaagttgctttaaaaaatcatattaatctatttttgaaatttaaaatagttaatactcaattaatcatgagctaatagctcacctcgttttatgtatcttcccaatctcctcaatccccttctcctcaaacacacccttagctagtgtgtactactgttagtagtgtaccactgcagggttgtgtacgtgggctatgtttagtttctaaaattgaggagaagtttggagaaagttgggctgtgtttagatccaaagtttggatccaaacttcagtccttttccatcgcatcaatctgtcatacacacacaacttttcagtcatattatctccaatatcaaccaaaatctaaactttgcgctgaactaaacacaacttggtagtttagaaaaaaagttgggagtttatgtgtgtaggaaagttttggatgtgatgtgatggaaagttgaaaataaaagggaagtttggtgtgaactaaacagggcactggtgagagcggccgatcagcgtcgacacaatgtaaggccgagtttagttctaaactttttcttcaaacttctaacttttcaatcacatccaaactttcttacacacataaacttctaacttttccatcacatcattccaatttcaaccaaactttcaattttagcgtgacataaacacatcctaaggcttctcacagtgcggtgagctggctcgtgccttacctgcgccatggaggattttcgcttaggtggagctaggaatcgcgactaagcttggcccctcgtccccaaacatagcgacacggtaccacgctttgacgagtccacgcgcgtccgttctttgacgcagcgtgtccttgcgccgcagccgctcggagaaatcccaaattcgccctccaaaaatccagtctgcgccgacgttcttgctgctgccgacggcgtcgtcgtcgtcattggccacaactcaatcaaatcaaaacaaaatcccaaacaagataccaagttcattcaatcccaagatcaaatcccaactcaccaagacgagaaatttctccttctccgagaaacaatctgaactagtatatgcacacaaagatgaaagctaagaaaagcagcggacatttctccttctccaagaaattttgcctaacgacaagaaggagcaggcgcaggacaagccgccgccgcacctacacccgcacctcctccgcgccaccgccgctggcccggcccacccgctccttctcctggcggcggtggctggtgctgcgcctgcgcggctcctctgtgggcgccggcggctccgccgacgccgagccactgcagctgcgaggcggcatcagcacggcgggcgagcggcggactccggtgacgcggcgggcgagcggcatcagcacggcgtcgtaggcggggacacagaggaggatgctgaccacctcgaagccggcttcccgtcgtcgtcgcgtcatcttcccatcgggacagagaagggaagggaaggaggcgccgtagccacatcccgcgctgtagccacagacggaagggcgagagacgggtgagaccgtgccgccgccccccgaagccgaccgctgccgccggggatgcgtcccgccgccaccgcgccagtcaccgccgttggggacgcaccccgccgccgcaaggggttggatagagcgaagcggtcgaggtgtccgcctgcgtgctgggttggagagaggggtaggtgaggaataaattttgctccgttaccgtgtccaaaagcctgggttcacgcccactgtgggcttcgtttccttcatcagtgtctccatccaattaagccacacatatatgggtgcttacactatgtggtggatgtctttggactaaccttttgagctaagggcacccgcaatggttatctataggctctttacaagatatccatgtcagcatattttcctacttggaagagattaaatgaagagagagagcaaagctatctactaacgtggagatagtttatagagaaaaacgagacaatgcattagagagctatagatacccatatagacatactattgaggtggtttactattaatctagtctattgctaagatgtacatgttttacagagagcaccttactttaacattacgggtgctctaaggtacgggccccatgtcttacaatgtgagaggcctaaatatgcatcatgcatgccttggcagtttggctggttcccgtttaacttcacataacaacaacgactcagcgctcggtccggatcgcaagcaacgcggccaccgcgggatgctgccggcggcaaatgctcctcgatcggggcaggaaatccacgcggattcacaaaggcgtgtgggttagtatgtactccgtactagctagcctgtacactaggatcacgcacgcacgcacgcacgcacgcacgcacgcacgccggccggcctttgttgttgttgttcctgcgccctgggcagtcaatggatggggtgtggcacgcgcgtcgtgcaaccgcggcaacatcccgtgactcgcgtgtcggtgtcagtagttaacgattggggctatttgattcaatgcttcaatttgacacaactccttaggcttgtgtttggtttattgtcatagttatagcaagccacactttctcaccgtcctaccccacatgtcataaactcaattctttgcctaactttgccacacgtgtggcttacaatttgtaggaaaaaaaaacgtgataagtcacatttgtctaacattgtctaaagtgatttatatcaatgttagttaagaaccaaacagcccctaactcctgtgactgtgtgactgcaacttgcgtttgcacgccgcgtaccatgtccgtatataggagtactgtactacacaggttgtgctcgccgctgctgccaatacagctagtagtagtagtagtagtacagtactgtacgtcaatgcccgtcatgggcgctcctgcacccagcagctagctgggtcgcgtggcttgcgtgcctctcaaacacgtacgatcgcgtgttcgtgtgcaccgtggaatggctcgcggggctgcatctgtagttgtagtaggctattttgtagtaattttggaagaaaaccaacatcagctctagcctcatgttttctctttaagtcttgaagtttgtatggttttccagtagtgttgccaaacggtatttgttgcaaatgtctgtggttaaaattcctttaggattcaacgaggcattattcccgcatttttactattcttgtttttctgaatcccatattccaaagaagcccttaacgggtattaactattgccatccaatttctatcctgaattatggtgcatacgaaattacaaaatcggatggtacatacatgtccaaatttctcatatacaatttttgttctaaaatataagcatatgttgcatatcttaactaattaagagattcgtattttttctttcgtcacctcgtccgtgcggtgattttcgctcgccctcctccccaacaaaaaaaaaccagtcggaattccatcatacaaataaaactgaagcgtatgaatcgaagacaaggacacaagaagaaaaacgataccggaaggagagggtgccgctgtcgccgccgaaccgccgccgccgtcgaagggacgctggttcgccgcggctcccctcctgctggatccgattgaggggaggctgggccgttatcgcctcacgtcccctcccctcctgctagatccgggatgccgggtctaggccgccgggccgccgccgcctcccctcccactagattcggcggaggggagggtgccaccgccgctgggccgcagcggaggggagggcgccgcgcggaagacgatggggaggggcactgcgcggaagacgacagggaggggcgccggggcaaggccgcttgatggcggcgcactcaccctcgggcaagtgcgcacaccggggaggaggcatgcgccagtgccgctgcttttctcttttcgggcgagggggcgaggaggctagggttttcaccggcgccgggagggatggggttttgtcccttcaacgtcggcaccggtcgtccgatcaaaaccctaagatcagacggccggcactggccgaaccgaattcggcccaagtagaggcgcgcgcggggaggcttccccagcccaggcccaggttgcggcccagggaggtggggagctcccgcatgtgtacataagaggccgtgggccgaccagccagtccgggagaaagtctgatttagatccctaagcaaca

SEQ ID NO: 12758 - DNA, 8592 bp, Oryza sativa
tcaggaaattaatactattttctcacaaacagaacatatcacactgcactgaacagccagagcactcatagtactaaaaacatgcatacacaagatagcgagcaatataatggtatcacaatttcctggatcgagagggggcttcaattaggccgtgtagacgccgatggaatcgagcaattctccagagcggccgaagaagccgacgacgcggccgctggcggtgaacgacgtgccctccgcgcggccgaacgggccgtacgccctcaggttggtggccaccctcagcgacatcaccaccacgttgctgttgtacgcgccgtacgtcccggacacttccatcacgtactccgatagccccagctggatctgcatcgtcgtcacagtacacgatcgacacaattgtgaacggcacgaacattattttgttggacatggatgcatcatgttcaaaatctagtatatatataaaccacagtggaacccgaattaatatttcaccttgggtgtgcaattaatgatattcaaactctacatgaaccactgttgcttcctctggggagaagtataaggaattagggagtattttcaataccaatataattgatgcatattgtagaaaaaatagtgttaaggtatttctagaaaaaaatattatagaaaaatatgaagtagaatgctttatgcacggaaaattgacatataattcaaaagggcattcttaattatgttatatttccatgttaaaaaaaattcatatactcaccgtggttgtatcgcctccactgctactgccccatgggccaacagagcgctactgaccagtttggtcagtgtaagaaaaggacatggagtcaattgtccagccgtgacggattgttatgctttctaaacgctggggtgcaatagggatgtcgtgaggagtgcctccagttccaccccatggtccaaccttagtgggatggctttgctgaaatggattgaaagagttacttttgctttacctattcatgatgcaaatgaaatatactttttttgcacggtatgtctaaaagaagatatttctcttactcctatggtcataaatactcggacagctcttgaaaaagaaatgttggtgactgaactaattgcaaaatacatgtaatgcttaacaatttacaagtttgtgttaaattgctctttaagccaaatctagtacatgattttccaaaataccatttgaaggatatcgatgcttaaaacttatagaagtatgacaaaaaacattgtccaaaattatgagcattatttgtgactacatcagaatgagtagatggtagcaatcagagttctaaggccaaacaaaccacacggagaatagcattctttcagataacgggtaaacttccattaatacttactccctctgtttcaggttataagatgttttaaagtcaaaattgctttaagtttaactaagtttgtagaaaaaagcagtaacattttcaacccaagacaaatttactatgtaaatatattcaattatttatttgatgaaactaatttagtattataaatattactatatatttatctataaacttagttaaatttgaaatagtttaactttgatcaaagtcaaaacgtcttataatctgattataatctgaaagggagggattaaaaactaatgaaacagaggaaaaacttggtcaaaatttttgttcaactcacattgtacgtgggcatggggtactgctgggatggtcccattggcagagtctgagagcctctaggcacagggcagaatccatggattgtaatctctatgatgttgccatcgtttctccgttggtgcaccctcttctggatcacacctcctgccatggcgaactgaccggtcccaccaacaattccccattcaccgttttcgacagacacttgtcgacgtttgatgtctcgactacggtatttagacagtatggggatcgttggtgctaggatatatgcgagactgaggtaaaagagatggagacagggatttttatacaggttcgggcccctgagtagtcaggtaataaccctacatcctgttggccgaagccggtattgctcttattcaccataatcataccagtacaatatgtgggtagcctatctaactgttgtcgacatgtcggtctgaaggtctgactcgtagtcgacaacagggtagtcttcctcctcgaattcgtgcccggcgagatcagagatagcgctttcgtatctcctgacagtatccggaggcaccgtaggagaatagccatgcctatccctgaagtcgatatccggcggcgtgtcttggcgtatgtaggcttctatgttgtggcttctatgtcgattgtgttgggtgttgatcctgttgattgtctccttgtgggtgtccccctgtcctcctaggggggcttgtatttatacccataggtgtttccttgtccaagtagaactagggaaaccaatatggatacaatccgagtagtccttgtcatttccatgtagaactctggttctctttccttatccgaaactccctccatatctgaagtcggtttccgtataggacatggtatgtggtgggtcctgccgagatttagtcaactactattaggtatgtggtatccataaccataacaacactcccatcaccaaaagcgtggatcccctaaacctaagtacaacacaaataaacatgtcaattttttaattaaaacatgccctttcagctatatattattctaggcgtatcgttcttcggtgctcaagtgctatcttcgtcccgaaataaatttattttcatacatcctgcacataccaatataaaccacaaaaaaaactagaatacctctactttatcaaatctcaatgcaactatttctcactccatctactctcaatataattatatcatactttcataaactatgtttcaatgattactcaaaaacaaacttattttaagacaaatggaaggggctaaaagtaaatttaatttggaatagaggaagtactttaacaatgtgacgaatataactgatatgtaaatacaatgtaaatagggtgtaactactacgtaagtactaactaaagtgttatgtaattattgcataatggatataactttagttttggcaagggaagaaaaaatggtgccatgctcaattggtttggtgctatcactacaacttagaagattagaagaccagggtttcgatccctgccaccgtgctttgtacattttttctgctactacgcactagcacagatatcaaagtacatcctatggccaaaaaatcgactaattttcataaaaaactgatgacatatttatagcaaatccgattttatttttatatttgtttaaattgaaacgtgtcttacaataaagttatactgcctcttttcttaaatagatattgccctaaaacgtatatatagtcaaaccttgaagtcttaaataattaattaatataaaaatattatgatttgatatgagaaaacgatatcggtgtatttgttataaaaagtacattcatatggttatcatatctttctagcttttataaacatgtattccctccgttttatatcataagactttctagcattgtctatatttatgtatatgttaataaatctagacatatatagaatttcgaggaagtagtaaaaaaaaagatggtgatataatacatgtactgcgagacggtttcaatgcccaaaacgacaagtaaagaaaacacggagggaattgaagcacgggtacctttggtcctcgaagacgatggtgaaggagttgtgccagtcaccggcgtagacgtggagtccccgcgcgcgggcgacgagggagccgaggccgtcgtagatgggccagttgttgacggtggtggcgccgagccccgtggcggcgtcggcggcgagcatcaccgactgcgtcgggttgggccccaggtagagatggtgcaagtagaggttgcggaagttgagctcgttgtactgctccaccagcgccccgcacggcgtcacctgcaggctactgcctgtaattgggtacccagagctaggagggtaagccatgtctcagcaatagctgaacttagctagcttcagacttcagagatcgattgtatgtgtgttataatgttaatatgttgtgtgtgcctttgctatcgctagacagtagacagagaagaggtgcaggattgtagctagctagctgctgggagaatgtggagctggctggagtagtggtctccatctccagggcatatatatcccatatatatttgggcatacatgggtgtgtgtatcacgagtgtggctggccacatcctccatatcgatcgtcgtcctagcttgatcaaaacattggatagcattgttgattgttgaaaggtcgatgcggccatagcttgtgtgtgagaaacgtattgtatgtatctaattcatttggtggttgttctacaattcgcgtacgtgttcctttcaatcggattgaaagttgatgttctcacttaagaatgtacatactgtaaattttcatgattaatatgctaataatgagatatttgagagagaaccatgcaagtttctatggttaattgtgttagaatggaaaattggctttgtgttagttaatatgattgttgtgaggggaatatgattgtttttgttggcgaaaacaatgaaaaatgcttaggggtcttttggttagctccataagatggtgagttagctggcctagctaggttcaatttttttttaagaggggggtattgtattcaatatgcttctgcagtgataatggtcctctatcataatgatcatcttccattcaataatttgcccacaatgtaatgttatccacaaatttatttagacaaacattgaacttgatagcaatgccatgcctgttagaccaaacacagctatctccatcagtcttccaatcaagcacgtgaggtggatcatggccaagttcagcaactgtcctattaaacacaacaaaatatatatttgattcaaaattatgatttgactgaacctgcatcaacaaaatttaaaattaattgttcatccccggtacctatgccgtattggtgtcatccggatgatctgtcaagcgttgacgttcagttcaattcagaggattccgattcattctatgctgaattattctccatatcttatctggcaaacctgtttaacgtcgagaggccttgtttctcaagttatgaagtcatatgacgaattcacgatgacttttgtctagttaatgttacatatactgcgcttgatttcacaagattgtcgccatgctctagggcctattttgggagctttagattctgagaagcagctgtttggtagccagcttctgatattctggaaaaactctgaaaaccagctgtttggtagctaacttctgatattttggaaaaactctgaaacccagcttctatagcttctgacttcttagttcatttttcagaatctgtaactacagatgaaacccagcttctgacttcttagttcatttttactacagatgaaacccagcttctacagcttctgacttcttagttcatttttcagaatctgtaactacagatgaaacctagcttctacagcttctgacttcttagttcatttttcagaatctgtaactacagatgaaacctagcttctacagcttctgacttcttagttcatttttcagaatctgtaactacagattcacagcttctgacttcttagttcatttttcagaatctataactatagattctcagaagctgtggactatttggggcagcttttaagaagctgtgaattgtttggggcagcttctagcagaagcagcttttgggaaaagctgcagttgggacaacctcccccaaacatggccctagtgtctttggaagccagagatctgagccctaaatattcttcatccgacggcaacggcgtgtcattcttggtccggcagccctatctatgcagctcagcaacgcaccacggcttgctattaatccaactctaatgcaaattaacaccaccaggatttggaagtcacaaccagtgacccaatctcttgcattcaaacatgttaaaaatgttatcaaatgatcaaatgaaaacatagatgataatttacatgtgtacatcctaaatagaacctaaatcggcacgtttagccgatttaggatcgcctgtgccaatacatggcacagcagtaagcatctgataaattcttgcttctggtcctgaagcaaccacatgttactgggatccgttcttcttcatcctcagaaagctaactaatgtgagcctggagggagcaccggttcccggtctcctcttaattgttgtcgtcttccacagctttccatctctcatggtagtcgtggttgtagatgatacgttatagaactgcatacagacaagttgtgactggaacttaaaatgtttggatgaagatttaagttctcaagaattgttgagaaaatatttacctcacatacaccatgcagaagcaacctctgaaacggatcctggacattcagtacaagcacatctttaccactagcatcttcaatgaaggccctaattcggtcctgcaaatgtgaaaagcagattcaccaatatcaaataactaaggcttcttaagtactttatgtaaagaaactcaaacacaatcatattgtaattgttaacttgcacttgcattcacgtcgcacgtgagtgtatacatcaaaagtttcacaagactgataaatgttggcaaaataagcactcaaccatctcatttctgagaataataacacatttcacagtagcaataacagacaatcaggtcaccatgtttaagcctgaagcctgagcaacaggactgcttccttttcattaagaagataactatacagtaccattccaaattgcagagacagatgcaagagcgaacagaacatcatctaaaaagcttaggtacccgcactgttacttgtaagccagctattagggctagcaatgccaggagagattttctcagaccctcaaaagtgtaaatcatgttgtaaaggaatatttctagatgtatgtttagatggtccttaccttaccatgagttgtacagaaaaatcttttaaaccaaaatggttaatggtgtaataagataggtgatgatctcagaccctcaaaagtgtaaatcatgttgtaaaggaatattatagatgcatgtttaggtggtccttaccttaccaggagttgtacagaaaaatcttttaaaccaaaatggttaatggtgtaataagataggtgatgatctcagaccctcaaaagtgtaaatcatgttgtaaaggaatattatagatgcatgtttagatggtcctttaccttaccaggagttctatagaaaaaaaattaagccaaaatggttaattgtgtaataagataggtgctgatctaagaccctcaaaagtttaaatcatgttgtaaaggaatattctagatgttagatgtatgtttatatggtccttaccatgagttctacagaaaaatcttttaagccaaaatggttaatggtgtaataagataggtgtgtaatgcaattccacgctacaaccaaaaacactgtaaggatccctaaattgcacctaattgtttgttcgaacttgctcataaaaaaggtgtttgatcttttaaaactacaaaatcagaaagatgcatcaagtagtaaaacaactcccaactaaacaaatctagtaaccattgtggcaaacagaaatacaaaaagtatggcaattggtttaaagagtacaatcaaagagaaagaaaggcatacctcatatatgtcaagcagatctgggaggaaatttctctttatggcttctcttgtttggcgatctatacgatgccaagcattgagagcaatcaattcatcgctgtccacatgattcttctgttttgtagaagattgtttcatctgttgcatcaatcgtgcctacagataaaaagcacagtaagcaaaatggatccctaaaaagttcacatggtatctagatgataggcccttttttctaattacacggtcggtttgatatattattgtcaactcaaggtggacaacacagattactgacgcactagcatacctcaacgtccatgtcaatactcctgaaggcatcccattcaccatcacttgtcctacaaaatgcagaaacgggcagttcctcacctacatgtagaatatagataagtataacatacaaaaaagatgtggaacatctctgtaataatacatcgaaaatactaatttccctgcagtaaacagtcagcacaattaaagtgcacaactgaacataagcacttggaaggaaaaaaagtgtgacaatcagggaaactggatagcatacatccttcctgtaaatctatatatttttaattaatgacacacagttaacatgcacatgcagtaaggaaaataatattgtttctcattctcaatgtgaacacatcgtaaagagtatgcataacatggctcacattttctagagaacttactacgggctgcag

SEQ ID NO: 12759 - DNA, 5064 bp, Oryza sativa
agggcgcccagtgtgaaaaaaaaaagaaaaaagaaaaaaaaactcacttgcattaggagacacctcggggggcaatttcgaaggtaaaaggagagtcacctttgggggagtcgaacaaggaggcgtagaactcctcctccctcctcagcagatccgccatggtggactcccttcccgcgggcttgtcgcgctccccctcctcggcctcgaagctcgaagtgctgcggcgatggaggatttgagagggagtagaattgcggggtggatggattgcgcgtcgtggtgtttctagggctaaaatatggtggggcgattgattggggaatcgtgttcgagagaagcgatgcgcacgcagagtagtggtgaggaatatgcggatacgtggcaccggatacccgtgggctgatattagcaattgggcctaaacagcaaagcccaattaccagaaacagcaaagtccaggtttgcttcccattcatgggcctcatggctgctcatggccagtgttctagataatttttaggaaagtctatacgtagcttgtcttacttaaacttttattactaacaccatgtgttacactgtgagtacatctcgattttttattatttctatctacttacaaatggttgagcttattgtttgtaaaagttttgtaaaagaaatttagtacgtgtagcagtgctctaatttttataagtaggtgaaagcccgcgtattgctgcgggaatttagtatgtttgtgaattatgtgaattattatgtgatatacattgaaacattatgtgaattatgttggatgataatttaatatgtttgtgtttgaaaagctcttaaattataaaaactataaagatatagcatgtttgcatgatgtttaaatgtgatgattgttagtggatgatgatgtggtatcttgttaattagtggatgatgatgtagcatctttgcatgaagatatacattgaaacattatgtgaattatgttggatgataatttaacatgtttgtatttcaaaagctcttaaattataaaaaatataaagatataacatgtttgcatgatgtttaaatgtgatgattgttagtggataataatgtgacatcttgttaattagtggatgatgatgtggcatctatgcatgttaagcttaagataaaattttcaccttcctatcaacagaagacgaccaggcaaagttggcatcacaagtttcttagtagtattttcttttttttagcaagagaggagatcctctcctgttcccattagcagaaacgatacaatatcccattggagttggacacaaccaaagcaccattctgttgtactccgttttcctgtgatgatgccatggcaatgtcacgaggggaaaaaaaattcaacaaaaagcatccaatcccttgtaaatacttttacttctacttcatataatgaaattggcccggtcttatgtcggtgcgttaaaaaaaaaagaaagcatccaatccacataccaacgcaacaaaagcaaacaccgccggccgcagccgcaccgcacgacacgacgagacgtgagggccggcgcacacgacgcaagcagcacgaacggataagataaaaattgccctcaaaaagaaaaacggataagataaaacagataaatatactatgcgtgccaccaaacaggcaaacaaaaaaaaaactacaaaaagcacaggagatttctatgggattcgtctagaaagctacgattcctagttcctacccttcccggtaacttatttatcctcccaaatcctctccaaattcaaacccaccatttccttttctttaaaaaaaaactttacttaaacgctagtagtacacttccactagtgaaaaaaagacgaggagtcggagtcccccacgcttcgtcctctgcttcccacgcgccacaaatttcttcgccttcttcccacgcaacgcctcgccggagaaacaggagacgagtagtagacgactagtgcgagccaagggcatggcgcggcagcagcagcagcgggaggaggagagggccccaatgggcgcggcccagcggcggctgcgcgccgtctccggccacctccagccgccgacggagtccggcggcgttgacctcgccgccaaccccaccgccggcgagtacgcgcacggtacgtacgatcgatcgatcgatcgtctattcgtctgcactactacttgctacttactagtgatgtggtatgcatttgtgattttatccatcccgtgcatgattgatgccgcgatttggatcttggggttggattgcgtggggcctactgggcgcgcgcaccgctcgagcgtaaagtggataaagtggagaataacaagtgcaaccactcccaaattcccaattcttaagctgtagagatagcttcctctttctgaatttgtgcttagactgggcatctatgccataattccattgctgagctcggtaaccgtctaaaataattgcttagctccgagctcgttagcttttaactgactgggatgcttcttttcctattttttagtacgccgacgcatgctagttgcggtttctcaactgcactctgcatgttttaagttatctttcttgacatagcaatgctttttttttttaaagtttacaactcaatgtgcatagcttctccagtgcagggctacagtgctgtactccctgagaagttgcaaactggaaagtggaatgtgtacaggtaggttatttagtagtatatgttatactgcatttgcttatgtcatggctcaaaatttctgtttccatcttgcagatccgcaaagtcacctcttaagttaataaatagattccctgataacccagacattggaacgcttcatgataactttgtgtaagaatcctcatagtctgacttgagcatcaaacttctatttctgaatgttaatctcaacttcgacaaatctcagttatttaccaatgttatgctacgatttatcaaattcttgtcttgaattgtcagcaaacctttgagtgtaattacataccatcaagcaaaataaatgctagttatgttttccttaggaatctcccatattttttgtttctgaattgtatcaggaagatttttaggaaaatctaatctaattaggaaaaagaattattcgcaagtgagtctgttattttattgaaaccttggagttggaaaatgtttgtatgcaacgacttgaatgcaaaggtttttatctgatgtttttatgaaaactggtaaacttaaatgcctgttgcaggctacatgttttacaagagaactattagtgttcaaatttaagttctgtgataagttctcaggcaatatacccaaaattgtgcaggtatgcagttgaaacctttagggactgtagatacctgggcacaagagtctgtgttgatggaacagttggggagtaagaattggttcctggatatatatgtcattattgccttttgtagctttgttaaaatcttttaaatgatatatatgaattgttgcagctacaaatggatgacatatggagaagctagtacaagccggactgcgataggttctggtcttatttaccatggaatacctgaagtgagtcattatgatctcaacaagcaccgtccttctgattttaactactaacaggcagatcttgtcacacattgccataatgatatagcatttgtggttacacttacagattcctttttttaaacttgcattaaataattttctaaaactgaaccagggtgcgcgcattggtttgtattttataaacagacctgagtggaccatagttgatcatgcctgtgcggcatattcatatgtatccgtgccactttatgatactctaggtatgcactcatcacataatgatcatctatctccttttcatttatctagcaacaagttttatgtattgtttatacaggtccagatgcagttcagttcattgttaaccatgcgacagtacaagctattttctgtgtgcctcaaacactaagcactgtgagctttaacccttatctcaaccttgtatagttactagtctatacaatcattaaaagtcgcagttttcatgtcactgctcatactggtccttaacttagtgatgctgggaactagctagttatttccaggaaacagatctgtgctttcaggtgctgatctcatcctgcagaaactgcatgcacatcaaatactgtttttttgggaccatatccacatgcacacaaccaatgggctgagtgctgggctggggcctgatcatgaaatacattctatgtggattctgatcctatttccattttcttatttcaaacactacatcaattttggtaacactgcctagcatttaatcttgaattttatcatggtatattctatggaacgaagtgtacttatgttctgcttatgtgtaactatttattgcagctactaagctttataactcaaatgccgtgtgttcgccttatagtggtaagttcaaaccatttatagttagtatattcaatgaacggccatgattgtttaagattctctctttttctttttttttaaaaaaaacttgtttaatataggtaattggtggagacaatgcaaatatgccatctaccccaacagctactggagtggaaattataacttactccagactacttagccaggtgagtttgctaaatggcccttaagtttactaacactacttcttgcttatggtatttgttctctttttcataaaaaaaaagtatctgttatctaatgtcagtcaaccaactggcatttaaacttgttaaaaaaacactttacatgcatacctgtagtccttgagaaccacatatctagttccaaagttgtatgggcatatggttcaatatttatatgaaatctcttgggatacgaattacttggctgcactcttgcactgattaatttagtactgtttccaaaagatttatccatggcaaacaaagttgatgtgacatcttgtttccacttccattagaaaacacgtttgttatgcaattatatttatgtatgtatgaggggctgcaggaa

SEQ ID NO: 12760 - DNA, 2901 bp, Oryza sativa
tctttttttcctttcaaattgttataaaaccggccccgaaatcacatcggaaaccaatccgcggaagaaaacgccataggagatccaaacacgatgatgacaccgaggcatgatatttgataacggagttcagccgaggcctacatctccggggcactgattacgggtgctcctccccgatctagcatatacagcgtatcagagttacaacgactcacggccggtagccgccggcagccgctccctctcgctatgctaagtcgccatgcggttacaacaggcacgccctctatttatgagagatcctaggatagagtccgactcatactctagtcctaatacctattacaactccaagtcctaaactgtaaccgactacgtatacatattcgacacaaactctaacacaaatcatagttttgtctatgtgctatagcagtgtgcggtgtgcacacttgctcaattcttttcttatggacacacatagtatgtgcatggtggatatatattgccttagttttagttttgcatcaacggcctgcgaaataaaaagtatgtgtgtatctatttccagccatatacattatctttgctgttagattaaaggatgctagcacattttgctcactgttcttctgatctttcaatcttcaactcagggaaagatgagttctcaatcttttcgccctccaaaacctgaagatattgccactatttgttacactagtggcactactggcacaccgaaggtaaataactcatctttctgattatttttagtttcattcaaagagctcttctaattcaaccttccaatctgtgacgatgtcatatttatttcagggagttgttctttctcatgggaatttaattgcaaatgtagcaggatcaagcctagtcattaagttttacccatctgatgtgtgagtttacattaaatctagatttgtttctttctgccatagcttaataaatttatcccatctggtaatgttttgaattataatcatgttggtatgtctttgcaggtatatctcatatctacctttagctcacatctatgagagagttaaccaggtctcagtggttcactatggtgttgccattggtttctaccaaggggtatgcagatccaaaaccatttaggttgttaattttgtagttatttgcatttgctgtttgtgtaaataataaaaccagtagaataatggggtttctgagttctgacctagcaaaggtaaatatgaataaccggggacaaatgaattaaaccactcggaaaagtaatttcaaatgatagatcagccacaagttacccctagatatagaggcagaaatgaatcacctagtgcaatatatcaaactgttatataacaatcattcagaaggttaattgaacacaacagatgcattttagtgctggacctttcacctacaaggctacaagataatattctgataatcccattgtactatttgttatggcctcatcatcttgatgcatgcattatgttggctcatgctagttcactacagctctatgttgctcatcatcatcctttcctcaccatcgtaccatcatattgtaaacctattgctggatttccttgcacacagcaagcaattagatccatatagggttatatcttatgtgtttgccagtagcaataactttgttcaacacttgacaaatatgcatttagatcaaatatccatcttacttactacatggattctttgccataataatcgtttacattcaatggattctttgccatatatctgatgtgtatattgttgttgtttctaggataatttgaagctgatggatgatctggctgcattgagaccaacagtatttcctagtgtgcctcggctatataatagaatttatgctgcgtaatccaactacacccgtaacttagatactttcatgttgggaaaaactatttctagtcatatcctttttgaggttagcattttttccccttttcagtacagctaagtggttagttgtttatcattttgtagaattacaaatgctgtcaaggagtctggagggttgaaagaaagattgtttcatgctgcatacaatgctaagaggcaagcgattattaatggtaagaacagctcattgatattaagtgtcttagttttgcaatgacttctcatttaaaaacagttcctacatgctttctgtgacttatgtcatatcccatttttttgggaaaattgaaaccatgccacttttttatccactacatctacatgtatgaaatgttaattctacattttgggttattagggagaaatccgtccccaatgtgggacaggttggtatttaacaaaataaaagctaggcttggtggacgtgtgaggcttatgacttcaggcgcttctccattgtcagctgatgtaatggaattcctaagaatgtaagctgtcttcatatatgcccttggggtagcacgattattatttagaacttggattaactaatatactactgttttaattttttaacagatgttttggtggtgaagtactcgaaggatatggaatgacagagacatcatgtatcatctctgcaatgaatattggtgataggttaattggtcatgtcggatctccaaatccatcttgtggtaagatctgtgtttgggtttaactagacttggttggataaataacttgtccttttgttcacagtaattcctcactgttattgtttttgtacattatcacttctcacactcttccataacgcaaattctgtttctatttttcagagattaaactagtggatgtcccagaaatgaattacacctctgaggatgaaccatatcctcgtggagaaatctgtgttaggggacctacgatattctgtggttactataaaga

SEQ ID NO: 12761 - DNA, 2401 bp, Oryza sativa
ctgtgctaaaagactaaagtgaaagcaagatgttaaaccatcttagctattgatcaaagagcaaaccaaaactatcttacccactgttattgtagcagacagcacatggtagccttcaactaggaaggttgtaacacatggatgtttttgagaaatgaccacaaccctattgtgaaatacttttgtctctaattacttattatcctctttccacacattttcttaggtaatttaagcccctggaactgtatttgatctgattagttttcttattaaataaattattaattgattgtgttttaatggtctcaaggaaaaagaacattttcaagttagctcaaggagaatacatagctcccgagaagattgagaatgtctatgctaagtgcaagtttattgcgcagtcctttatatatggtaatattcatgtccttatactggttataactaccaataatttgccatatatgttctaagctgttgattcggatgcaggtgatagtttaaactcttctttggttgccgtagtagcagttgaaccagatgtgttgaaggcttgggctgcatctgagggaatccaggtaaatatgctgaccttagagagtagatattctgcaactgcacaactggtttctccaaactagcggaacattatattcttcttgcacctctttgccagttcactacacaaattatgtctctctttgtcaaaaaaaaataaataaataaaaacagaacacccacaaataaaactccttacatcttcgttggctacttatgttatgtcctttctaacctgtagcacgaggatttaagacagctttgtgctgatccgaaagcaagatctgctgtcctggctgagatggactctattggaaaggaagcacaggtttacttctcacttctcataaccttgcatgctcttaataagttatgaatcatgtgtatgattcccttattaatctctctttccttgctgcaccagctaagaggttttgaatttgccaaagctgttacccttgttgctgaacctttcacattagaaaatggtctcctcaccccaactttcaaggtaggcccgttaatacaagttggaggagatttctacaccaggtactaattctctatctcaatgacttttgcaggtcaaaagaccgcaagctaaggcatactttgcaaaagaaatcgcagatatgtatgcacaactgcgccaagcagaacagataaaacctaagctgtaactacccgagtgacaatcggagtaaaagttctagcaacaaactacaaatgactggcttggtatagtgaaggcaactgtgaatgaactctgttggatatgtccacgaatgcttgataatcatctaataggatgatcaggtaaaagaatagcctgttttatgtacatctgtaagatgaaatgaaaaaagatgtagacatgttaaatgtcatatatatgaatccattgaatttcacctgactatcataggaatataaggtaaaactttccctcttaatcctgctgtgaggcattctgccaaccacttgccaagcaatattcatatggaatggatctattgaatttcacctgactatcatatcaatagaaactatggaattgtttccctcttatattacatgtcttgatccttctgtgagaccgaggcattttgtcaggcaatatacttgcacagctgttatattagagcaggtttctctggatgaaggcacatttcgcatgaaagcaaataatcgacagctgtttattggttagcgtggagctaaccatcacgcatcctcctgcgcagacgtggtgtttcatagactgttataccaaagctttaaactgatagtggtctgttattctttctgccatatttttttttaaaaaatatattcactttccaattgtacaggtcactgaaattattgttagtttaaaatgcaatggtaccttttattcccctctcaagaactaaacatgtctgcaataataaattaacattattcacctcccgattttatatgtcaattcaaattatggttagtttaagatgaaataccttatacaggtgccctttcatggacacaacaagactaaaataaattagtaaacaaatatcattgctaatcagtttggttaggggaagacgctacttagattcagtactagatttagatagttgttcacgggaaaaaaaaacaaaaaacaaaaaacaaaacaaaagtagaagataaacaggatgatcccttctcacaaataacaacaaagttcatacaaaaatttaaagttagaagataaacgagacggccatttctctactactgtaaaaacgaaattctccctccctatcatcttacttcccttgacgtcattagataaaaacgaaccgttggatgataa

SEQ ID NO: 12762 - DNA, 3150 bp, Oryza sativa
aatttgtgaagcccttggcaaggggaacaatccaatatattaatactcaattaatactgaataagggcatgtttagttcacgttaaaatgaaattttagttgaaattggaacgatgtgacggaaaagttagaagtttgtgtgtgtaggaaagtttcgatgtgatggaaaaaattggaagtttgaagaaaaaatttggaagggctaagaaaggagcgtttcagtttcccatgcaactgagtcctctctacacaagcacccagtacggctttagctgaaacctttgcacttccatttcaaccttcacaaatcacaaacaccccaaacccagctttcatcgttttcatcttatccaaattgactgcatctggagacctggtcgaagcttgctgacgtacggcgccggatacaagctccctccgcctctttgaggccatgtaatgaggtactacctcccctccgcttccctctcctccatttcctgcatctcaatctgaggtcgcatccacctgctgcaacgagacggagagcgcttcgctggtattatcatatcatgtttatgtcgtgtttgtgttatctggggaggtcagaattgagatgttgggtttcattttcttattagacaggatatacttttgacagggcggcgcgcctgattttctagtttctctactactgtaaaaacgaaattctccctccccatcatcttacttcccttaacaaacaatagtgtttccatgtgaaaattaacccatcaagaaaacagattagataagactgaacctcataaaaccacgtaccgatcgcttaaaagactctagtgaccattagcactcttcagagcaagaataataatacagccagctgcttacttatagcctatctatcatctcactcatataatggttaactcttcactataaatatatggtctacctatctgtctcacagattttattggttcttgtgcctaagccggctgtaaacttatagctcgcttctcatctctctcctctcctctctcatccacatcagcattcagccttcttatagccctctattatacttgctctcaggacactgcacacccgttggcgttgtgctctcttattctgttggagcccatcttactatgtgtcatcaaagaacggcaattcgtcattaatatgtctcatcaccatcatcacttcccatgcattcttgtataagctcatcacaacctatctcttgatcttccaagacggccggggttgccataaattaatcaatatatagtctattaatccgtcctccaatcctccgaacaaatgcaccaccattatcttaatccaacccattgacagcgagatgtttgtgataacttcatcaatatcaatatcaagatataccggtccactattccaaaggtgtttatagagatagaatgtgcatgtatattcatagggataagtgtgcgtgtattatgagcgtctatatttgtaccgcgtttctaaaaaaaaattatcttgatcgtaccacttatacgaaggatgatcctccatgtttccattttgtagcatattgtctgtttgatactgatgagcataaccctcaatatttccatgtggcaagatatagtcaggatggacagtatatgacgttagtctagatcatctccaaatgcatgcaacgctgctattaatattctcggcttgctggtaatggagattctccgtgtaggctggctgtgtgatcgtcatcaattgatcagcagagtaccgtggctgctggtcctggttgcaccacacggcagggccctgtctgggctgcagcttgcactactagctacgctgtcgtcgttgagctgagaaatgcttggtgtgtttgcatgttgttcttcgtcaaacatcatctgcatataatggggatcaagttgacaaagtgtctccaatatgttattgaatgctcttcctgcccttgggaggtagccgcttcctgccttccttccccttgctcttgcatttgctgccgctcttcgcctcttttccggccttcttttgatcaaccttgtgggtatgcttcaacaccatcggagccaaaatggcatataaacaaaaagtaatttatgaataaaacttggtatatacgtgttgttagcgatctagtttgtagaaaatatagaagtattttcgatacaaaacaaacatacttctaaaatatattcatccagctctgctaggctggatgaaacggcccaatactgctccctcccgcagaaggcccaatagaaagacaagcccaagcagtttccagaaggcccaagtagcccaccgtcgcagccggagcaaccgcactgttcacacacgcaacggcgcaacacaaccacttcgtcgtcttcctctgctgcttccttctcctcccaagcccccgctccgctccgacgacctcgccgccctccgcctacaggtgaggaggtttttctccgccgcggcggacgcctccgctcgccgttctcgcttgggtttttgggtgattctggctgggttctcccctgatcgcacatttcgacgcaggtgggcagatggccgcccgtccaagcagtacaggcgaaggcgggcagctccagctcatggacgccgagaggatcgaggaggaggaggagtgcttcgagtccatcgacaagcgtacgccctccgcctcatctccatcccttcctccccctgtctcgtatcccgcactgcattgcttggcgcgcctgctcgtgtgcgttcgtgtgtgttcgcgtgtgttcgcgcgtgcgagtggcagtgctcgttctgcctcgcctttcaattagtcgctgttcgacttgtagttcgatgcttgattcgcggtgaagtaaacgagatttagcattagtacgtttccactttttttttgttggtttcgattctgcttgcgagcagcgtctggatgctttgtgatgtgcgtgttgggttgcttctagttttccccccaatttcgtgcgttctggacataaattagcctcgtctcgtgacgaatttgttctggaattttcgccgctccacaattgatctctgtttttgggctatttcctgctgatcggtgtgtggatcgccacatcgcttgctatgagaggatcgattagaatttatccccatttttagtcaaat

SEQ ID NO: 12763 - DNA, 12369 bp, Oryza sativa
ggtgcacttggaggtttagggattaagcttgagtgcctctgcactttacgttttctggtggctccctaactctagcgagttcaattttagtaagttgtttggtgtgatcctgacatttgcctgtgtttcatgcttcatttggttcttcctgcaaattattcattgccgtgaattcaaactaatgagcatagttcctgcattactgttcatctctggtgcacttgtctacagtaatctcgcaagggataaactctggagatgtgaagaagctgcaggatgctggtatctacacttgcaatggcctcatgatgcatacaaagaaggttgtgaactcgggatcccaaaccttcatgccatctcctgcttgttccatttctggtttatgacacccatcttctttcgtttgttctatttctttcttacagtatgcttatctgatattgtttcaatatatggattcatcttgtagagcctgacaggaatcaagggattatctgaagcaaaggtagacaagatctgcgaagcagccgaaaaacttctggtgtggttctcttttcattattaaagtctgaaagcttcactgtcaattctgtgtgatacattcttctgaaattgctatatttgtttttctcagagtcagggcttcataacaggaagtgatctccttattaaggtaaggaaataggagctaatctgcatacagcatactagtgtacaggatatggtgttatagcaaactaagtggaaactattccttgcttcatggatgctctagagcttttagttactccagctgtgcacttccctgggctgtttggtttattctttttcttcttttgaagcggaaatctgttgttcgaatcaccactgggagccaggcgcttgacaagctgcttggcggtagcatatatagtcctctgattatgttatgatcagttgttgcattatgttgttctaatctattttcattcttcaaattttcaaggagggattgaaacactttgcatcacagaggcatttggagaatttcggtgcgtagacgttcttgttccttttgattctttttcctggattacaactgcagattggttgtaccaatggaatgtggccatatctgtctaatagatatggtgaaaatctagcttagcaatatgtttagtattctggttgaagttaatttgctaaggctgttgtgctcccatttttatcatttattcatgccagtatatacagtaaattcctaaatatgtttgtattctgctaacactgagaacttaatactcctcatgtgtaaacttcaggcatatacacatcaatattgtctgaaactgttttctttgatgttaatactaaattggttctactaaacattaaatttagctgagataatcttgttttgcgacaaagttgatgtattatagaatgattccttgaattgcagcttggaacaatttggctttgtgtagcacataaataaaacatcttactatttaatgtgaaccagccaaactttgacccttgatgtactttgatttaacgttcatcattcgtcaatttggttccagcttcttagctttgtaatttgtaatctgtcatctttatttttggtcctcagatcagggaagacccagttggctcacactctatgcgtctccgctcaggttcatttccgacacatttttgtcatcaacaccttactaccatagatccaatgaataattttatttattttttgtttgtgaactgcagcttccaatccacatgcatggggggaacgggaaggttgcttacattgatactgagggaacattgtatcttttgaatttactgagtaataactcagctgattcactcaatggatttatttgcatttccatatcgccccaacttgtttccttaatggaattttcagccggcctgaacgaattgtgccgattgctgagagatttgggatggatgccaatgctgttcttgataatgtatggctcttaatttgtctttaccatttcaggcctaacagatgaagctgtatgttatatttccatttatttcttgtttagatcatatatgctcgtgcatacacctatgagcaccagtacaaccttctccttggccttgccgctaagatggctgaagagcctttcaggcttctggtaggcatggctccataacataaaagaacattgataaatttgtgtatctcagttacttatgtggttgttttacctgagtagattgtggattctgtgatcgcactattccgtgtcgatttcagtggcaggggtgaacttgcagagcgccaggtattgtcaatatttgtgttggtagaaacaaaaaaaaatcataaagtagttgaaggcctaaagttatgtactaattactctgaacttgcagcaaaaattggcacagatgctctcccgccttactaaaatagctgaggagttcaatgttgcagtgtacatcaccaaccaaggtgagctttcaggactatcctgtatatcccaagaaagagtaacaccataagggatttcaaattacaagtgtcctccttgtttcagtgattgccgacccaggtggtggaatgttcataactgacctgcaaaaaccagcgggaggccacgtgctggcgcatgcagctaccatccggttgatgctgaggaaaggcaaaggagagcagcgtgtctgcaagatctttgatgcccctaacctgcctgagggagaagctatatccttttgtatatacatatacatgtttaccaaaacttcttgtgcaattggtaacttcggttcagtaggttgctaaaatattgattggtttttctttctttgttcagacttgctcctcaaactcttgtgatttagttaattgcagatgctgttttcggtgactggaagtccaaaagctttgcataacagattattaatggtgtggtgtaaaatagttgcttcccttgaccaataacacgttttccaggtaacatcaggtggaataatggatgcgaaagactgaatgttcattgagggtgcttcctgtcttcaaattattcaggtttctcctagtaaattcctgcataggccatataggtttggtacattgactaaactactactgctactttgccactgtcgaggaaatatgcaacctcatttatccagacgattataccttaaaatgggtatttttctatgcttatgagatcaacagttgtactgaaacaaatacagtattgtcttaagtgaaaaatatataagaggtttacatgatggtaactttccccagaaactaaattctttatacccgcgtgtgcacaatttatacaatctgacttattctgctgtatcagctataaggtccttaattatttgatcaaaccccaaacaattattttttgcggcttatcctgggatttttccttcaaggacgtggtctaatctctctatactccagttcttcagtcccccaatctgcaatcttcagttaaaccacaaaagaatcccagcatgtgcgacaagcattttctcgttagaagagactccagttatcttttagcatgcacttcttcaattggacagaacaaggatcattagcataatcggcatagttgcagctaagctaacaacaaagagagttggaatgaacatgccattgtacttgtagtttgatattcggtagaggagatacataacatgcttccaattgaaaagtactactcgatcttggaatagatcgatagagaaacatgcttctagctttagctttacattgatgggacgataaaacatcgtctcagtctgtacaacacaactcttggaacagacaaatcaccaatctgcctaatgcagaggatatttaggtgaacagaggaacaaaatacagccttttggccggttcatcagctggttgctcctagctccgggcacccaagcttgtcgtcatcctcctgctgtagtgctgtgtgggtagagcgcggcggcagagagggcagatgcagctgagccggagccagtcgaagatgcagcgctggtggaaggtgtgggagcacggcatcatcctcagcttctcctccgccacgaaatcctgcaagcaaacggcgcactcctcctccctcgcgccggccgccgtcacctcacgcaggccttggatggccttgctcagctcgcctgtaggacgcagccgcctcgtcggagatctgtggcgtggggtgattgatctcctcctcgttgccagatgacattgatgaatacacgtcttcggatgatgatacgtaagcttccggcggcggcggcggattttgttccaccctcaggggaagcctccggtcgccaataaccaggtggctatagataagattcccctgctcatcgaagaggggggccattgcgatagtatacttctgtatggatattcatctctccggccaggagcacgacggcggcgacgcgatcgacgacggagatgatgaaacgagtcggcggaaggaagaggaggctgccaaacctccgactcggatcctggtatgatggaggcgcatacaaatgagggggcaccgggcgctgttttagcacttagcgaaagaatgttctttaaaaaaaaacacggtaagattactagatgaaacaatttggtttaacttacacaacaaaacgatttaagtcattgaaacacataaaatccgtgtacatcaaaacaaaccccgtatatatcaagtgaaataattaaacactatctaaaatccaccgtaacatttgattcacacacaaagaaacatcacgagcatattagttgaaacattgcttttgaaccattgaaacatcaacaaagctggtgaggcaaaaatagaaatatggaatactatcgaaatatccattggaacatttgatccaaacataaagaacatcacgagtacactagttgtcgaaacaagatttcggcaatactaaaaggggtggcaattaagctagaaaagtggatgggttatgagacacaaggtttatacaggttcaggtcttctcgatgagaagtaataccctactcctgtctggggattgatctgccgagtgtattattgatcgtatgatctgggagaaaagttacgctcataagagcactcggacccctccttatataggaggaggagccgagattacaacatacaatccatgttctttatggactaggcctttagagataaattacaatcataaccgactagaactatcggatgtttccttgatacacaagttaacattacaaccgagtcctttactacacatattctaaccgcataaagtatcccttataaccagtcagatatctatgccatgtgggtatgtagtacccataatctccacactagcggaaacacacaaaaaacacaaaacctagtctaaactgcatcttcctactctccgatgaacacagggttgctcgcatcggtcttctccaccacccccatcactggatctggagaaggcaggagagggggagggcagcggagatgaggagggagtgctcctgggagagagggggagccggcgagcctcctccaccaccactgccgccgccgccaccaccacctcgtcgggcgtgcgttgtcctccgcgtcggccgccaccacggggacaaagccaccgtcgacgttgaggaagacaaaaagcggcggcggatccgacggagaaggcgacgtaggcgaggtcgtgggggagaggaggtagcgtgggcaagggagctcgtgggagaggaggtggcgccgatgggggagaggaggcgacatgagtgagagaggcacggggagcccgagtgacaaggaatgagacgtgcgggcgcccgatatttttctctcatcaggcgcctgagtataaggatgcagtgcctagggggcactcggactggctgcctgagatcaagatggatggccgggcatgcgcaagcggtcgaaccccacgcctctactggcgattctccgccaccgagctagcagctcgttgagcctggtggcggcgatgccttgccctgttgcccgccgctcatcgagtctgcaggtggaatggaaagggtgacgtaggaacatgtgaatgcaggagtcccacttggggtcgctgatttcatgcccacgtggattgatagacgatctagattattggtttttacgtaatcctagtacaattctgcttgatatttcggcccactctcgtccatgcctagcgtctaaatctaaaagtagaaaaattctcatatcaatcgcataaaacaatgggcaaaattctgatcatcaccttcactgtactcgagtcgacgaccacgacgccaccattagcgcctctgcctgagttttgattctgcccctcccgttgccagtaccaccatgaaccacaaaattgggttccccatccttgtgctctccttggtttgtcccctcgctaccatcgacctgcaggcgattgggctaaaacaagtagacttgtcgggcttggaaggtgatgtgggggaagaggaaatgtggcgaacaataaaagagttgccgggggattgagctcttgcacccgatggttacactggtctcttctttcaaacctgatggggtataatcaaacaagacttgatgagggctttggacaagtttttccaaggaaactttcaaaatttggacatgcttaattcgacaatgattattcttctttctaagaaggaggcgcccggcccttttgaaggactaccacccgatcagtctaattcacagcttctccaagttggctacaaaggttatggtgactagactggcaggctaaatgggagagctcattccttacactcagtccgccttcataagaggacgttcaattcacgagaatttcatgtttgtgaagggcatggcgttgctctgtcacagggggcacaaaccgatggtgttgctcaagcttgacatctccagggcgttcgactcggtatcctggccgtttttgctgaggttgctacagtacaagggtttcggggtgcggtggaggaggtgggtgtgctcgcttctcctgacggtgcacaccacggtggggctgaatggagaggaatgtgaatcaattaagttgatgaggggactacgccagggtgatccgctttcgcctttgctctttgtgctcgtcatggacgtcttgcaagccatggtaaccacagcaatggcttcagggacgttaagagggactggtactgctttgcagtcgtcggccatttcgttgtatgccgatgatgcggtgatcttcctccaaccaacggaacaagacacataggcaatcaaagcgattttggacctgtttagggctgcgacaggtctcaaagtgaacttcaccaagagcactatcaccacgatcagatgctcacaggagcatccgcgctcgtccagtccatcccgtgttgtcagctcgatcagttcccgatcacctacctcggcctcctgctctccctccgacagctaacaaagcaggatgttcagcctttgttagaccgtttgccaagaagttcgtgggctggaaaccaaatttcctctcgacgggtgatcgacttgtcctgattaagttagttctgttagctttactggtgcatcaaggtttaccaaaaatgatcgattatcacgttgccttttcctgaaaaacatttgcccaggagaaacttgtagttcaaactgtttcttcctcaggcctccccttccctccctatccaactccactgcctctgccatcctcttcctcccctccaagttgcattccacctattcacctacctctatcgacaccggccatagagtgcaccaccagcgtcatccgcaaggccatctacgcactacctaaagcccccggtggcgcgatccagtgaagaccaaggtaatactggctgaaggtggtggaggtcggggtggaggcattgtagacgatatgggccgtttggagggcggtgccgggaatggagactagcgtcgtctttgttctgcagtgaacgggggttatggtgactactcggagggcggcgctgggagaggcactgcgtgggatggctaccaattagagcacggcgatagtgccctgaaaggagacctgcagcatctttgcgctgtagtgaacatgggccacttgttgggcgcctccaatagaggtgctaacttcgacgtggattgctcaaggattggttccggcagaggcggctactactcgaagggcggcgctgtgcgcgatggcgaccagttggagtgccgcagcagcgtcctgaaaggagaccaacattggcacgccgcagaagacgggtgccgctcgctgcgagccgccgacggtggaggtgtccagtgtccaagtgctacaatgcccgtagattgcttgttggtcagctcaggtagagaggccatggtttgtgggattatcgggagagcagcgccgacaaaaccggttatggtatacggggaaacactctaggtagacgctattgggaggggtcatggtcgaggacctcaaggtggcggcggcatggaggggagcccggacatggtgatgtcgtgacgagcacgacgacattgcagtggttttagtggtgttgatgctgggacacattccattggagagtactctgtttcagttaatggagccgatgacgtggccaaccaccaggatgccgtattcagcacatatgggtatgattgttcccatgatttgtatttagttggttgcgctgttatgagtcatggacacacatataggaaagacttctcctcttgttctttaagatagagtttttctacaagcaagaaaagctcagggaattttcagcagtgatggtgctcctgatctcataagtgagattacatatgtttttactgaataatttaggcccggtttcatgtttcgcgttgactcatctatatggagttatgtgattgatcaattaactcattagatgaagattttgtagggaagtgagtctcacaatttgttctaattaaaccttgcctacccaaccaatttggattcctacttgatcaattgtaaggaggtgagtgtcacaattgttctaattaaccttgcctgcccaactaattttggatttcctacttgatcaattgctcaatcctattttgcgtatggatgacttaattaaacatattctcttttcatcaagggggctgtttcggaagctaagattctaataagtagctggttggtagccaggttcgtagccagtttctgaggatcttccggcttctaacttagttcattttctggattctataactacagcttctcataatctagaacaaaagctcgattgtttaggggagtttttgattctgggaaagctgcaacaactataagctccccaaacaagtttcaagattattttagttggggtgaatgaaagaagaagagcgtgacctcttttaaaagacaaaatggatgattttgtttggaatcagtaatatgtatggggctgttcggaataagcagaaggaaaaatttctaattgagcttgtacatatttgttaacaacaaaaacaccccctgctggtaggggatttcaatattataggtaaggagaattacaatagatggagttttatttttaatgctattattgaataacataatttgagagaaattatcatgggtgggatgaatttcacttattgtaagaaccagagtaatatcacgtatgaaaagttggataaggttctagtttcaaatgatttggagtgtaagtgtcccaacggcagaagttagaagtttggagagggtcggctaacacagggcaaaatcctattactcattctggttttaaatttgaactgagttggtttcttagagaagacacagatgaggtagttagtaaggtgtggacagaacatgggactcaggggtagtattgaaagatggcaaggaaagatgaaacacatgaggaaagcacttaagggttggaatttaaattgggaagtgtctacaagaaagagaaaaagaaaattctagagcaattggataagattgacaagtggtatgaaagtaatggtatgaatgcccaaacaagaggaaaaaaagatcttggaggaacaattgagattcacagtaagggaggaaagaattagagagaatcccttatatgccactagaatttgaccagttcccttatatgccactcaaaattggcttctcccttatatgccactacttcaagttttttcacccttttatgccactcccaccactatagtgttagttgactgttagtcaaaggttagtttttttgtaaatgaccaatatgccctctcaactaaaaaatatgtaaacttcaaaaaatcataactaatttattttaaatcctttttgagtgaacaaaattttgtcagaaccagtgaaaaatgctctttatattaaaaatattgttggaaaactgcatgtttcatgcttacattgaaaatttatttgtgatggtaatggctaaaattgcatgtgatgcagaaaaaatcaattttcatatgttgtatccagtagctatattagtactaaaatacctattattggttgtatactaattctcaagggtaaatgcgtctttttacaatgaagttaacggtcaactgacggtgtactgacggcaatggcttaaaagggaggagaaatttgaaccggtggcacaaaagggagaagccaatttaaagtggcatataagggagccggttaatttagagtggcatataagggattctctcaaagaattaagtggtttcaaagaagtaaagaaaaggagattatggagggtgtgatgtgatgatgactactatgatacaaccattgctcacatcatggatcaacaaaaaggcatcatgatcaaatcctccaagtgctggaatccaatttggccacatgctacagtgctgatttcaaacagctgccaagtgtgcatatgtgcccaagaaagaaagaaaaaaagaaagaaagaaggaaaagagaaaatcaattgtatatttgagtttgttttcatatatcagtgtgtgcttgagttgtttctggtgctatcttgtggtaccgtttgtgtctaggctcgtgtttctactacattctagcctaggacaagcacaatacttgactttgaacaattattcaagtttgcattctctgatacaagcatttgctattcctttgctacatatttaagcctacccagggctccacagatttgattgcagtcgtacagctagtgtttgccaaggcatcgatacattcaaccttcattagggtgcttggttgagtcggtgtatgtcaccatctagcttgcattagtaaaaacttgtaagaacctggtaaaaagcttgagtgtgtgtgatatctgagcttctactacctagtagctgataggagcatgcatattcttatgtgtgtttcttgtttgctattaaccatggcagaattgagcaatgggatatgacggagcgtggggctcctcaccgggagaccgcgcaggcccccctttgccggttcggccgggggcgctaagtgaggttcttcgccctcgatctggggaatgttcgcgagagagcaaatgcacaagacacgggcgatgtagacaggttcgggccgctgagaagcgtaataccctactcctgtgttctggtggatctgtgtgtgaaggagttacagagagccggagagcaagagagttcaggctctagaacccctcttcctctttctctcctctacgagctcaggtattctcagagtcgtctgagcgtccccctttcttcggtgggcaaggtcctccttttatatctcaaggggataccacatgcaccacttctacctactcttcttttgggtggggacccaccctatcttgaccaaaacctggctcgcgccttcgcctggaagctaaatcacagcttgtccttgagtgaggcccagcgccgtcactcgcctgacacaggggataaccctgtcattccttcattaatgggcggagatttgcaatggccgctgtccgaatgaccctccgatgggatgagtcatacctacctccactccgccggaagcagatgcaacgtgggagcacggttgtctgccgatgacgtgaccggcgtcagaccagtcacaaaccggtcatttttgtccaccgcgcgtcagtttagcatgccgcacgtctgcccttcttcatacaatgacttccttgccatggttgcgatgaagcctggaatgaatctggccgggactgacataccaactccaggagttagcacgccggctccggctagggacgagtgcctggaggctctcatcattccgacgggacggggcgaggcgtgtgacaggccgcctgttgccacctaacccgcgatctgaccggtccgt

SEQ ID NO: 12764 - DNA, 6682 bp, Oryza sativa
ctgcagcccatgagaaaatattttgtgagttcttattacagatgtacacttctggagaaattagaacatatgaaacaaggtgataaaactgttagagagtatatccatgaatttaaagtttgtagagtaaatttcagattggaccccttttcattaccatagttgcacaatgggcaagggtctatcaacacttttcatatatcaccatctaaccttgccaaaacatagcagtttggaccaggtgtagtggggtactgccttgagctgctaccatggctatttcacccagggtgaaagatgaggtgagcactatgcacaaggggataaacggcatatatcatgctggattagattaaaccaatggctcctatgtgctatgtgttgagaggtcagtggcaactagcaagacgattcgcatggccagacaattgactcaaatagcagccaattttgatgcttacgtgccttgttctgccgctcgtgtgcctgtagctggggctttggcgcagtcaagctgctgtgagaagaacaaagcaaagcaatgcatcaggatcggcagcgccaccgcttatgtagctatgtgtggaatacaagtacccgggtacccaaggagaggcctttgggccgtacggcatagggtgggccaagagccctaggcccatgcgacgtacttgtaaataaaagaaagagatatttccgggataagatataattctcgaggatcatgcatatctttatagatagaatacggagatctagtttcaatcaactacatactttccttgtaaccctccctcctcatcctatataagagggggcaacggtctcgagaggagagggaggtcggatcatctccaagatttcttttttgaccatttttccaccgatacagagaatcaaccacactggacgtagggtattacctcaccttgagggcctgaaccaggacaatcatctgtttcactatctctccttaatctagcgcgccccataaaatatattgccaatcatagaaatcgacagttgacgccccaggtatgggggtgctagatcgtttctttaaggagatagcttcaaccaccgatcgccgggtttgtcgtttcaatttgtttttatggtttgattaatttctaatcatagattgatgcgcgggtatttcttgctttcatgtcccgacgatctggccatccgccgcacgttggaaaaagcagttcgctgccaggacgagatcaacaggttttggccgtactgcaaatcgccgcgaccgcgaagcgaggcgaggcggccttgccgccaaccgcgcaagccgtgggcaatgcacgtctccgcgcaagccgtccatgcagccacgccggatcgtgtctgatatatgggaagccaatcgcaggcggcctggaaacacaagcaagacgtgttgatccagtcacatgcatgcgtggcttaatcaacaatcacacatgcatctatacagcaagcatatacatgcatctgtttgttccatttagactaatcttgccggttgctaatcccgaattaatctgtgattttttgcatgcatgtcgccgacggcttctacgatcggagtatgtaccggcttaagctgtccacaccgagggcacgcacggccgcacgcgggagtgcgagaccaccggccgccagccgccagctgccagcgcacgacatcgcgtgacgtcgcttggttaagcatgatcaggccgtccgtctcgattgtgtgcagctgtgcagtacatgcatgcgatgggccacatgcatgtgaccgatgattatctgggagcaagcaaatactccatgcttttctttgactttgcatctacgtatatacatatgtatttaattcattgatgctgctgcagttgtttcccctttttgttttgcacgcacgctcggggcactacgccgcacattgggaacttcatccattacccggctggcgcggctcgactgtgcccggggcacacctgcgttgtctgggcgctctacaccgacccgccacagactcgagggctttgcatctcccgttgtccgggcactccacgtcgactcaccacagatccgggggcttcgcatcccccatcgaccgtgcactccacgccgactcaccacggacccggggggcttcacatcccctatcgtccgtgcactcctcgccgactcaccacggatccaggggcttcgcctccgtcgtccaggtgcccttcgccgacctcgccacggactcggggggcttaacctccctcgttgtccgggcgctctacaccgacttcgctatggactcgggggcttcgcatcctccgtcgtcctggcactccacgccgacccaccatggactcgagggcttcgcctctcccgtcgtccgggtgccctatgccgacttcatcacggactcaggggcttcgcctccctcgtcatccgggtgcccttcgctgacctcgctacggactcaggggcttcgtctcccccgttgtctaagcgctttacgccgacccgccacggacttgggggctccgccttcctttctacccgggcgttctacgccgaccttaccacgaactcagggacttcgcctcccttgtcgtccgggtgttcttcgctgacccgctacgggctagggggcttcgcctccctcgttgtccaggagctctgcaccgactctgccacgggtttgggggcttcgcctccctcgttgtccgggcgctctgcaccgacccgccacagactcaggggcttcgccccctcgttgtccgggcgctctgcaccgactccgccacgggctcgggggcttcgcctccctcgttgtctgggcactctacgcggactttgccacgtactcgggggcttcgcctacctcgttgttcaggtgcacttcgccgaccttgccacgaacttgggggcttcgcctcactcatcgtccgggtgctctttgccgacttcaccacaggctcaggggcttgacacccctcattgcctgggtactactcgccgacaccgggtgacaagctcctcgcgcaggacggctacttagtcgctgactgaagacttgcaccgagccgaccgcatacaccgctgtcgggtgatccgctccgcgcgcaggacggctactgcgttttcgaacgaaggcttgcacctccaagccgaccgcatacgccgccgccgggtgatctgctccccgcgcaggacgactactgtgttatcgactggaggcttgcaccttcgggccgaccgcatacaccgcctcagggtgatccgttccccgcgcaggacggctactgcattgccgatcggaagcttgcaccttcgagccaaccgcctacaccgccgccaagtgatccgctccttgcggaggatagccggacgtctacgtcgatgcctagcgacttcctccccatgcaccatggctgcttcaccgccactgactgagggttgtgctccctcagcggatgcaacccttacttgatgagataaccactcggctgcaacaattttcacttagcaatattgagatgagtactcagccagtcttgtcttcaccagatggcttcaccaacctctgagtcttcgtcaagctaaatactcgggggctactgtgggatacacggtacctgggtacccaaggagaggcctttgggccgtacgacatagggtgggccaagatccctaggcccatgcagcgtacttgtaaataaagaaagagatttccgggataagatataattctcggggatcatgcatatctttatagatagaatacggagatcgagttgcaatcaaccgtatactttccttgtaaccctcccctctcatcctatataagagggggcaggggtctcgagaggagagggaggttggatcatctccaagatttcttctgggaccatttttccaccgatacagagaatcaaccacactggacgtagggtattacctcaccttgagggcatgaaccaggataattatttgtatcactatctctccttgatctagcacaccccataaaatatattgccgatcatagaaatcggcaatatgcttgtgcggatgccggatgagctaaggagctcaaaactgtccaatgtccgcccttccccttgctcgaggtccatcagcccatgcatgttcatcactagcacctctggtgtgcgagctgtgcgctcgaccccacgctccgctagctcctccctctagaataggcaacaagagttgggcactgttgcactactccttctccctacagatcaagccaccagagttgggcacgatgcagcagatagcagagagagaaagagggggaagcaatggtgttgccgcatctctgatggcccattggacgtggagaagacgagaggtggactagagtgaaacaaatggtaagtttaagtggttcaaagtgaaaaccttggctaagatatgatccaagctgcaacatgggtaaaaatatatggaccacactaaaatttactcaagtttgtatcatctatagtggtctaaaagagtgcaatgaaaacacaatgcgtagatttttcaatgggctcaattttgaagttcaggttatgcttgctaatgtggcatataatcatagacacttattcatgcttgctcgtagcgttaagagtaaaattttacaagatttcatatcaaatacgagaaagcatgaacaatgtgatttatctgttgtttctgaatctcctatttccttgtgcaatgatgatgtgcaaacattggaggagcaatcttttgtgtctcctgttactaacgttttgcagggagttcaaaacaatcaacaaaaggaggagactaatgttcttgataagaaagcggagaagtatgaagcacctacaatgtttgaaaaaagtttgcaaggtaaattaaatggtgctgagataaatgaaggtggatattctcaagatgagctgcacatgtccactcttcatgctatggtagagcaactattagtggaaccaattgttgacattcttttgtcacaagttgatttgtttgatgttccttgtgataaaaaagaattgtgtgataatgcttcacttatatcaatgccacaactagtgaataaccgtgctatttctagtgtgagttctttctgtgctgattttaagcatgtttttcacatttctcatgaagtagaggaacgtgaattgctttcttctttaaatacttagggctatgttcggtttgatgacttttgtgagctcgataattttaaggagaaattatttgctaagtctaatttgccatgtccgactaatgctatttttcatatctttggtgaatataatggtaaaggaatatatttggtgcatagagtttacatctgttcggatttagaacctcatgtagatgtggataaaacatggacgctagggagatgttattgctaatcatattatctcgagtttgtcttgttttgatttaaagaaacaggttggttttgaagaaggggagcgacaagatcgctcaatgttgctactttgtgccactgaaaaagtatcatgtcaatgctttgtttatgaagaaggggagccgagatgagctgcaagagaattatatctatgtagttcctacatactttgcagtacattccaattattaggtacatttgtttcataggagattaatacaatttgctaaagaactaatgatattacatgataaaattttgttgcgtttgttttcttgtagacacttctacgggcaagatcatgcactacgcgatgaacaccatatgaaaaaaccgatgacgtttttccatgaagaagaggaggatgatgtgactatgactactatagatacaatcattgctcacattgtgaatcaacaagaagacatcacgataaaatccaccaagtgctggaatccgattcggccacttgctagagtgctgatttcaaacagccgccaggtgtgcatatgtgctccgttttgggcccgtgagtacttaatggaaagctatcggagtcctctttcaaatggatccaacctcatctccaaattccatctcagtcggccgcaatcatatgaacaaagtgttacgtcactcataatgggtctataagcatgtaacttcatttgggatcccagcctaagtggagcccatgtggggtgcaccccatccaggtggagcacgaccatagggaccccttggtcatcctcccacccccttaaatagctaggtacctcttcagggttttttggtttttgtttagattaaagtttagcttcactactttgccgtgtaatcctgtggtcgattagattgctgatttgctcgttacagaaccctaatttatcatttgtatttaattcctattttgctattcagattgtttttatctagttcttgcttgttttctcgatttgcttgcaggaataaggttgatctacactggctagatcaacaacccacggaaaggtgtatcgatcgctaaggcgcaacacaacaacatctcgtatggttgtagttgggtcgtcaacgtttctctcaaatcgtagttatcttcaactcatcgaaagatcggatcaatcatagtcgtgagtgtctcgagtggaacgcaagatttatcatggtgataataacataaagtatttccatgctaaggctaatggtagaagaagaaaggataggatttacactccggaacaggaaggaggg

SEQ ID NO: 12765 - DNA, 840 bp, Oryza sativa
gacgttgcgcagttgagcactaaagaaccgtacaggaggcggtcagttttggtcgaggccgcgcatcggaatgctggcccctcctcatcccatcccatccatcccagtctcagccaaggacaaaccctgcctctgcctgcctgcctgcgcgcgtctcgccatatgcgtcgcggacagaatccccatccattcaactccaccagccgcagccagcagccggcccatgtgcctgcctcgctcgacaacccgccacccccacccacaccccacgcgtacgtacaccatcctcctacgcgcgtacgccctccccgcctcgtcggcagcacatcatccaatcatccatccaccgtgtgtgtgcaaccggcgccgagacgagccacgcccacgcgacgccgggttgggagatgggtggcctacgtatagtggagtacggggcgggggatcggtgtggctgttgctgttggggggcgatctgtgacgcaagattcgtcgtccgctacgctccgagtttcatgcaggacactgggtgagtggctgtctgctttgcttttctcgcggttatttgacgcgacacatgcgcgcaggcaggggagccagcagcagcagcagcggcatgtacagaagaggcgcatgctgcattgtgcgatgtggcttgatgctcggtattactccgtgtggtctcgtggttgtaaacaagcacagctgctttcaactattttaccgaaatactgacacgtactccctccgtttcacaatgtaaatcattttagcatttttcacatttatattgatgctaatgaatctagataataacttacattgtgaaacggaggaagtatt

SEQ ID NO: 12766 - DNA, 2564 bp, Oryza sativa
ttttgacctttggggagtgctatgctactcctcgatttccgtgcagttggttggccactcctcccaacatctcatcatccaggacctactgttgtatgtgcccgccaaaattataaggaaaggtgtgtgtgctcgcatcaccatggtccatgcacctttgccttggcctgcagcagctgcaggacggtctcttcttcctcacttcctaattcaggtgtgtttagttcacgctaaaattagaagtttaattgaaattagaatgatgtgacgaaaaagttaaaagcttatgtgtgtagtaaagttttgatgcgataaaaaatttaaaagtttgaagaaataatttggaactaaactcggcctgagagagaatcttgagctaaagtttggcatgccgtcatcacgcatgccaatttttctcactgttttacaagtcgcaactctatataatatctgcatttgcaatttatacttatttcatcctaaaatatagtaatataaaccaaatgagatgtatcatattacctactaatatgggacagagaatatttatttatttacttatttatgcggctctcaaattaaccaaagataaaataatactagtatatattttcctccttttcctcactagtcacttcattggcactgaagtatgagctgggctgatctatatgcatcttgttgccttgtcaacaaggtggcaaaacagcccatgtcctgaagctcttgtagctatacggagaacggcttgattggtggttgcagagttgaacacaagaaagccagttagtactattttataggcgattcctgctgcctcaccacaagcagcaaaagttgctcgaatatacaccctctatctaaaaaaatccattcctgattacgaacatgtgtagctagagttagatttttttttacaaaggatatattaattccgatcactgcattattatactcatgcaattgaacaacttgcctaaattcctgtggatccagctataaattcctgacaccaaataatgcattccccgccatacatgatccaaaagaaaagggaaaaaaaccctccaatgattaagatcgagagcgttgtgaccggacacgtcaaatccatgcaagcagctccatgtagacgatcacaggaatctccctgaacaagtaagtactccgctccaagtaacatgcatggtcaagaatgagtagatggtagggagcatgcatgcactaggttttagttacaacaaaactgtgaagcgcatggcctataacttcttttcactttgactaaattttatgacaaacatccagttatgttctcatcagtaacctgtatgtatggtgcatttatacattcacggagagtatatatatatatgtctgtacaatatcaatgtatggtttgaaatttgaaggaaaaggacatgtagcctagtggctgcagtgacctgagtagcatatcaaggttctaagattcaatctacgtaagagcgaatttcaaattagattatttgatggctaagtctccgataggctaaatttttgatttaaaaaacctacatatatctaactggatgtagaagacaggtaaaaaaaaacccttctctaaaaaaaaacttcctacacacactccatacacaccaattagcaaataccataagaaattttataaacaattggacacatactttcaataacattacacgtatatgtgaaattttatgtctaaattcattatattttagtcgtaacaaaaaaataaaattcggagaggtttttactctttaaactatcaaaattttcactctttttgttatggctaaaatataatgaatttgaatatgagactttgcagatatgtgcaatattattaaaagtatatgtctattttttttaattttccatgatatttattggttggtgtgcacaaaaaacttgtgtatatgagatatattctcgtgtacactactgtagtgttattctatatattactataggtactagtattactaacatattgtactagcagctagcaccatgtcggttatgacattctgagcatgtagtagcacatgcagaggttccatgagcgacaatgcatgtaccttcggctgtgttctttgcaacactttcccagctccactctctcatttttcgtacacacgttttttttaatcctgtgaaaagaatcatgaaaagtaaccgaagtttgttttttaacttttactagttgagccatgtgaaaatggttaccgatgaaaacaaaatgatacaatgaaattgaaaatggaaacgttacatgttcttatagaaattaccttttttataaatacgtcaatatctatggtccatttttttttcatttggctcatagtttagaggtcggtcaattcctcaaccaaattcctaacttgagtgcaaggttaaagatagacaatttgtaatatacctagtgtaaccttgaatttgttttacatattatatattcatacaaagttgatgtttctggtattattattggtttcgattgataccaaatagtttcattctcgattttccgatatcta

SEQ ID NO: 12767 - DNA, 494 bp, Oryza sativa
  unsure (1)..(494): unsure at all n locations
gggctgcaggaattcgatatcaagcttatcgataccgtcgacctcgagggggggcccggtacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12768 - DNA, 527 bp, Oryza sativa
ccatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcgggccggcggtgaagtcgtagacgcccaacagcggcgacataataggccagccgtgtaggcggaggcaccactcggcggcgacggaggcgggccggcggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtg

SEQ ID NO: 12769 - DNA, 1239 bp, Oryza sativa
tccacagttttctttcgatacactagtcaagcctagacctttcaattctcctggcgatcactttgtgggttctaatcacgatcatctatatcattcttaaaggaactttttgtggatatatgttcatacttctctgcttcaactgttcttatattttttgggcccttgtacaatgaccttttcattttccttttgctggcaccaagggtgactaacagtctaacacacacgggagatcaccttgtggattcatcacgagggttcaaatcctacgatttgaagaccttcaactgggctgctgaatcaggcgaggttaagctgcatgcgtttgatgggcttcatgaacgggttcacttttggttttcggctcatatctcgaacagtttttgtttcggctcttttgaacagaaaagattttatactgcttaaagatgtccaattcagagaaaaaaaattcaaaattccttacctaggcacaacgacgcaattatgagggagctcattgtgtggggctgcaggcctcccaaaagaaggtatgctataccaaaaacgagaaaaactctatccctttccttttgatatccccatctgccacaccgcacacaccacacaggagggtgtggggccattaaaaaggagatcctatcaatatcaactagtaattgttccgatataggataataagctcatgagcttggtcgtactttgccctaaacgaaaaaagacttccatatccaaatttagctcaaacgtagctgccttccttttgggcatgaagcaattaatgtcaaaccaaaatacgtaagtattagctcatgaaaaaggaggtgatccagctgcaacttccagtacgactatgagcctgtttggggagcttaaaattataagcagctggttcatagccagcttcttagagtctgaagttttccagcttctgagagtctggagtttttcagcttctagcttctagtttatttttctagattctacaattataggttctcagaaattggacaaaaaaactgaattgttaggtagagcttctgattctgagagaaactacagctgccagaagctcccccagacatgccctaccttgttacaacttcactctagtcaaaggcctagccttaggcatcttccttcttatggttaaggttaatgagttcaaacatagtcaacttctatagtgtgacgggcgttgtgtcgaacggattcaccgtcgtatggctaaccggt

SEQ ID NO: 12770 - DNA, 1889 bp, Oryza sativa
agagtctggagtttttcagcttctagcttctagtttatttttctagattctacaattataggtgctcagaaattggacaaaaaaactgaattgttaggtagagcttctgattctgagagaaactacagctgccagaagctcccccagacatgccctaccttgttacaacttcactctagtcaaaggcctagccttaggcatcttccttcttatggttaaggttaatgagttcaaacatagtcaacttctatagtgtgacgggcgttgtgtcgaacggattcaccgtcgtatggctaaccggtgataactagcgattcctgcttcatgcaaatgagatgcaaatgagttgcaacctacaatccgaaccgaggacggatttttggagttagctcaccttcacgagatcgcaatcctttgtcccgccaaaatttgaatttttgcttatgcttatgctcctcgtcttttcgcttatgcttataattattagtcaaaatttgaattttcaaccttaaatttgaaactgattttgagaaatttttttcatcgaaattattttttagcctttacttttagatcgcaaagaacacgtatataaaagttttattcacaaattacttttcgtttgcaaatatgtcgtttcgcgaaacagtgactcggcttgtgacattcaattaagatcaaagatagcaggctatactaggaaagttgaaaacgcatatatagaaaaggagatatgaattgaggtacatatcacaaatgacacggcggcccaaggaagaacaatacacataaacaacgaagagctaagcaacatcaaggtggcatcaaactaaagatatgatctaatcaattgttgcctaatactattttttcactgcccctgttgttgtgcttaagtagccacgacgactcggcggttgctgcagaggagctcgtcgacgaacgctcgccactcgtggaagaagaaaaccctgcactggatgacgacgagctagctgccgccgcgtcgcagtacaatgcaaggctcggcaaggaggagtacgtcggcacgggcatcgtcggaggaagagccggcagcggagcctcgaactggagcgcggcgagcgcctgcttgatggacggccgcacgccgcggtccgggtgcgcgcaccagagccccacgaccatcacgcactccacctgcttcgcgtcgagctcgagctcgccgccgcgcagccgctcgtcggccgcctcgaggatggcgccgcggccgtggaggtcccagacccactcgaggaggcgggacctgatggattgttcttggagcagcacgggcctcctcccgcagcacatctccagcagcacgatgccgaagctgtagacgtcggacgcggtgctcgccttgccggaggccgcgtactccgggtccatgtaccccatcgtccccgccaggaccgccgtcgtctgcgaggcgtcgccgtggtcgacgagcttcgccagcccgaagtcgccgagcttggcggcgaaggcggagtcgagcatgatgttgctgggcttgatgtccctgtgcaccacgcacttctcgtagccggagtgcaggtagagcagcgccgagccgagcccgagcgcgatctcgtacctggtcggccacggcagcgtcgcgccgccgccgtagaggtgcgcgtcgaggctaccgttgggcaccagctcgtagacgaggaggaagtcgccgcggccgtggcaccagccgacgagctgcaccaggttccggtgccggaggcggctgatgatgctcacctcggaggcgtactccttcctcccctgcttggaggtcttggagatcctcttgacggcgacgtggacgccggccggttcgctcaagacgcccctgtacaccgacccgaagccac

SEQ ID NO: 12771 - DNA, 11307 bp, Oryza sativa
tcttcagacgccaccaatgtcgaattgaaagaccaggtgagtacttggtgccgctcctaggaccacccgctcgccgccgagaatccgatggccacctgcgcggggagcaagctcttgaggtcaaccgtgctgttgagctcgtacctcttgccgccatcttggggggccatctgcagcatgacggccagcatccttgtgctgttgttgtagctcaccgacgcaaccatcggctcggtgacgttggagaggctgcggtcagacagcaacttcaccgcggtcgagttgatggagttgacgtcgatgccgatgtggtcgctgctctggtcccactcattttggaacgtgtcgaactccaccgcgacgatcggggcggcggcggacggattcatgccagtgctgttggtgaagacgccgagcaatccaccgccgtcgagtggagacatctttgacggatagggtgacaggaagaaggcaagcccgtcgctgggtgcgtacttggccttgtctgactagttaaacttgatgacgaacgagaagcgcgtcgtaaaactcgtcacctcgccggtggcctcgtcccagagcggcaccggatggccgtaggaccctcggcccaccgtgtcgtatatgccttcacgtttcgggtcagcgttctgcgtgagctcgatgagaccattgagactcgcggatccatctattgcgatgtcggaacgattgaaagtggtgggcttggagaaatcgtagctgaaagagagtgatctggagaagcaaggtagcttgaagatggacaaggaagcgaggagcaagagtgcggggatcattgagctcctcttggcacccatgactaacttggcacaagctcaaaatatttttttttcccaaaggggggaacaaattaatggcggcagcgatatctgactaggagaagagaattcaagaaacaattagaggtccaaaacaaatgtaacttgacgctggtaacctgagcggtgtggaacgaaaggaacgaaatgatcttcaatcagaaagcgcgaacgccacttcggatgtttggggacatcaaggagatggaagatggcgggcgtattcagagaggtggattttttttttcagtagttgatgtaatttcaccctgtacagaacactcccctttcttcctgagatccactaactaatgactgagccacgcaaagaaatggccaatcttcctcgctgcgactgcacacactatggggaataacctagtaacagtagtcttttcaaaagtcaaaacacaaatcaacggcaacctagtcaagcacactaaccaagacctttctattgtccttgttgccggattttggacattgatttcccgcttggatgccatcgccggacttctgatttgctagcttgccgccagtatcggcgcgcgtcaccctcacaactgtaggatcgaatagaaagaagggtgtagctatatttatggcactatattttcatcaaaaaaaaatagtcggcatgtatttacattgtaagtccctaaattacatatctaattttaatgtatttacaatgtaagtctcaaaattacatgtgtaagtactaaaattacatatgtaaattcaaaaattacatagtaattacatatgtaagtaggatgtaaatgaggtgtaactactgtgtaagtggctgaaaaaaaatcgactgtagcatatgacgccatatttctagcaactccgtagaaagaattaagtcaaccatagggggtgaatggttggtgtacccaaaaaccaaaatttttagcggaattaaaagttaccctcaatttcgatatagatcggtctaatcgaggttgatctgccagtttgatcgtgcttgtgccgccggtctgaccggtatagatccgcccggttcgacagccctggaatggcctccgcatcccatacgcacacaatatctccatcgtatgtcatatggaatattcaccaaccacgtgcattgatctttagcctaagtatcccgcatgatatccgatcgtccggacgtcgccttatctccaagtcgactcccgatccatcaccgactatactcttctgaggcatcaggtcacctacacatgaatcaaacaaggaaaccatattccaagaccaagctattttcaacttgactcattgttagcaaacaacagtattacatacacataggatccatctagaagccataaacacgaaacatccacggatttctaaacaaacaacccgaagtcgacacagagtcgacacagagcacctggccggtctgaccggacacgacaaaacaacaaaccttgttcatcatctgaaaatcaattatttccaaaaccacttcgccaataatcttcaaatgtcaaaatcaataatctcagatgccaattgttcatcgcagaataagaataaaaaacaatttgattttacagcaacagcagccgttcgtcaccacaacatcatggccattcgtcttcgcaattcctagagcgtcgtaacgatgccgggtcacaggatccaaggtgttcgaggcaggtttgctttgatgggcttcaggaacgcgtttcactatttgtttttcggcttatatctcgaccaaatccgttgaacaaaaaggattttagacggctaaaagacgtccaatttagggacaaattcgaaatttcttacgtggttttaaccattgggaaactcacgtttctctcagtgttcaattagcatctgggatgcaaaccatgtgaaaataatccttcgcctttattcagcagaccaaaggatgatgttccctgttgcaagggttgtcaatggtgacaggtaatgtaactacagtggattcctgtgcatgcacggtgaggttatgaattccatttcaccattaacaaactggtagaaggcaatatttgtaacttgcaacagcatagccatctaaacgacgcattgttttaactaatcagaaatttgatttcctggtgtctagaatgaggttcaattcacaatggcttgccttgaaacagccaacaaactataccttctttcatgggcacattttgaacccaaccgtaataatagagcacaatccaaccaaatcctattgagtgtgatgaccattgaccaatgagaagcaaattacaggttacacaggtacagtaaacataagcagatctacgctcttgacgttcctccatggtccctctcaacatgctccacaagcaacactggatctcgaaatgccttgctgcatttcgggcagacatcgaccgtcactctgctacgacttgattgcgagttgctctgatgggacttttcgcaatgctcgattaaggcccccacggtggaaaatcttgctgggcactgaacacattgctccacgagatcaccgctgttactgctgcttgtcgagatcccatccttagccttctggatggcttgggtagttgctgtgctcaatttctgcatcccagcttcagcagatgatttgaaactcgttgctgcggtaagaagactagagctccaccaggatgaactagtgctactgctgtttgaatttgaacatgattctgctttctgacttctcctaagcatatttccgaaggggaatgtagattccggttttcttggccctggacacttgtgatcaggtccaaatctatgcttcaggcagtgttctttggtgcaatctttgcatctaattgtgtttgaaaatgtcagtgtctctctgcacccaggcactgggcatttctttttctttgttactttctggtaatttgatggatcacagtcactattgacatgggtgtcccaggtgatgtttggatcttcgttcgggttcaggcgaactcctttagcacagagtgggcagatgaggacagtcacatccttctgatttgcatttggacactgatgcgatgtataacttcggtgctgaaggcaaaagacctaaacaatgatcaaataaccatgtcagtgctgccaattggatgttgatgcaatgttactttacattcgggaagccatgaagtggaaaggattcaaaaataataaattatggaaaaattttgaacccaaaatgtctatgagttatgcttttttttttagagaagggtattttttatccggcctctacatccaaccggatatatgcagccttttaaattaggaacttagcctatcaaacagggaacttagccctcaaataacccaatctgaaatttgctcctatggagatttgaactcaagaccttggagtgctactcaggatgagttatgcttgaacactgcaataacgcatactcctatatggtgtgtaattccagagtgtcatgattccagtggagctgcatgctgtgatgtcaacgaaagaaactagagggcaacaaagaaacagtacaatgactagagggcatgtttctggcacaaaatacagatatgaatggcattgtgaataaataccacacttccactactgtttttcagttctttttttcctatcattatgtgcattcaaccataggcaacaagctaacaatgaaggactccttgtcaactaaatcctccttttccccgttccaaatttgaaaccatacccattgcattcttaagcccagtttcagattttgtctgagatcaatttcattcttattgaagcaacaattctgaccaattatgtgattggctacatagcattcaattagtagatgaaactaattatccaaaagggcgcaaaactgcaagagcatcaccgaaagggtcatcatgttctcggtcaacgatagacacatcaactctcatccaccaaacggtcaaaaaaagatctccattcgtgctgcctaggcattggcatgaatttcccttctccatctcctcgattgtgatggatcactgtcctaaaggctaaagcccagacgagattttccctaaactaggtgctttccaagatctacttcaagaaaccgtatatcaagcaaaaattccaggaagaatcagttctttggttccacaatctacagaagaacaaatttccttaaaaactaccgcagcagcaaatccgatttcggcaacgaggcaccgagacacgaaaacggccaggggaggagacgggaaagacgtacgtggtcgcagcggtcgcaggtgaagggcaggaagtcgatctggttgcagtcgccgacgctgcagtgcttgcccaggttggggaactccggcgtccccatcccggaactccggaggggggggggttaccgattcgccctcgccgccgcgacgactccgctccggcggtcggcggcggcttcccggtagttgccgccggtaggagagaagggaagagaagagggcaaggctcgctcgtcaagggtgtgggggcacgaaatcgagtagcatacataacgttttgacccgggccgaaaacggccgggatggctataaccctctttgattcgttggctgtctttagttcagcgtaaagttaaatttttttaaaaaattaaaaatgatgcgactgaaaagttatacatgtatgacatgttgatatgatgaaaaaagactgaagtttgaattcaaactttggatctaaacacagccgttgttggcagggtctcacattttcaattgagcattggatcccgatcttatgacggttttcatgaaccttgataaattccaatcaaatttattatttcaaatttaaattcttgaaaatcatttgaaaagttacttagaatctgcttgtgttcaacgtcgaaaccttataatttggtggctttcattttgtttttgtcgaaaacgtgaacaatgttgttgactctatttggcatgggttattcattgaattattaccatgtattattatctacttgatttaattttaataataaattaaatattttagaaaaatgaatgtgatttatgatattgattttttttttagaaaagagaatgcttgccacctgcacaattccgttttctactggcttacgaatatttgaagtgtgtgcataatggtgtgtacttcttttctataatccaaaataaatacccggttagtattcaaagcaagataataaaaatagacagtattggaaaatacagatttttttttccttgtaacagttggtacctgctttgttctggagcaggtggagtcggtgaaaggaggcacctactgccatgacatcgacagacagtgcaggagtacaaaagaagtcatctaaacacggacgacatcatttgatatttcgtcgcacgcgatgaggctagcaactgcatcatcaggttcacggttagtcagagactcggagttaagacgggagaccgttacgaagacgtaggttatatctcactgggatttcacggtaaattgcacaccaagtgagaggaaccacggcgcctgtgcattcagaggaacaccaactgtgagctgtccacaacatccgcaggcagcggtcgacgtccggattcgctggtgcgcgaggcggcgacggacgcggccacggaaagcaacgaggcgatcgactcacgcgatgaccaagccagacttgtcgcgatagagaagaagacgcggtgcgcgcgcggtgtgccggtgcgggaatcggtccactaaccggccggggcgtggggtgcgacgcgaccgaccgcgtcgtctccggctgcgtccccgcgagatcggccgtaggaaaccgtggtctcgtgggggcctgcagaatccgcgacttcgcgacttctttttcttgccgtcgcgcgcgtcccggtggcgtggttgacgcggccgccaatttggttcattgcctcacggggcacgggctcgtgccgttgcttttccggtgcttttgcttagcgcaggttttcgcgggtgtgcatgaccgcgagtccgtgaaccatttcgcgcgtacgccatgcggtgcgcgtggaccgtggagtcaggcctttcctctcagagtcaggcccgtttggtacagcttcagctccagctccatcccttctgaagctggagctcagccaaacagtttcagctccaccaaaattaggaatggagttgggtggagctctctcacaaaatatactagagttgtggaggtgggtttaggcagctccacaactctactccagactaaactcctggacttatatttaggagttggagctatatcaaacaggccctcaggtctaagctagtcagctacaaagcgttgtgttcggatttgggcttcttaagggggagtttggatggggttaaaaaattttagtccctggcacatcggatgtttgatactaattagaagtattaaacatagactaatgataaaacctatttcataactctggactatttcgcgagacaaatttattgagcctaattaatccatgattatcctatatgatgctaccgtaaaaattctttaattatagattaattatgcttaaaaaatttgtctcacatattagctctcgtttatgcaattagttttgtaagtaagctatgtttaatactctaaattagtatcaaaacattctacgtgacagggtctaagctaaagtctcagttagaacaagatttttttcaaaacatagtacaaatgagatgctcatataaacatggcaaattttgctgtaggacactgtaacttcgtggtttttaactctagggcacgtcaaaagtcgatctttaggggaaggcactctcaaaatgtggttttttttcttatggacaccatagtcattaaaatattaatttccggctaaataggagagataaacaacatgaaacgtcaaaaatatccctaggtcagtccttctcacactccagccacagtgccacctctgctcgccatcagcaaccaccctggccctccctcctcgcctcctccacctccgctgtggcggcttggtccggctcccctcagctcccttgctaggctcctaggtagaagctgacgagccacgccgacatgacctccacgaggtaggtggaccctagcccaactcctctgcggaagggggcttgggcgacggcggtgggttgggctcctgctaggctcgcgacggcgcttgtcttgtggcagtagaggaggaggaagtgtcgcgaccaatgtgggtgcatgtggcgccgtggtggaggcccttctcgtcatgctggttctaccgccgcaacggcggtagtggaggggaggaagcgccatgactgatgtgggtgcgagcaacaccatggtagaggctggtctcctgctcctaatactgaggtttgcggtggtggaggggaaggaagcgcctcgaccaacgtgggtgcgggtggcgcctatggtgtcgggagggaggagagcaggctggtggggaggatgcggtgacggcggagtgacagtgtctgaggtgaggagtgagtggaggcgaagctcgaggattgaagcgagatggatgaactgcacgacgaagagcggcgccagccgataggtgagtcaatttgaggatgggcaggggcaatttggtcacagcgcatcaaaaagtggacagctcttgcatagtcaacactaaaacgctaaataaatgggagccgtgcccgttagcaaataaccaagattacatagtgtcttaccccaaaagtgatttcatgtggtgtcccataactaaaatcacgaatttgcgatgtcttgtagtaaaatgtacttataaacattaatatcaaataatgtacttataaacattaatatcaaataatgtacttataaacattaatatcaaatgtagaacttgaattctttcactatgataaacatacgcaagtgcccttactttggtgttcactatcagaaaagatattttagggtggcagtcatgcattccacaaattacattctcacaaaaagctaaaagtgaatattctcaaaaaaaaaaggaaaaggctgaaagagaaatgtacttctgaagccaaaaaaaaaaagaatcaagggaatcgcgaaaatacagagaggcaaatagaatcatctctagtcgccattccgccaccaatcagcgagctgccggacgaaatatcggcgcgaacgtggggtctcccgtttgccctcaggaagcccatgaaacgcgctgttttcgcggacagaatcagccaaagcctcagcaaaaaaaatccaccgctgctgcctatccagaaccccgccgcggctcgcatcgtcgcagccggcgtcgagccgtcgggagggaaaaaaacatctctagctctccttcgcggcgccgccgatggctgccgtcgcgcggatggccgccgcggtcgtctgccttccctcctcgtcctcatcctcctccgcgtgccgcgcggcgccattgccgtggtcccgcggcgtcgtcgtcggggtgaggcggcggcgcacggtggcgcgggcggcgcggcggagggggaggaggcccggccgccgcggcctcgtcatcgtggacgagttcgccgggcagtacgaggaggggttcgaagacgtgcacacggtgcgtgtacactactgatttcgattttctttttttttgaaccggcaggggataatcggaacgctatctgtaaacgacagcaatataatggttaattttctctaactgcaaggttaattgggtttagattgcatggaactctgaagattgttctctccattttgcaggaaatcatgaattacttcacttacaaggccacaagcacggtgctccaccagttgtatgaaatgaatccacctgcttatacttggctgtataagtaagtcaccccattgcaagaaaatctcacattgatatattgtgctatgttgaaatgaaatctaagtagaataggttaatgttggtgtcagttccaatctgcatccttagcgtctaaaatacgaacacttacgatttgtcagctacgtcgtggttaacgatccaaaggagggcaaacatttcctcatcgcactcgcaaaggtatctttttgcatcttgttactaagcaatgaagaaaaatatatatgatgttcagcattgtgccaaggttcattctctaattaatttgacttcgtatgcaccaggagaggcaagatttggcagagagagtgatgatcacacgactccacttgtacagcaaatggatcaaggtaataaaaaagagtgagatattccagagtaatttgagacatctttgatgcataaattatttaattagttacctcttcatcaatgcagaaatgtgaccatgcaaaaatgtacgagaagatttcgaatgagaatctggagataatgcgtcagaggttaatggaaactgtagcgtggccaacggacgacacaaacaccagcgacacggcgaaatgaacgatcgattcatggcagcaaacttgaaactcatgttgagtatgacagatccactcaataatgtactttacgaatattccttgcaggttttgagttaatcatttgtgtatataagtagcccctgcatgaatagaacaatcgatgtatattctcctagtaaaaagaacagttggtgtatattttcttctagttactgagattatgatgctgatccttgtgtactacacactatgcgaaatacataagctgtggtcgctttgttaattttccatgtttgaacccttttttcagtgcacaagcaagatatatcatagtgccatatacttcacttctgccgtctgatcttggttgccataactcaatagatttgtgccaactccagaatagagattacagtcaagaaatatttactgcttgtcaagttgtcatcgaactgatccctaaggacaaggtaaatcattgtgctatatgtattaataaactctcctgtgctgcatgaaattgttgtatgccgcatgaaagacaaaaattacatcatgacccagtttgttaagcatataagatcgataagagctttccttttggcagattctgtgcatgtctgaactcagtccaattctgccttagaaaatacatgttccatttgctgagaggagataacctccttttctgccggcaaccaccataatcatattatgggcgagacatacttgacttcataatcttggccggcaaagacgatacaaaccaagcttcatctagctttttggaaagcttagttaagttccaaatttgagctgcttctcctgtggcgtacatatgtcctttcagggcatatgcacaggccggcagtatgacactcaccctttaatagcaccgagtatggttaacacgatcaagggtattgaccaagttaatggttatacaggttatcaggtctgcaaaagtagtgtcttttcatttccttccttccatctctccctcctgctctctctccagc

SEQ ID NO: 12772 - DNA, 2109 bp, Oryza sativa
aaacaggagcttggacaaacacctctatgatggtggaaacctgttagcatggccattgcggttcaagataaccataggtgttgcatccgccctcctgtatctccacgaggagtgggaacaatgtgtcgtgcatcgtgatgtcaagccaagcaatgtgatgcttgattctggattcaacgctaagcttggggactttgggctcgcacggcttgtagaccatgaccgaggctcacaaactacagtgatagctgggaccatgggttacatggctccagagtgtgtcactactgggaaagcaagcaaagagactgatgtctacagctttggcattcttgctctggagatagcttgtggaaggaggcccgttgtgccaaaggaagataatgacaggatcagtttggttcaatgggtttgggatctttatggaagaaatgagatacttaatgcaattgatggaaggcttgatggtgaatttgaagagcgggaagttatttccttgatggttgttggactttggtgtgcacacccagattataatatccggccttcaattcgccaggtcataagcgtactgaagtttgaagcaccattaccagaccttccaccaaagatgccagtggcaatgtactttgcaccaccaatttctctctgcagattttcacagtcatctaatgggacactgaaggagctggaaaggccgaacagttatggaaatacgagctcgtccagtgcaaccaatgattcttgtgcccctccctctgttcggttgccagaggttggttactaggtttgccgtgtattcctattgtgttatcatgtttgcctttgtgcagtgctgactgtttttgagaggcactcaagtttaactgcaaacagacgtgtatttgactctagctaaatgctgtgaacatccctgattcaattattgtttcatagctaaatgtcatggtgtaagcctgtgtatctgcattctcttggggttaatttgtaatgtactgattttctcgctttcaatatattgatagctttgcatgttaacaagaaaaaggtcagttcctcgtgtaaatggatttctacagttttattcccataacaaaaggaacttactactaaatgtatgaacaatttgaaggaaaatagcagcaatggaacacataattcttgggcctccacttcaattccataaaagtaacacaaaagaacaaaaaactttccatgttaagtaacataatgttttatgtcattccttccttgcatgcagaggaattgtgccattgatcttttctctagagaccgtccatcaccatttgaagtgctagtacgaagacatgctagacttgtgttcttgagaaccaaaaactttgtcttgttcaaactacaaatttcggcagtcccttgccaatcataaagtcctgtactgctactaccacctcataatcatatcgtctattattagattggttattctaagatagtgaaatcctaaacttcattgtgactccatgagaattaactagaatccataaataaaacaaaggatagcacctgacacatccaaatccatatgcaaccacacaaccaagttttggccctcagttttttttctctgtttgaattctaacagtatgatctttcacaacaaacagaaagaacacatgacgaacacaatcgagcaggcagtcattaccttttggaagagcttcttcacttcttgtcacgccgcttcttctcggtaaagaggtagaccaccgggccatggcgccacccttcgagcggcgggtcctcgtgtaccacctcgacgtcgaacagcttcctcgccttggcgaagaacttcttgtccgtgcgcttccaccttctcatgtgcgccatcacgaacaccacctcccccttgacgaagaaccgcatcgtctcaatcaaggggtcaaccaacgcctcgtagtacaccacgtccgacgccacgacgaggtcgaaccgagaagccggcggcggagcagcgacggcctccatcgcggcggcgtcgccccacgggagcgggacgacggagacggagccgccgcgggcgtcgaggaggggcgcgttgagggacgcgttgtggcggaggttggggag

SEQ ID NO: 12773 - DNA, 15925 bp, Oryza sativa
gatcgtcggagtcggagtcggagtcggaggagacggtggcgccggcgacgaggggatcggcggcggcggcggccattgacaagcaaaatggtgtgtgtactggtctggctgctttggggttttaggagttttcagacatccgagctgaaaagacggcgttgcttctgtacgtttttttcattcggagaacatgggcttttcattgtaagcccatgtgacactggcccaatggctacaatgagcagcactacggccttccagtggcccaaccgaggaaagggcccaaaggtgtaaccgcgattagctgctgctccatccagccgaagggtcgacgacctgtcgggttcacgctcaccttgtaagctgaagttttgctgggtttgctaccagatgatcgaaagtcgaaactttctgccttcctctctctcaaaaaaaagaaactttctgcctgaatcatctcaaaaatagaccttctttctgaatgatctgcgatcaaagtactctctgtctttaaatacatggtattatgccattttgagaataattaaggaagttaaaagagggttaaatcatagtataaaagatgatggttgaggaaataaaccagtacataaggtaaaggttgaaaaaataaactaatactcccttcatctacttttgatagtcatatgttatcttggcagacagaccaatgatagataattctacttatcatctatttaaatatgctactagtcattcctcgtaaacaagcgatttattaatatttacatttctcgatgcccatagagccaatcttatgtgaaagaattgagagtcacgtattaaatccaagaaagccattaagatgataggttgtttgattgaaatatacctatcaaaaataaatttttcagatttgaaaatataactatcaaaagtagatggagggagtagtaccaaagttgttaagtgaggattaaactagtgcatgagttcattgatggatagaagataaacattgtcttgggattgtaaaattgcttatatatttagataagggattaggccaatatcccttatatacttgaacggagaaaatataagatcatattgttcgtaaataagctcacaaggcgattgcatcatctagtccaacaatggattggtgcaattcggtaaacctactacccagttccgtaaccgattacgcacggtgcattacataattactcctacatcatctggtgcacctacacgtgatttgaccaaattttacagtatatattatgctcatcttagatttagagaagaaagcactaaaaaagacgtcatgaactattcaaaacttcaagtgcgtgcgtccaatctgtccaggtggagccagatggccagtgaccttgactggttagtggttacttttccaaacaaatgacctagtcgtaactccagtaaacatcgatcatttcaccagcggctctacatccacggctaaatttctctgggttggacgtacacgtggcacccctaaagctcgacagctacctcgttgattaaacaaaagaccaataaaaggctaaatttcttaggctttcatctatacgtcatcacccacggacgtgaagaccgtgaagtgaaacatcttgtcccggcacgacgagctctaaagtaagcacgaacgcaccagccaatcacgattacgaaccgagatattaattcacaccgatgcaccgcatatgacaattccaataggtgatagtctatccccgattaacgtgaacgtgctgcctgccataaaaaaaccctgaattcacctgatgtaacacaaaacagttatctcttcccaagcactgacgcgaaccaggaaaaaggttgtatacgtactccacacgggcacacaccacccgaaacgcgcgttgatgcacgcacgcgagagcatttttctggcacgtccgcgccacgcacggcgcgtgctgcgtgacagcgtgatccccatcatcagatggcccgaacgaaagccaacgcgcgggaggggacacgggcgaaacagccgttgcaccggctagctagacccgaggcgagatgacgtctcgtctcgtccccgacgcgacgcgcacgcggccggtgcgttgcacggcatgcgccaaatcggagggcgagacggggcgggggaggtcggagggaagcttcgcgcgtttggcgccgttcggaaaatttttttcctagcgtacggtcgctgcggctgctgctgcggccgcaggcgaacggagcggcggttgccgggcggccgctttcgcggggttggcttgcttttcgtgctggtatgattttttttgcctgatccggtcgatcgaatcgggtcccgggctggcacgtcgtacgtgtttgtttacggggaggaaggtaggtgcatccggcctgcatctagccggtcctaccagcatcaccagcggtactacgacatggattggaacaggacaaagctagtgctcacagtgctactagtagctaagctactgcaggttattttcaaccgggaactttttgtttgtttgggtgcttgagctctggttctttcttctcgtccggttgttgtttcctcctcccagcggctcgacggtcactctccgtttcccgggggtgtacgtggtggtagggaattgatgccgatcgagggcatttgccgacaggttgaggccgggtgttttgcacattgccacattggtgcgtgcaggtgtgtacacggtctggacatttgtcgaccaacctgtggtatctaagcaccagataaccagtggtatctgattactcctatctaagcgcaccaggttaccagttagcgctctttgtattgaacgaaaaatccacgaatcgaatcacccacggtacttgctacgcaatcagagtatggttcgttcgtttagggccagctgattgatgagacacattgttcactcgatcatcacccatgtgtttttttttcctgacattcgaaagcgcagcagcagcatacatgcatccaaattattcctcaagtgcactagctagacttgtgcatcgcataacggtgaacacgtgtaggtgcggaatattcggcactcactgatcgatcgattgatcgaccgggttgtgcttgtgcagtgctgtgcaagggcgaaccaagccggagtccgttccggccggtcacgtctgggctccacgcgcacgatcaagaaaggagcgtgtgcgccgtgctgccgcatgcagggtgcagggtcgtctcgtgggagctaggaaagctatgggatggccagtttgctatgtgatgcccatgcctaactaacctcgagtgagtggcatctagctagttgcgtggcggtatggcacgcggtagatttcgttattgcgcgagcattgcgtaacgatcgaaaaaggtggtagatagctatgaatgggaatgggaaccgggacgggtgcgttttggcattccatggagcaccttttcgggatgtaggcctgcccaaataggaggggcttaaccgggtctatgatgctggatggatatgtgtgaataggggttggtcaaaaatctcgaaactcgtaagctaatttaattgggataattacttatttgacctcatttgaaagactaactactaaactagcttttttttttctagtttgctatttgaacccgcttttcaaaaatgaacaccccgtctaaccctgtttccaccgcactgttaaggttccattttttttagaaaaaaatactgtaatgaccaaactaccctcaaggaaaccaatccacatctaacctacccattcactaccgtttctctctctcatatatcctgtgcggcggcggcgcatggaggggcgagttgcggcagtggcggatgagcggacgcgccggctcgtggaggaaggcagcagcgacggcggagggacacggaggaagcggatccgtgccggcgtcagctcgtggagagagggagcggtcacgccagctcgtggaagacggtagcggcggcggcggcgacggagggagtaaatccgtggcggcgccgcgtcgtgacgggaggacggcgacggtggcggcgctgttcctcgatctggacggggaggacgatgtgtggtggcgatgctccttcttgcttcgaagaggatggcgacgcggtcttctcctgtttgttccaaacaaggaggtaggcggcacaaacgtgtgaataagaagggcacaccgttacgttgatttaacagaagggggtcagacctgatcttcagttttaaaaacgagggtcaaatgagcaaagttgaaaaagtatggtcaaattggtaggttctagaacagggtcaaaagcgctattgccccaatttaatttgtgtaaaactcttctcgactcaactcgacttggcagttaatgagttgagttgagtttgaacttttactcatttgtttaatgagacaactcgaggtagctcgttgagcgcatgatgtattaagatataagttaattgtccacattttgccagtgtaaaggtcgtaataaactcgtaattattccttgtattgttagtcatgatacatagcacgacaatcataatctttggtcataggctcacaaatcatgatttatatatgtatatgaatttttttttcgaggaaccgacggcaggagtttctcctgccggaatttatagaagaagagaattggcccagttaataagggaaaccgggcccgaaaaccaaacaagcacggttaattaaacgggaaaccggcaaaaaccaatacagaaaagaaaagaaacaactaatgagacctcacagaagtcgtcgttaccgagcttaccaaaaggcaagcagcttcgacaacataatgacaaggtctccagaaccaccaaacatcctctagtggagcaaataccttctgagcgaagccttcaacaaggaaacaacattaaggatgctgtcaacgcccgttccgaaaggaacccggttttcacctgaaggaagagagaaccaacatgacgacacctccaaggaggaaacggcgcccacaagcgtcgatatcatcaacctaggatagactaggtgtaacatacccgaaattttaggacttaaaatttcttatcaaaatagttagaggttaatttctccaattttgagagccaaaaatttccgttttaatttaggtgatgatcaacttaaaccattgcatgattaaaatttgagaacaaaataaaacattttcattcccaacattagactagaaatgtcaccaagcatacatgtacataatgcatgcctaggctcgagttctttgtgcatttgaagttttggtcttgcattccataatagatcccatgagcataatctaaaagaattacttcactaaacaaacctatagttaatcttgggtaataacatgtggacttaatattaaactcaaatatcatcttctcagtctaaaagaagtttaatgtaatccctataataatattagatgcaattatgaagtgggaacacatatacaaacaaaggtcaacttaattctctaaaatattttgtgcaagataaaatcatggaaaaatttatgtggacaatgattagcacaaacttatcctccgtaatttggtaacgtgttaacactcaagttgatatctcaaattaatcggtcgaagcagacaactaaaagaaatcaaattaaattttaatcggctaaaaccatatttcatccaaaagtacatttaactgcacatcagtgaacatggaaaataatttattcaaatactagattagttatcatgaataaatgtaatttttctagaattttccttctctgtttaagcctcctaaaaattcaatctagctttctaatagcccatctttgtttaatttctgtgagcagtccacccattatttttgagtgcaaccaaagaaaatggaatctaggtgtaatcatttacctccagtaaaatcaacactaattaatttggtccacacattgaattatgtagttacaaagttagaggagaaaataattccgaaaattaatctaaaaatccagtttaccagtcttctacccatatctctctccctggcctagtttccatcgagttggccccacttgtcagtgccttaggctaggttcagctctgtccatcacttcctccactgctccagccgagagagggagagattgagcgagccgacgcgtggccgcaacgtgtcgtcgatctcggtttcctttttctcgctctctactcctcctagacgcgtcgccattctccattcaccactcagagccgaagaaaccgagggaggaggttctctgcctctccatcgccccaaaccttgccgccggccgtggagacgacgaccatcgccatcgctgattgggtaaaggtcatctccaggttttccgcgttcccttctctccacacagtgccgaaccatttctcttttgaccacctcccgttttgtgtatcacagccaccggaacgcgaccacgccgacgatgccctggagcacgcaccggagcgccgccgcttcaaccatcgttgtcgtccggccattctcatccacctcagagaaagccgctgcgccattgtcatcacctcaacctcctcttcaaaacgcctcaagaaccccagccggaaacatcaagaacacggagaacacatccttttcttcaccggcgccaatctaggatcgcctctgccgtcatcgtcgattaccgctgcctcggtgagccattgttcgattccttgcacatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagaccacatgcatgcatccttttcattcgtaatcgacttccatgcacacatgcactttcaccccaaaaccaccgccgctcacactcgccatcggcgctactccgatgtcctctaaccaagaaaactagaggaatggaatcgcgagagcttgctcttcattttatcttttgacctcaacctcaaacgagccaccgtttgctgccggcgagctccagatcgagctcagccatggctagctctgctctgcctagagcagagggatgacttccgtgaattagattaagtgcagggatctgtttacaattgtagaaacacactgacatatgggcctaggactgcgggttgattcctagaaacctcaagggcctttgtgcatattggtccctcacagccatgtggacccatcctttaaaatctgaagaaaaattaggaaaatgcccaaacaaatatatgtttagcagaaaaatgcacaaagttgtaaaatctatataaaatcaaatatagctcattttgaagttattccagttgctgtagattcttgaagttatgaactttattccaggaatataaaacttgacactcactgtacaaataatgtctctaaaatttatctaagataggttatacataaaacatgtacaaacttataaaatacatagaaaattcatttcaactcattttgaaacaaaatcaaattctacagattcatcatcatacagtctctgattaagtgaaataaaagtaattacttactttgcatcaaatgcctctaaaactattatctctataatgattagttttagataagctaaactttagaaattcatgtagaacccaatttagcttcaatttgaataaacttaagttatgtaggatcactaaaacatgtatttccatgttatgaaataagattatatacttgctgtgtagtaaaagtctctaaatattcatataaggatttactaacatagagcagccattaatttgtaaaacttgtagaaaatttatttttagtccaaatgaaatgaacaaagtttctatagaaccagcaaatagttatcttcaacatagtaaaataaaatttgtcaccttttgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatttccatccactaaaattagaagaacttagctcatataacaatttctaggttaatataatatattgctagtttagattaaagcatctctactttataaaatatgaaccatagtagtaaagaccataaacatgtgagataaaaatgttttagttaaccaaattattccttttattcaacttaaacaggaagtagcatgttctgaacctataactcaaaagtcatgaacatataaaacactatatgtctaaaacacgttataacttgtaaaatgcataaagaattcattataattccaaaaattgtgaaaccaaatgtgttagtcttagaaaacacatctccacacccctgtgaagtctaatctaataaaaatcattttacaaaagtatttcataacactacctaagactatactattgtaaaccgataaaacttctaaaattcataactcccaaatggaataaaataaaataggaattatttcacctaaattcattttagatcatttccaacccactgtgcataaatcatgcattttagagcattttggattttcagctctttcggtgtttaattgcatgtcgtgtcctttatctagataattgcataatcggtgaagaagtggattaggtgctaacaattctctgatcaaggcaagttttctcctcccatcctttgaacacattggatcccatgatttgaggaatgaaaatatttgtttgcaaagttgcatgtgaacttagactatatcggtatttgaaactgggttaaggtagttatgacctatttgctgcataacccaccttgaataattgatcctcttgctgtttgaaccctagaaatggttagagtacactctttgtgctcatatgggtttatatatgctctatgtgcaattacttgcttagccatgcttagaaatatgcaaatgctcattccatctataattaaaatgtggttttgatacttgaacctttgctggaataaaatgaatatgatgggtatttgcgaactaaaatgtgtaaaatgtgattttacacttgggcagcaagtggtgtgcatatagtgttagttgcataccgatagggggagtgtttgcccaagtccataaggaccgaacttgtgtcacccatttaaagttattcgtacatccacatgtgctagtatgggatggcctaagctgattaatctatttaggactagccttgcattctggtaggccggtgtgtatgagttcgtataattcagaggagcttcctatttaccccgacgtggtagtttaggtgactaagcgtgtccaatacaacggtattgtgccacgtggtgggttcccgtcgtgtccgctaccacggcgttaagtttaaggcgtgggcccgccacttaacggttccaggtatattccaagtatgcctaggatggaggaacacgtatcgtgctggtgcaaggctaggctctaagtagtgtaaaggcttcgttatgacctctagatcacattcaacatgaagagtgtggtggagtcttgcaaactcaaaacaaactagagagttcatatcatgtgggtaaagctgtacaaactctgcagagttctttaaactaatcgattagccgtgctcacggtcatgagcgctttggtgatgtgtcatgagtatagactatgttttaaaaatgtgatcatgtgacattggtttgaaattgataaatgtgttgagttgtgtatgtggtgatacattatgacttattgttaagtatggcaataagagattgtttatgatggaattatgaagaagttaataatgaaacttaaaacttgtctttgttaattgaagcatcacctcctttacaaaagaattgcaaaacaaaacttgctatatgctgaaattgaactacatattgccttcctttgaatatatgccttacatgtagtatagtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatagggtaaacccctagtcggtgtgcttgtgattgggtagtcaagcttccgctgttctctaataagtctatttggccggttggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgcctttgagtggtttgacgggcacatctcaggctgaagttgactggcaggctaagggcccagcaatgtctccaaaattcctctctcgaggcgtcggatgtttcattatgcttgtttgatgacttgaattattcacttcatctctcaaatataatggaaggtctggagagcctacgacactaggcaaggttttcacctaaggctctctcgaactgctccacctcaaaaccctcgtcgcgttgccgggacgttcgttgagggtcatcgttgccgagcttgcaagacaagcagctccaactccacctcaacagccaaccctgcagctcgaccagagaccacctcacacccaggaacccagctgcagggaaacaacggcgcggccgacgaccagcgaacaggatgccgaaacaactccgcacgccacccctaccgaaccacggaactccccggcatcgactggaagcagcctagcctaagaagggaggagcacctaagaagaggggagcggacgccgcaccgtcagagagcaccggaagaaacaccactgaagaaggggagaaccggatctggaggaccaggagggagggagatggaggcgccttccccgtcgccggcaaaagccgcagcaggccggcagcccctggccaggaccacgcggcagccggcgccggagcaccgccgccgacccggtgctgtcgtcgccgatgaaaccgcgccgaagctgctggccacctgctacgtccgagggcgccggcgtcgaccgagaccgtcgccggccacgccgagacccgccgccgcgccgccgtcgtaccccggccagatctggcggggctaccagatctggcgacgccctcaacggagccgcgcagagccccaccgccgcgctgccatcgccgcggggagccccaccaccacgccatcgccgcgacctcgccgtcccgccgccgcgacctcgccgtcccgccgccatcgtcgccacacccgcgccggggcgagatggagtcgagggagattaccccgccgccgccatcccagcgcgtcgcccggctttgccggcgacgagctccggcggcggcgaagcagggaggagggaggaggaggggcggtggcggctagggtttcgcccccgagccgccgcgcgaggtcgacgcgagggacaaacttcgctttgccccatgtatatgaattttaaaccatgtatttcgatgtaacgagtttaatgagtcgacttgggctttttaacaagtcgagttgctttcatttttaacttgttattttaacaagtcgagtcgctttccatttttaactcattatgttaacaagtcaacccgagctagctcgctaacttaacgagtttttacaagtcgagccgagttggctcgttagccaccactaaatagggctggataacgaaccagctagactcgttaaggctcaattcgttaaaactcgttatcttagtacgagtcatctcggctcattaacattgagctaaaagactagctcggttcgggtcgtgagctgttaagctcattaggctcgttaacaagctctatctcatttatatcatatcgataatttcaaatttatcatatattaacataataataaacacaaactaatgaagaactcactaaatacgaataattttgatgtaattaaaaatctaagcactagttaagaagtactaagtatataaagatgtggtgatatcttgtactaacaagctaaacgaggagctcgcgagttagctcgttaaggttatgagttaaaaatctaacctggcctgactcattaagattacgagttcgagcctatctgagtcgagatcgctacaagctgatctaagccatgagctttgcgctttttgtccacctctatgctacgttaaggcacaatttgaattaatagagccgcctacaagttaagctatggcacgcaattgcgactatatccattttgttgatgaatgaaccagattattggctacagtgccaacacaaaagtaaacaatttttgccacagtgatctacactaccagggtgcatattgaccattggacccaatctaataagcggtcatagattgcataaattgcagtcacactatcacatctgattcaaatccatgttaagtctcgcgcacttctttcagacacaatattggtaaatgtttaattttaaaactgttgtgcagttacaccggatcatagcggtaatggggaaaaaggacatttagaagaaccagggtgtcgaaacatgatttcggcaataataaaacggggtagcgcacgagacctaaaagtggatggatgtggagacaaaggatttagacaggttcgggccctctcaatgagaggtaataccctactcctgtttggggatttgaatccgccgggtgtattatagatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattctatagatataagttatcccctatgactggtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatctgagtaaataaactcataaaggatttaccaaccgcctagaaaatgaccacaatatataatcagcctaagccataacattggtcaataaaaatgcacacttacgtggcgaaaagcaatgatattgtatctaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagctgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaagcgaagaaaccagtcggcaacagtcaggtcagctagcagtgaagatgtaggcgcccaacaacaacgaaagatcagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagatgaagtcgctccactatgatgacaaagttgcatcgccgtgatgaagtgaacatgagtcggcggcaacagaagcaaactggtagcgaagacgcgcagttgtgaagataaaagcactagtcggcggcggcataaccagtcggcaacggaagacgatgatgtccatcagtagtggtagctgtataaaccagacgtagaggtgagggcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtg

SEQ ID NO: 12774 - DNA, 8876 bp, Oryza sativa
cggtcggtaaagacgtagacgcccaacacgggcggcataaaggccagccgtgcaggcagaaacaccagtcggcggcggcaaaggcaagccggtcggtgaagacgtagacacccaacaacggcggcataaaggccagccgtgcaggcggaagcaccagtcggcggcggcgaaggcaagccggtcggtgaagacgtagacgcccaacaacggcagcataataggccagccgtgcaggcggaaacaccagtcggcggcggacgaggcggccggtcggtgaagacgtagacgcccaacaacggcggcataaaggccagccgtgcaggcagaaacaccagtcggcggcggcaaaggcaagccggtcggtgaagacgtagacacccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataagccagccgtgcaggcggaaacaccagtcggcggcggtcgaggcgagccggtggtggtgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgttaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataataatgaagacaccagtcggcggcgacgaaggcggtcgacggtgaaagcgaagatgcccactaatggcggtataataggtcagccgtgtaagcggaaacaccagtcgacggcaacgaaggtgagccaacggtgaggatgtagacatccaacaacggcggcataataggccagccgtgtaggcggaggcaccaatcggcggcgacggaggcaggccggcggtgaagatgacgatgcccatcaacggtggtgtgaccaaccgaccgtataggcggggacaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcgggccggcggtgaagtcgtagacgcccaacagcggcggcataataggccatccgtgtaggcggaggcaccactcgcccccgacggaggcgggccggcggtgaagtagtagacgcccaacagcagcggcataataggccagccgtgtagccggaggccccaatcggcggcgacgtaggcaggccggcggtgaagtcgtagacgcccgacagcggcgtcataataggccatccgtgtaggcggaaacaccagtcggcggcggcgaaggccagccggtcggtgaagacatgaacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaacggggtagcgcacgagacctaaaagtggatggatgtggagacaaaggatttagacaggttcgggccctctcaatgagaggtaataccctactcctgtttggggatttgaatccgccgggtgtattatagatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattctatagatataagttatcccctatgactggtcggataaccatgccgtatgggtatggggtacccataatatccacacaggggaaaacctctaaactacttttgagtgtttgatatgaaaacgctatatccaacctctacaataacaccaaaatttgttaccgaactaggtgccactggcataacgaatttgtcctactaataaaattaaccggacaattgccaactgaattatgcacaatattgtcttctgagttggactcccaattgccaactggctggccagccctactatttatgaattacgagttggagggaaaacattgcagtaatataaaaatcgaataggttatccataatagtcgaatttttaaaatctgaattcatcgtttggtaaccagtaatcagctctagaccagctactgctagatatttttagtccttaattggtcttagttcctccatcccccccccaccccccaccccatatgactcattgcaattaattaatgaagtgtcgatggataaagaaagaagagaaaggagatgtatctttgcaaagaggcatctcagataatatagggtacaaggaaacagttgagaggagtgacattagatatcatattgtctcttgtacatgccatttttatttgttcttagttgatgtggctgtgtacataaatgatattacatagctgtctcaatcattatatacgttttgtttataatctaaagtactttctccataaaaaaaacctaacttagaatagaatgtgacgcattcaagaacaacgaatctggattaagtgcttgtcttgattggttgtccgaggatatataacagttcctatcttagattgtattttctgagacggagggaatgagtgacattattaagcgtttgctcactagtatgatctgctacttcaaaagagttgtagtccattcatagaatcgatcaggtgcgtcccaaaaggatctcatcaccattatatcttgagacaagtctgacaccttacatatatattcagtcaaccatttgacacatgtttttagtggcaatcttaggaaccagtccaagcttagctagccactcgcccaaggtcgcatgcaaaggggtgtcgtgttgatctcttaaaacagatttctcgctatctagtcctgaagtgctctatagattactagcacgaactagtaggcacatctaaaagaacaaatgacctaattatcgtatgggcgtatggctgagctttaaaaaaaaacacgagtcctccacctaaacctgtttattggctccggtgcactcaccaccctaacgaaaaagaaatgcaaaaccaacagagccgtatctcgcataaagcattatccattattatcatcccccgccgcggaggccaaccgaacggcggcaagtggcgcgcgttgctgcaagtcagcaacactcgccgcgaaagtgatcagcgcaccaacccaatttttattctctgatcgagccctatcgtcattaactcctacgaaaaggaggattaaacaagcgtacaaccacagaaaagattagacagaaacacgatatttctcctaccgcttcttgtacatgccgctagttagtggagtaattaatagtactaagcgagtcgctagcgatggattggcttgtgtcgccgtcacgtcgcgcgcgccatgatcacaatggtgacgcgcgcgcgcgtgcgcgcccggcggcatcgatcggcatggcgttcggcggcggcgacgctgcagagcgcgcgcgctcgcgcccgcggcgcgctgtgcgtgtacgacgtcgtcgcatggtggctggcgcggcgcgcgcgcggggcgggggcgcgggcgcgctcgccatcggtcggcgtcgcggtctcgacgacgtcgcgcgcgcgcgagagcgcgcgccgccgggccccgcgggtcacggccgctgtcggtagcgcgcgggctgcccacgtggctgggcaccccggccaggccgacaaccgcgtcgtctgaccggtgcgtgcatggcgccccatgacgtggtggggccgactgggcctttttcacagtgcccctctgctcgagtgggcccgggcctgcaggggctgtgggcgattgatgggcctgggctgctgctgtcatggtagggtatggttaaggttgaccatgacctactactacttccctgccgcaatgatcttctgcgtacccaccttctgtgagcggagcagagcaccagctaagtttagtgtaaaacgcatttggcctttttaaaagttatgctttgtatttcccaaatatattagtgtacttccatttcaaaagtgaaagcaaaattctacacttatctaacagttggcaaaggcactgggggcatctgtagtgtttggtttgatcaatctaatagaagagccaaacaaaatttcagtttgatagctataatgttaaaattgttttgtgggatctgtaaaaagggaatgagccaatcactggaaccgtacctgcatgcatgcacagtatattaatttactctttcagttcgactccaatgtggagttcgatttgttgtttgacacctacggttcgacagctacaatgtgcatgatttggttctcctgtcgtaaaatcgattttttgttcacactacagatgctctaaggttaggagattatggacattcgacctaaattctgttaaccaaattatatcgaaagggaaatccatcaagggttccaatcttctaatacatcggctacttagagttcgagctttatttgatcagatattgcataaattgtatgagagaatgtaccaccttaatttggcacatttttagatttttgcagtattgcctttcatatatacttgacatctctttcgaaaatcttcaaacttgacaaatcctattagctttctcttagtcatgattgcaactccctgctcctccactcggagcatccattgcctgctggggccagtcaaattatagtcgaatctgcaacgatcgttgtagatatggttgttacagaggatccttgctactactacctcctgccatctcttccctttgtttgtttcctccgttgtatccagcactggccccctgcaaaatctatagtctaaccctgtttagatgggactataaacttttaagttcctatcacatcaaatgtttggacactaattataaatattaacatagactattaataaaacccatccataattttggactaattcgcgagacgaatctattaagcctaattaatccatgattagaatataatgctacagtaaaacattctctaattatgaattaattagacttaaaaaatttgtctcccaaattagctttcatttatgtaattagttctctaaatagtctatatttaatactctaaattagtgtctaaataaaaaactaaagttaaatccctaaattcaaagaccacctaagcactgcgaaattgcgaccgagtcactgacatggagtttacatgtcgtgatccttctcaatctcatgacgtctacccttgataacaagatccttttcttgtcacaaccaaattcaaatttcctgattagtactcttttcgttcttaaaaaaactcaaccacgtcttttaagcaggtacaatagcagattataaaccagctgcaaacatattttaataagataaataaggagagagaagagcagcgggctatacatttgtagccagctatagcacggacttcgagacgcaatatgtgtatgacaggtgagaccaggtattaatagtgtagtacgtaactattgtataaatgagctactagattagctatagataaattggagctattagttggctatactattaaacttgctcttagtataatgaatctggatagctttttgtctaaatacattgtatcagaagaggttacatcctcttttaagttgagtatttttggacggttgtagtatttcgtagagggaaaaacgtgtggttttattttggcagacgggtgtgttttggccgcgtcaaatatcagcggcatgcaggtgacaaaaacattcgttctcactttcacaggctgtaaagtaatgcaaagtagaggcataaattaagcaagacgaattttggattatgctgtgattttttttggtggctgtgtttgactgattgctacgtgcgtgcacgtcatcgtcatgcgcgcggtcgtttcgatcggtcgcggttcgagtgagctcatcgcatcgcatcgcatgcaccgcgtgttctacactcttcttcccctggccgtgcgtccaacgttgtacagccggaatacagctagcgaagctccgcgcgtggaaagggtaaaagacgtatactcatacaagcgacacgaccatgcgtctttttctcatacaagcacaatacaatagatattcaaattcatatacatgtgtgcatactaatcccctgtgaatacagggacacattattagcacttgtaagaaactaaatggatatattttaaatttgacgaaattaccataaacacctcactgttaacagatattaacagatatgttatctaaacttaaaattacttaaaagtttatgtgtaaatgagagcatatcatatatctactattataaaatttgaagatgtttttgtcggaattttatttcgttatcggtgtctaggttgtacgtcgtccgcatccagttcagctcgagcctaaaataactactccatccatctactttttatagtcatatttcacacaatgaccaaggataagtaattctacttatcatccatttaaacatgttactagttattcatcgtaaacaatcgattcattaatatttatatttcttgatgcccatgtaaccagtcttatgtgaaagaatggaaagtcacgcattaaatccgagaaagtcattaagatgataggtggttggattaaaatatgcatttcaaaagtaaatttttcagatttggaaatatacctatcaaaagtagatggatggagtactgtacacctcctccccagcctaatcccacccatccctctcctagcccaacacaacccaatcgacccgtaccatcccgcgtgcatccactcgaagtcatgtgctcttcccttgactgtctttttttttactcttttctctttttctttttcccgataatcctaattctctccctcttctttcaatctcttctcttttcccctcattttctctttcggtattggtatctctatctcttctccattattataaaaattaaaaatattttcgctgatactttagcatgttattcgtatttgacttggtttctaagtttgttcgcttttgaaaatatataaggagtcatataagaaatcttttttaaaaaaactcacatgcaaacctaggatgggagtctgattcttaattgctttagaattctcgtcaggcgtacatgatatgaccatcatcttaataagggttccaaattagatatcaatactatcaaaataaaaatcccatatattttttagacaaaaattctaacaataatatattaaaatagccttcacttattgtaacgtatgggtagttttttcttgtctatattaaatttagaactttaacttagatgaataggtttcaccacatgaaacctaatgtagctctcgttactttgtgaatgtatgtagctaaaaaaatatttgtggacgaaagtaatacacgagtactccctccgtttcacaatgtaagtcattctagtatttttcacattcgtgtctagattcattaacatcaatacgaatgtgagaaatgctagaatgacttacattgtgaaacggaggaaatagtaagtagtaactagtaacattcggtaacttg

SEQ ID NO: 12775 - DNA, 12952 bp, Oryza sativa
ccatagtggcacaccccctatctatctagtcgggccaacggccaacgcctcacatgacgggtttgttcgttctgatctctgacaggcaccacaccaaacgcatctccgccgtcgatctccacccgtggggcccacccgcggagacacccccgggcccaccttgtctgcgcctaacccggtgtataatagagtagtaggataatgcaagcgggctgggccccacacggctccgccgctaattcgcaacggcctcaaaataatcctaaccccctttcgctaacacacacccgctttaactccgtgacagcgagacggggttaaccgcggccgaccacgtcttttgattacccatcgcctccatgcaaacgatgataattactactccttctgttaaattggagtaatatgagaaattttgagtttttgtttgcactgtttgatcacttatcttattcaaaaacatttatgcaaatataaaaaaataaaaaattatgcttaaaatactttggataataaagtaagtcaataaataataaataataattctaaattttcttaaataaaacgagtggtcaaacagtgtaagaattattatgagacgtggtagtagtacctcttacgtgtgtgtaagaattaataaaacgtcgctgtcaacgttgctctaaaccagcacacacgtactacgtaggtaactcaccgcctccctgctcgcgaagtaaccagtaaacaattcggtgatgacatttgaatcgtaaatcttctttttttttggtgggggtggggggggggggtgaagttgacacggcctaatcaccaaatcttcatttattttatccgctgggaatgcgtttgactgaactctctcgggacaggagtgcacgagacttcggtggtgtttggatccagagatttaactttagtccctgtctttatacactaatttagagtattaaatatagactacttacaaaactaattatataaatgaaagctaattcacgagacaaattttttaagcctaattaatccataattagagaatgtttactgtagcatcatataggctaatcatagattagttaggctcaatagattcgtctcgcgaattagtccaagattatggatgggttttattaatagtatacgtttaatatttataattaatattcaaacatccgatgtgatagggacttaaaagttttaatcccatctaaacaggcccttcgtttgcatgcggcggcagaatcactcgaaggttcgccggttataccgacttgtagttcgttcggtaggggtgggtatatatgtgtatatttgatacgctgagtcgctgacatcatatgagtagtactccgtggctttcaggttataagatgttttaattttaatcaaagttaaacagctttaagtttaactaggtttagggcccctttgaattaaaggatttatgtaggaatttcataggattcaaatcctataggaaatttttctatttggccctttgattcaaaggattgaaactttccaaatcctatgaaattcctatggaatggcacattgcatgtggattttgaagaaaatttagcaagagctccaacctcttggaaaatttcctttgagtctatctttctcatccgattcctgcgtttttcctgcgctccaatcaaacgaccattcctgtgtttttcctgtgttttgcaatcctctgttttacacttcaattcctatcagaatcctgcgttttttctattcctccgttttttctaccctgcgattcaaaggggcccttataggtaaatatagtaatatttatattaccaaattagttttattaaattaataattaaatatatttttataataaatttatctttgtaaaaaatattattttttataaacttagccaaacttagagcaatttaattttaactaaagtcaaaacatcttataacctgaaacggagacatcttatgacctgaaacggagtaccatttatgtcgaagccaatgatgttatattcatttaaccatatattttgtgtaaggtcattgcggccgcctgataacaatccggcccaggtggggtcggccgaggcccaataacttaaggttgtccggaccccaacagttctttagcacacccactcagggaaaggcccaatctccctaaaagactagtccggtaggggaagggtggctctcctttttaaggtggcttcctccttctaagctaagtaaggtgggattagctaagcaaggtgggattattcagaggctcacacggtcgccgcccgactttagcgtctctgccagcggataatagtggaggatgtcctcatcaccgcctgacccaaaccactatagcatgtagcaattggtttgaggctggttcttttcctcaataaattatagattatcgtagacacgttttacaagtttagaaacatggtattttaaaaactttctatatataaactgtttagaataatattttagaacaacttatctattttttcacaattaattcattcgtttgtatagtcgattatcatcacaaaattagataatctatcgtatgtcccgcccctaaatggagtattatattaattaatctatttagaacatcaatctagtccattaaaaaacaactaatccctccgtctcgataaaaagtaacttagcgtcctaataaaaatcaacatagattgatttcctgatttttattgggacggagtgagtaatatttatcgatccattttaaaatattttacggcgacgcatgatcgtacagtggaagtacgtaactaaacatgtaggaagagagaaggctagaaccttcacgctctttgccctaaaaaatgggtgacgtatccaatccaaacctgtactactaatcaaagggaaaaaataatcatacggcgcttgttaatgttaaaactatatgattgtgtgagtcagcgcactttgcacactctaacctctaaaccttaccccccaaaaataaacacacacacacagacccctccaaaatcagaaagcgagacgaagccgcccaaaaggcacacgaaatggggatcgaaacggaaatacccaaactgcccctccaatggcgggcactggctcagcgacactgacacgcccgggcccacctccccctcttctcccgcctatttaaccaagctaggcatccgatcctactcaccactcaccaccacagctcagctcggagaagcgaagaggaggaagaagagcaagacgccgatggttacgcgtgtgtgctagtggctgagcactagcggcggcggcggcggcgacggcgacgacgacctcacccacggcggcgacacatgttgagtgaacaaacggcggctagtggtagcagcagcagcagccgcggcgccgacgaccgggagattgtcatcagcaccggccgggagatcgtcgtcagaagcagcgggggtgaggagagggaggaggaggtggtggtggaggaggagctcgaggagccggagttcagggacatccacgcgctgagcccgccgccgacgccgacgccgagccagccgtcgtcgtcgtaccaccggcggaggagggagtcgtgggagtccgcggcggggagcaggcacacgtcgatccgctccgtggggagcgacaccgccccaagtgagctcttccctactatgagcagggagttctcggccatggtcgccgcagcagccaacgccaacgccgccgccgccgcagccgcgaacggcggcgactccagccgcgccggggtggacgacgcgctggggaggatcggggaggatgagctcgaggagacgaacccgctcgccatcgtcccggacagcaaccccatcccgtcccctcgccgcgcccacctcgcgctccccgcccccggcgacgtgtcgtcggcgggcggcggccacggcgacgaggtgtcggtggggcaggtgaagaaggaggaggtggagtccaagatcgccgcgtggcagatcgccgaggtcgccaaggtcaacaaccgcttcaagcgcgaggaggtcgtcatcaatggctgggagggcgaccaggtcgagaaggccaacgcctggctcaagaagtacgaggtaaaacaagaaaccaaaacgaaatccatcatctaatcgccattgatttctaccaatcgagctctggattctgatggaattgggggtgtgttgcagaggaagctggaggagaagagggccaaggcgatggagaaggcgcagaacgaggtggcgaaggcgcggcggaaggcggaggagaagcgggcgtcggcggaggcgaagaggggcaccaaggtggcgcgcgtgctggagctcgccaacttcatgagggccgtggggagggcgccatccaagcgctccttcttctgagcgaccgcgccaccctcttcccctcctcctcctcctctctgctttgctcgccgccgtcgccgtcgtcgtcgtcgccggcgccggcggctgatcgttcaccgcttcgcttcacacgcagggatcagtgctgtgatgtggttgctgtgtggaactctcgttttagtgttgtatccacatgtatgatgtactgtcatcatatcctctcttttttttctttttttcttgttctctttactttcttgtgcttgataagggtattgcaaagttgggagggacagacagaacaagtaaatagcataagttggatggtgctctgccccttatagcttatggtgagggggacaagagctgcctgtaatttgttttttgtcatcatcaaggattgtgtatgtcaatatgaacaagatatggagctacctgttttgtgtaattgcttgaccaccatttcagtggcttccttcacttcattctatgtaggagtacgagtgaagtttctctgcagtccggcaccttgtcctgcttcttttatggcttcataagtgcttaacaatattttgacaaaaggacatgaatgcaccatttaggaagaggacttgagcatagagtactgaaccctaccgccttgattccggcatgtgacccaccggtttggcggtttcactttgaataattgagtttgagcattagaacgtgtgttgatctttcatattgtcctgacgagtttactgcgtagctgtaaataacacatcgaggacaaagtgcctgaattgaggattgagttgtttgtcaaatgtcacatcagctcgctctcacactaacaaaggtgagacttcgagaggaactgcagttattaaacagtactattatggtaccagtatatctgaaagtgccatttgcaatccagtcgacagttggattatcccatcatctgcatctctgcttttttaaaaaaaaaactgatctctggatttttatagcagtttttaatatggagtattcgagtttttttttaacttagttaaactgaagccgtattcagataacttagttaaactgaagccgtattcagattccattgtgcggtaagattaagatgtttcttcttactaaaatattccgtttaaattgggcacagtgaagagagtgatgagatttatgcgcatgtttggtttgtaataaaaataaaccttaccaaattttaatatgttaaagatgtgatggtgacatctggttcgaggccttatcagattttgatgtagaatgcaaagttctataattatccaaatttgataaggttattgatgatggttgataaacgagagatttgtaaggccagcgttgggtctgggccgagtaattaagagtcgaatatgccgcatgagaagagcgacggacgaaagggcagaaatgccaaaataatcttaacaagttttgctttacttggtaaggtaacgatagggatggtgatgtttggtttgaggtcttaccagatttagtgtaaggttccaaaaattatcaaattttggtagcgctatgatagttggagctgtttcattgttcaatttgttatcgtaccaaagtttgataataccaatgtttttgataagggtgttttccgacaaacagcacccccctacattttcttgtggctatatttctgtttagattggatatggtcacacagtgaaagtgctcctagacaagtgatggtgtgatcgcggtgcattgactctattccaaagtccgtatacgcacagattcttgtgggaaaatctcgcacagtatcatccaataagaaagcgaccaatcctaataagtttggatccgaccatacctgaaatttctgtacgtccgcgccttttcagttgagccgcaaattgatacgaatccatgctttccttgaacttggacgccatggcgaaggctggccggctgcagtgttaatgctgtagctgtaccgtgtgggacgacgatttcacctggcccatggcatgaggaattaaggattagtccatgtggtgcagaccgctggggcgccaagcaagctcacatgtgtacattatgtagccctgttcttgtgtttcatcacgtaacatggcgtgttccagaaactgacctgctagaaataagtggctgcatgaatgcatgattagaggggaaaaaaagaaagaaagatcctaacagttacagtggatcacaaggatcagagaaggtatgaaacaatcgagtaaatcgtgcaatccaactctacggtgaacattagacatacctggttgcatgattagagaaagaaagaaagaaatttcctagcagttacagtggatcagagaaggtatgaatgaaacagttgcagtaaatcgggcaatccaactctacggtggtgaacataatttacctcataataagtcatacctggtttggaatgatgagtcggtctctggtagttcaggatattcgtcaaccacgtgaaaagacgaagtcacaagatggtaactgtatagagtggaaatctgggcgcttttcagccttttcttgtgatgcttacttgctgactgcttaaggttgaatggccagcagtgaaactgtgaaaggacaggtgataagtgtacacaggtaataccaaaaggtaaattgtttactcacagtaagtcttatatgtacagaaaaccgcatgggcgtggaagcaaacgttgatatatgtacagtaaaaccaacaaaaaaagtagtgcagctgaggctttttgagtatgttcgacttatttctaacaagtgggacaatgttgattgaacctatataaggctgtcaggatactctccattgccctctccagcgaatgtccctgaaggttttgattgatcatttagacatgcatgatgcatgtcgcttaggacagaagcatacgactctggaggaattggcggatcatccatatcaagcaaagactcatcatcaaccagctcgttcttggaagaagcatatgcatccaatggtgttggcagatcaactacatcaattataggttcatcagtgcgaggagcttcatcatctgaagacgagaatgtactaaacaacctagctgaacttaagccagcatcattgtcagtgtccttcgcatcagaaatttccgcttccgaatcagatgattcagcaagtaggacttcgagagaagggctgctcttacttgttttctttgccacgaaagccatgcctaaaacatcatcattgtactcgtaaagcaagtcacacaccttttgcagctcttcgcctgcagttgggtttacagtagaactacctgtaaaaggatcatcaacacaatttccagctgtgacaccacctgagccgacagcttctctagcaggttctgcactaaatgattccatactacacaaatctgacaaggagtgctctacctctgattttgtaaagctatcattgaggcttgcctccaagccgctgctctcaatgcatcttttcttggaatcagtaaaggctctaagacaacaagagttcatcccaccagaaacagaaaacttagcactgtcatcctcattaacctctagagctttctgcagcagaagttgattgatatcctttatattcttagcagattccatcgatgttctcttgaaggtatgcatttcagcaccaccattactagataatgcttcagaaatcacattcttactaaagttagcatttcttgccacaagaaactctgccaaggacaaggtagatctgttgccattcaactgttgtccatcattaatagattccaagacagtaggaagctgagaaggagcgatgatgtgctcagtgtttgcaatggattgcatcatgtatgaactagagccattattctttagatttgcttggcttccaacatctttagattcctcaactgtgtgaagctgtggaacacacaagggttctgtgctttcagcaaatgccatcatgttcaaatcgagaacattattcagatcgtttacctcagccttcaagtttgccttagagatataagtttgtggaactgcatctgcttcctcacaagatatgaaggtattgaccttatttgcatcaacgaatgtaccagataattggccagccgagccatcattagtggatgtctcatcaacttgttcagaagaaaatgggcaggtagaagaatcagtagtattttcagcagttgaattactggcagggcaagcagcagattgcgaagatggtgttttcttggttgaaccaagaagtgcctccaaggctgatgctagagcaccatcgacagatacatgagatttgcttttgaagctgtcaacagtgctttcactcaaagcagcatcagattttgtatgaccatcatcatgatcaccaacttctgtttctttctcttcctccaattcatcatctgaatcatttggaaattctggaaccttgacaactaaacctggggaagttttaggttctttctcagaagacagagcaaaatcaactggtgagaaagacccatcatgaagcttctcacaagcaaactcagattcagaaacaaaatcaggagccttaacaagaagccttggcaccatgctcggtccacgtaaggtaactgcattttcattggacttatcgcaactgaaggattcttctaaagaaaactctggtgctctgacaaccagacctggctgcctgttggttgtggaagcagaattttcagccttaccatcattatctgttttatcctgtggattaatcatatcagataaaccatctggggctgtcattcttgcagaagaagcttgtaaagtcttaatctccatagagaacacatcaaactgttgttccaatcgctgaagccttgactcgatgctacagataggcctcatcataccatcgtcaaacctggagcagtatagttccatcttctccatcttagagagaagagtatccagctttccctcaatgcgactgtaaggatttggattttcatccatgagaggagtaacaggctgatctgtatttgacacactctggttctttgtcaaaggagcttgtgtattttctgttgtttgtataggcaatagaatagacttggaatcctttagctcataatggttgcctttttcataagttattgtatcgccatctatagcatttagtttgctttccatccctgctgacttgaaatttaaatcatctgtgctacacggctctgcatctcgcactacattttcacatggactattattcactgccattgcacaaccttgggaaagctgagtccttgaggcatcagaaaaatatttattgtccgttttctggttccttgatttggacatttgcatgaggctagggacaagcatagccaacaaagaactacctcccatgtttccaggacgtgtttctgattcatcattggttggctcaacaggatcagcaaatatgtaaatctcctcgatgtgcactgatgtttttgactgaagtgaaaggaggcgaacagttagagatacacatgggcttgcatcagttatctcagcagttgcttcatagtgtgcctgcattccacatagcgaaacaaagttacagaaaaattttagaagctaatatcacaataggagcactcccagcagaagtttatggttgagtatttaacaatctttcatgatacaaaccaagaaataaggctttaccagagtggtttcctgtttgactccaattgcattaggttcttgagatttagatctgttcttttccacatgtaactctgggattttgacatcaacccagctatcttcatcaatactactgcttacgcttttggtttcatgctcatgcttttcactagttgaggcatcactactccattggggcatactttcttcagcagaggggagtggctctttaactgcaggtccacaacgcacagtgcatagataatccttagagctatccttggggtcagttgtatagtatatttcataaatccgagctgtgcttcgcacatacaccctgtgaatctcatactttcccctgaaatgaactgatgaacagctgtgaatcagatatatgcatactgaaatggaaaaatagcttagattttcatcatgctaggtactgtgctgtatatgctatgagatgtgagacactgacttgaaatttatacaatgaatcaatgaaaagaaaatcgactctaaattcggcacgatgggctttgtagtttatacagaattccatgtaaaggtttcaactttcaatggaatactgccagttccttttactttcataaaagaaatactagtagtagtttgatgaggatgacgaaactatagtacagatactttcctaatattagcaactctacaatttctgcaagtatacagtgcttagagctttctgtggtaatatcacccaatcctcatcttccaaaaagaaatgccaccaattcaataaattgtttgaattcctaatatcaggtagctccaatttctgcaaattgacagtacaaaggaattgaacaaatacatcattgagacttcagtatgatcgatgatgcttggactgttcacagtgcaacagcttcactacaagactaggtatctacacttaccgcttaccactgatggaaaaatcaaatctaaagtagtaaaaacttagccagatattttcctaaatagtaacgcaaactatcagttatcaattaagaatgctctggtcatggaagcataagaagcttaagtttaagagtatcacgcaaacaataaccagtagacagtagcaaatgaatccgttatatgacatactaacctgtcataatttttatcttaaggtattagtcgaaagtcgaaacgattcctcaagttacgaaaggatctctaaaacagatacctccaatccatggactctacgcattagaacattttaacgataactatgaatgattcacgcactagaactcgaacagcgataaccacttcggttgattctaccagcctactaggttcggttggttctaccagcctactagggtttatccgaccataagctagactagatgctgcaaaactaaaattcacaacagtgagtgcacctgcatccgatcggaccaacgcaaacaccgcgatcccgcggcaaactcgcaaaattctgacaagcccagagagctaagctaccccccaagtcaaaaacgacgactcaccagtgacctcgcagggaggagcgtcgccgtcgccatcaggggaagggcgttcaaggaagacggcggaggggacggcctccgcgtcgtcggcggacgtctcgaacgagacggcgtcctccacggccgcgccgccagccggagcccaggtggcggacaccgtccatggccgccccggctcggatcccgacgcctccatcgccccgcttccacgcgcgtgggtagaccgtgagccggcggcggcggcggtggtgtgctcgtcggcgttctccgctcgcttcgcttccggattccgtcgagtgcttcgctacacacgacgaatctgatggccgtggccggtggggaacacgagatcccatcttatgggcccccacgccgaccgctaaaactgggcccattttgggctaagcccatcgtgagataataatgggccttattgggcttagatccagcccagttattatctcgctaaaatcgaaaagaaatccttcagtacgttatccacatcgcggctgtgcgcggcggcgaggatgcatctccgcttcgtcccgttcccggcgatcgccgtcggcggagcgagcttgagattcctcgccgataacacacgtgcagtgggcggaagcgggaggaggcggtgctccgacgtggtcgccttctcgtcgtcggagaaggggccggggccggggtcgggggaggagcgcgagccgcgggctgaggaggcgctgcggcggctggcggagctcgactcgcagctggaggggctttccgagcccagggaacggccgccggcgccgcctcttccaccgggtacgtcccgttgggcttttgcctacctcgtccctcctctcatgggctcatggcaaattgcttttccagtttacatgtgcgctgtgtccatttcatcaacaattcactatgttcatcagggtcagtaattgatatcaactgaaaacttttagtggtaaacttacactagtttgtgcgtgcaagcatcttcgttttctcaagctcgttaacccaaaaaatctaatgagattatgattgattaagtagtcaaaattatatgtatagtgttctacttttacatatactattgatcaaagttttaagatgttgtccatagttatcctgcaatgacctatatatttggagatggaatatatgtttaaaatagaagagatggatcattcaatcggctgaaactgttcgtggagacctcaatgcattatgcaacatactaggctcactcatactaactttgtcaatgatcagatcaagagctttaaaaggtcggcaggacagatctctcagcaacaaatataaatattttttataaagtgtttggtggagatggatcagtcctctgtactgaaactac

SEQ ID NO: 12776 - DNA, 13100 bp, Oryza sativa
tcacccatgacttggacaaatgcttcattgcttttgtatgcagtagcacaacatgccatattgtcatttatgaagaacctaaggacaacagcaacagttcagtggggatgaagccatccaaaagtggcagacagagctttgaaacacagtaataatgtttgcatcttgagtctctattgctctgaaaacccatccagttgtctttaggagagctaccacgttgcatcagcatcatggtttattgatcagttgttcttaacaatgttaacatcacagtgagatggactccgatctaactgtgatttgcttgaaacagacccttacatggaccgagatatgataactgggcggggatcaaaagatgaacttcctgaattttctccaacgtatgtaacattctcaacacttgcacttgttatcctcacgatattcaccaacgttgtgttcaatctttacatcaaaccttccgtggacggcgtcgatcagcctgtaagaattgagagggtgcctatggttaatccagcagaccagcaattcaagtagcttctagactaggcatataaatttgttatagcaagaagtgatatgatatgctagtaaaatagatcatgattcatgtgtattcaaccatatcttctttttgtatttagcacccatacgttctaaatgaatcattttgttggctctgggaattcaataatagtaggacgttttgcacatgcctgtatggtcttttgacgctatctcctggaaggttatggctgtatgggacttgcaggtgtatccagtttctgcctagcttttagcagaaagggtgaaaatttctcctctttttttatcaaaatacattttggtcagagacttgggcatcttggtgatcaaacacggcacatgtaagaaaattgaacattggcaaccctggaccacacatcaaatacagcagatgtacagatgcatatatcaggagatgatgataaggtcggctgtaaatgcactctactttccctctgaaggataggaattctgaagtgccactgtatgcagtaaacatcctgggtgtcataaacgcagagcttgaatgcgctgtcgacaatggccgtgtgagaggggagaagagaagcagcacagagctgctctggtgtggtagcggtccagagctctacgatcttctactgtgtcgctaatggagtactgtactggtttagccttttcagcttgtctgtttatttggctcttctgttttttttttcgctttctttttctcgccgctttggattatctcgttcagatctgtaaagttagcgttctctatctctctctcttttgaagttcccgtaaacgtcgacacgtcgtccagctttatcattcgctttcgttttcccctgagcaggattctgatttctgagtcgtagttatagtgcattttggtttgtgtcctgtttcgtcagggtgataaacaaggaaccctgatttagcacatgtggtacacggacaggttgatcgatctttgacccgacgtcaaaccccacccatgtatttcccgtctttacttggtctttttatgctagatcattaattccccgttgcttattctgttcgcatgtggatcgtatcccttttttaagagcgagtctcgtacataaagagattagtttatctgagcgaagaacatgctctcagccttttttttctctcctcgatgcgtgcagagctgcagtccaacaaccatacacctcatgtgccgtgacccgagcgagtggctcgttcataccaccacaaaatatcatctcctacatagccttgccgaatcgagcctaggttagtcgtagcagcagcatgccagtattgtagaagtatttctcatcgaagcgctgacgcggcgatgagaagaaacgaacgatcatttcgcgtttcgccgatgggaacggcacttcaggcgtgctacgcagatcttgggcagcgtccacgtcctcccccaattcatttccgccccccaagaaacccgcaccgcgcgtcacgtctctcctctccccgccgcggcatgtgcgtctccccagatccgcgcatgcgcatcccatccgcgacaagtgcccatgcctccgccgcgacaccggcacaccgcgccccgcccgcccgcgaccgcgagggagcgctcgtcggtagccggcaacctgccggtgcgcgtggcttgcgtgcggctcgtcaaaaccgcgcgtgggggatatgcatgggccgcggccggttgcggtgccgccgcgccgtcgcggtcgcggatgcatggtgcatgcagttcttcgatcgtgacacggtgggagggtgggagcagctcggatctggggaggtaatgatcgcacgggggcaactgggcaaaggacggatcgccctccacggcttggctgtcatctggttattctggccgggtagggcagctagggacgggagggggcagagggctacgaacgttagcgattgaacttatccatgcgtgagggagagtattcactgttgttgcctgtggagcgtggagtactataactactactccctctgtcctctaatacaagagattttaatattttacatgtactgtttaattacttatcttatttaaaaaatttatgtaaatataaaaaacaaaaagttatgcttatagtactttagataataaagtaagtcacacaaaaaataaataataattctaaattttttttaataagatgaatagtcaaacagtacaagtaaaatatcaaaatcctttatattataggacggaaggagtagcagccagctaacctcttcgtctaagaaaactcaatcctagccaccaattggattctttttagagagaatagtactgtggtagtagtaagtttttttttcttctcgttacaggcacgtgatgggtgtgccaccaagtgctgcagcgccaggccgccagctagttgctggttgtcattttgtcatctgatgaatgaacagcagtactagttttgaagaagaattactgcgagctgtcccacgcgcacggtgcaactatttttcactcggtctgtagtatacactgagaaaaagagagagatgaatgccgttcagggcggaaccgatccaaaatgaaaagtatacaagtgctagctggccgatagtacaataatatctctgttaagaaatgtttgcgctggtgactgtagcagtaatagagtatttgtcgtgtgatgtgctcgtacgtactaaaattcaaaaggatacaccacccatataggctgattataattccccgtcgttaaaaagctgcaacctggagactacacctaatacaacaattttcagtcaacacgtgagagatcctgcgatgaacaccacgacgcaccaaaacaaaccacggaggcatcagccaccgctttggcagccaagaatcgcatggagagccaaagctacgactactactagtacctcgcacaaatctcagtactaaagaaaatcaagtgtgttacgtcggcatgcaacttgacgctggcacaatctctccgtcgcggcgtcgcctcggctgatcggtttcgcgatccaaccaacccgccctgcttttcgcgtaaagaaatcgcagagacgacggtgctatctggtctggtggtgctggcgtaccgcacgctcgctggtgaaactggtgtgcccggtgcgagcagaggcagagactggacagagcagcgcccaggcggggtacatctatctccagttcggtcgatgcatgtgggtgcgtagctggacggccaggccgaaccgcagagcacagagcaaaagcgtcaagcgtcaaggcagctctgcaaattgcaacgcaagattgaattatctttgttaaatcctatataaactagatctacataaatatgtgaaacatgataggggagtcatttcttggttctaaagcatcataatgagattccaaacctccgaaatctctactgcattttctacaagggggaggtttaacgcaaagctgcaagcggcccgggcagccagcccagaaagccgaaagaatcctttcttttcccctcgccgcccaagcctccacatgcgctctcgtgccggcctgaaccctgtcggaccacgtccatgccgcattatttagcccccacatggccgccgctgcgtgcctcctcctctcgtctcgctcgctgaagacgtgatacgggcaagcgcgcgccgagtcggacagggagcacctttggcttgtgcgcgctccagcgtgacagcgtttcagttcaggggatcggacagagacgtcgcgtgcatgggtggcggtgtggtgggccgcggcttgtgcgagtacgtggcgcggcgacggtggctctcgctgctgctgtgtccgtcctcctgctactagtacgttttttcacgggctggtggagtgatggacctggtcagctactcagtttgcattcatgcatgcaccaccgcctgcgacagtgcgagcgacgtgacgacgtctccttgattgtctctcgtgggcctgtgctatatgtgatcgatctaatccctgcgacacgataatgcaatgcatatctctacgaaatcgaacagtagaacatgcacttcgaccttttctcatccgaaataattagtgcgggatactcattatatgcgaattcaatcagagggggctgcaatttgcaaactgcgtataattgtttcatgtggatttaaataacctcctcattgctagtactcctatcatgttgacttacacggaaaacgagctgtcttcccgtccatttgcggccctttgccgatcataaccgagacaagcgtatccagaacaggtgctagcttagctacgcgacgcccccgtcttgaggctccgggagatccgagcgcacatgtccgcgagttaatacgagtgcgtgccgtgccgcccggccggccgggcgggcggagcgagcggcttctgctttctgcttctgcacccagcaatgtgggcgctggccggagcacggagcgggcgaaagccccagttcgttcccatcccacatgccattgctaatcatgcacgcaccaatcacgcgccggccgtggccgaacccacggcgatgcttcccggttatcaccaccacggcaccacctatctctgtgcctgtgcgtgtgtgtgcgtttggcatgttgcggtgtcagggattgattcgttttcactcatcattcaccgcgaatccttctcgtgtccgctcgtagtaccaccgcaccgctggccgtctcggtgtccgaggccccgagcccaagcatgtcccggttcgatgggtggtcaaaaaaaggatatgagagggagagagaaaaaaaatgggaggaaaatgtatcgtttatcccatcatgcatgcacactgatcctgacgcctccacgcgcggctctttttataccaccctcgagagctcatcactcccgcactcactcacacacactcaagccagctccagccacacgagcctagttcaggtagatacaatggcgtccaccgcctctttcatgctcgccgtcttgctggcggtggccgtcgcggcggcgccggcgagggcggtgcgatgcccgccgagcgacaagcaggcgctgatgagagtgaagcagtcgctgggaaacccggcgacgctgtcgacgtggtccctggcgtcggcggactgctgcgagtgggaccacgtccggtgcgacgaggccgggcgcgtgaacaacgtcttcatcgacggcgccaacgacgtccgcggccagatcccgtccgccgtggcggggctgacggcgctcatgtcgctgtcgctgttccgcctcccgggcctctccggccccatcccggcgtgcctcaccgcgctctccaacctccagttcctcaccatctcccacaccaacgtctccggcgtcatcccggactcgctcgcgcggatccgcagcctcgactccgtcgacctctcccacaacagcctgaccggccccatcccgaactccttctccgacctcccgaacctccggtcgcttgacctccgcagcaacaagctgacgggttgcatcccggcggggctcgtgcaggggcagttcaggtcgctgatcctctcctacaaccagctcaccggcccgatcccgcgcgacgacgcgcaggacgagatcaacaccgtcgacctctcgcacaaccgcctcaccggcgacgcctccttcctcttcgccgccggccggcccatcggcaaggtggacctctcgtggaacgacctcgacttcgacctcagcaagctcgtcttcccgccggagctcacctacctggacctcagccacaaccgcatcaggggcaccgtgccacgctccctcgccgcgctctccacgctgcagacgctggacctcagctacaaccgcctctgcggcccgctcccgaggctgcacggcgtcatccgccacggctgcaagccgtacgagcacaaccagtgcgccggcggcgccccgctcggcgggtgccaccaatcgtgagcatccatccatccatcaccgccggcgagctgatgctgccacgtaaggtggagcccggggtgcgtaacggtatacgtgtttggtgttttttcgcgtacggggacgtggccgtgtagtacacggtacgacgggtgcagccgtgcagggtactgggcgggtttacgttagtacaaattgtaaccaaggtagagtgcctgcacgcgtgcgtggtcgactctccttcagattgtacgaaacgagggagccgtgtgtacgtgtgcgtacgtgtaccgtgtatggagtacgatgatgatgatgatgcaagtgtgtgtattgtgaatgtacgttatggatcgccctaatgtatcatcgaaatgataagtgtttgatataatttgcctttcgttcttgtactcgtacttgcgagcgctaactgggtacacctcctttttgaactcaactcagtataccgtgtactgtggatctactgtaaagtggtaggataccccactttctgcatgatgctgcctgtctgggataataagaactagctgggtggcccgcgcaattgcgcggctagcatccatataaaattatctatttttaatatgattttacttaaattttattgaataaatagttatctcattattttaaaacttttaaaaatcaaaccatatcatcctcgtgtttaattttatagtttttaaaagttaccctattttttatttgcttgctcgatctatcactattcctattcattctccttggaaactttaaaattttgatcttataatttttagagtttattgtctcttagggtttcgtttttataatttttagaaatcccatcaaacactgccactctactcctatattgcccatccgttgcctcatttctttattgttattgggatttttaaaatcgaacataattattgtttgggtttattttttactttatagaactcccgccaaaccgttagcggctttgccactgtactcttctacggcccgtccgctgcctcccctctttattgtcgttgagattttaaaatcgaacattattatcattttttttactttttagaagttccgaatctttaaaaataggacctggtaatttttagagtttattttcgttgagtttcatttttatatttttagaagtctcatcaaacactaccactatactcttctataacccgtctgctgcctcctctctttattgtcattgggattctaaaaatcaaacataattattgtttgagttcatttttttactttctaaaagtcccaccaaacaattatcggctttgccattgtactattctatggctcgcatgctccctcctctctttatttcattgagattttaaattggaacattattttcattgttctttttactttttaaaagtcccgaacctttaaaaattggaccttgtactttttagagtttattatcttgtttcgtttcatttttataatatttagaagtctcatcaaatgctgtcactgtactcttctatataccattgtttagttctaaagatataattatattacatatatttctgttatcaatcttcaccgttctaatttggttctaccacagtctaatggcttggaatttattcttcgattaatgtgataatttatatcttttagaataaatatggcacattcttttcgagttgtcttaataataaagatttctacgttttttttatgtctctgatgatttttctaaagctatcttaataatatatatatagataaatgtacatatttggcaaagaatatttacatatttattattggtattatatttttattccaaattttatttttaagtttattttggaacctatattttcaaaggaaaactttttaattgtatcgcttaaggtgtgcacctggctagctgctgtgcacatgccatcgttccttctgtttgttgacgtgcatcgtccaattcttgctcatcgtgcagccgcgcggctcgacctgctgctgtggatttccgttgctactatacattatagcctaactattctagaacctaacttaagtttagaaaatcggacaaaactattttgagtccgtttgcatgtaaagatcctagttagagattgattctaattcagttaacatgctaagtttgtgttaaatctcagacattgaaatctatgcctcttacaatccaacggtgtaaataatttatattttcttcgattaacgtgagaatttctagcctccacggtaaacgtgatgtcttcttttcgagctgtcttaataatataatagatctagcctatctgcgtacatgggccaggaaattgggctaacttaatgaggccgggttagaggctagcttaaagcaggatgctttgataagtgttacgtttacatacttggaagtgcctgtcttccagtctccagcccaacaccgagtcccattaattttgctcaatcgatcgttaacgagaaagagggtacacggtgctgggacactgggaatgtctggcgcacggctgtgaactgcagtctcccctctctctgatgggcattgttgctccaggaagggaacaaaaaacactagtaagaagcacaattatgggttacaagttacaacgaggatgaagcactgcacttattaatttcagatgacccgaacgcatcaaattgttccgagatgtacgtatccgtgtgaccgtgtacgagtgttaccggccgtgatcctgtgaccgaaaggattttgccggcgcgcgcaccgcctggcggtacattggaggtacgactgtacgaggcggatgacacgcgcatcacgttcatgtgtagcagtagcatcgtgtagggacccgtcgagtaaataaaaaccaaaccacacgtgaagtcgtgaagctctttcatccggcattttgcaactctcgtcccctccaacgcgtgcaccaatagtacctgtcacggaaagccgaaccctcatgctcactgctcagtggtgcgatcttatactctgttttccccttccattacgcatctgatcgtcctccatttcgaaaagtctaccttccagaggttccaacattggctcgaaactttatttttttttggtttggcgtcgagatctgtagcgaatgacactattgacagttgaaatcgatggaaggatcggctaaagagggcaacaaagtactgcttcgtagccttgttcatttctcacactaaaagccacccatgaggcaagaggccacaaaaagagatcaagcgttagccacggcctgcctccccatcttgcccagcccgctttctgtcgagcgtagcagcaagccagcccacctaagcttatcgccttcacctcccagcccactaacagaaaagcaagccatccgggctgatcacccacaagccacaggcccacaagtccaccgcttgtctttgtatcggctgccactcccattttggaatttggagtagtttgcatttttgcccgctcgatgaccaagtaatgaaagtactccattcgaaaaaaaaaaaactcactaaggttatgtttttttagacggagtggcagacaagtggagagaaacactgtcatagtgcttacacatcgaaagccatttaataatttcactaaattcataaaaaatcatactaaattttattttattttattttggataaataattaatctgcctgaaattcacagatttcgtggttatcgatcaaaaggcgatatatggccccgaaccatagagagcaggtcctacctggaaaacttgagagttgggaacacatgtctattcacgcgttagcaacgggagatgtttccattggggcgtttgttttttttttccggggaaaaagggaaatttcattaatcaatcaaagaatcctcacacacaaggtgtgttatgaggttacaagtgttgtctggccaaaactcagatcgagacacagtccgacccctattagctaggaagtgactaacagtattctggcattgcaacactttcttaatagttatttccctgtttcctgagatcaactcatatctcccgaatcaggtgagccagttctgatctcacattatttgttgactgaatgaggtttacagcttccattggggcgtttgtttgaccacgacggcaatgcgacggacacggcaagcacagtcagactgaagcaagaatagacaacccttttcctttccctttattaacgtgtttctggaccgtatactccctttctttagcttgcttctggatcacacagtctgacaattctggccgtcaagactcgaagagtatcactttagacatgagacttcttctgttctttagggacgaaaaattaaaaaagaagaggaggaggaggagagaaactgcaccaacttccagaggaacgcgaacatcgccggtgtttgattaaagcaatcacctttggctagtcgtcgtatatatgtgagtactactagtatatgtcgtggtcgcgaggctgtccaaatcgccaccatccatggctgaccacgtccacagtgttctcgtccaccatggcatggacttgttttcagcacgcctgcaggcggcggcggcggcggctgcagcagcaccaccactcgctcagctccacccggctcggtcgcccttctcatgcctcgcgtgacaggtggactggccgagcatattcgcgcgaatataatagacggatttggtattgtaccgtcgagaataaaaccctgttttagatccaccctaaaattttccaccctgtcacagaacatctgcattaaatattaaatattggctaaaaataactaattacacaaattgtgactaatttgcgagacgaatcttttaagcctaattgctctataatttgacaatgtggtgttgcagtaaatatttgctaatgatagattaattaggcttaataaattcgtctcgcggtttattgatgaattctgtaatttattttgttattagacaatgtatgtccgtatatccgatgtgacacagtaaaaattttcaaccttggatctaaacacaacctaagtgcaagtttaatagtatagctcgctactagcttcaaattatctatagacaaattaatggccaatttatatgatagttacctataaacatatactacactattaactagcatagtggccgcgtagattgcgcagctaatataattatattttatctcatataatagcatatatgttttctgaatttattattaaaatatattaaaattataacataatttaaaattttgtactaactttacgaaactattaatgtgtaatgtttatattgtattttatatacgtgttagttattaattatttttaatataaaattttatttatttctaaattatattcctatatggactctagacttttctttcaatatttcttttttttaattccgaatttttgttatctgtgaattgtatttctatatagactctaggctcttcttccaatattacttatttttaattctaaatttttattatttttaattgtatttctaagttaactctaaacttatctttcaatattctttaatttttgatttcaaattctagttactattcctatattgattttaaactcttcttcccatgtttttttattttgaattttatttatttgtaaattgcatttttatacggactctaaactctacttttaattttattatgtttattatgaattttagttagttttatattcctatatgtactctatactctacttctaatattcattatttttaattccgaatttctattatttcttaattgtatttctatatggactctatactcttcttctaatattctttttttttaattccgaatttcagttatttctaaattgtatttctatatggactgtagtcacctcttccaatattctttattttttaattccgaatttcaactatttctaaattgtatttctatatggactctatttttctttttttccgattaatatgataatttctaggccgtgagagcgaacgtagaggctcatttttctattcctttaataagttaatagatatctactctcacctgtcatatacacattgcatcttggagtccgtgctacagctggctacaaatttgtagctcgctcgctgctcttcactcttttcttttatctcctcgaaatttatttatagatggcttatagtctgctattgtacctactgtaaatagggctagattttttttattttttttgccatccgatatgctttgaaattcgtgctatcagggaagagacctgctgctcagccgattgcagcactgaccgcttgcttcactgcacaagttacgtttaaattactcctcggttaaaaaaaaactggatagaatgtgacatgtcctaaaacactaaaacaatgaacctggataagaacctgaacaagtgtccatgttcattggacaagacaaattaattggagtaaaattgtctatctatagttgatataaaaatgatcagaatttaggaaacacagtcatgtatgtgcctttcctctatataaaaacagtcaggtatgtgcctttcctctatataaaatgtaaaatgtaagatgtaatttg

SEQ ID NO: 12777 - DNA, 45536 bp, Oryza sativa
  unsure (1)..(45536): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttagttcctaaattttttttaaaaaaacatcacatcaaatctttaaacacatgcatgaagcattaaatatacgtaaaatctatttggagaggcctctcgtttttgccttaaccagcgacacctgaacgtgtggagaaatctactatagcgtactacatgcatgcattttttagaagtctactacatcacatgtatgttattttcctcttcaaacaaagttttctctcaaattacttatccgacctacaatccgattacaccattgtgttcgttacaattaaatcttcacagtaagatcttacatgattatattacgatgaaaaaatatttatatttgtaaattacttttattatatatgtaagttactttttatcatatatataagttacttttaaatttgactaaattacttcttagatatataaaagtaaattcaatagagtctaaaagtaatttacatatattataaaagtaacttaaaacaaaacggaagtaactttgtcacgacattagaagtaaattcgttgtacggataaaaatatgactttatctaaaaataaaatttaatcagcacaaatcaacacatgtaagtttaacaatttttaaaagtaactttaatgttaactgaaagtaacttttgcatggttcaaaagtaactatatataaatctgcttaatcatcgattgttttttttcttttatttttagctgtgtagttacgtccaatgaaaaagggcattcattaaagttactttccttttgttataagttatttctataatatatgtaaattacttttaggctttattgaatttactttcatatgtctaaaagtaatttagtgaaatctaaaagtaatttagatatattataaaagtaatttatattttttcatcaaaatataatcatgtcggatcttgttataaagatttaattgttacgaatacaacggtgtaattggatcgttgatcggatgagtagtttaagagaaaattatatttgaagtatatgtggatagtgtctctcatagatggagtggtagctggtttagacaaatcagctaccactagctgtatagtcacatccttaaatatagattaaaaaaactaattacacagttaggagggaaaatcgcgagacgaatcttttaagtctaattagtccatgattagccataagtgttacaataacccatatatgctaatgacggtttaattaggctcaaaagattcgtcttacgatttccaggcgagttatgaaattagttttttcattcatgtccgaaaaccccttctgacatccggtcaaacatccgatgtagcacctaaattttttttttcgtgaactaaacatgccctagtacgattcacatgtccatgccgaaacttctttttttttaaaaaaaattattcacgcttataacacccgcacacccacccatatgaacacacatgcacaccctatctctataagcaagacatattgttagattgacgaagtcactatggatgtttcgttgtccgtggcaaacaattttagatggtttatttaatgttattatatccatatttttttaacaagtctatcttatatcttatttatattaaggaaaatacgaactagtgttggaaaaaaattacaactaaatttaacaaagcctcttctccactacatccattgcaatcatgtccgctctatgttgtttccattcttgtcgattttgccatgggtgaaggaaaggggaaatagagaactaagtaaaatctggacggacaccaattacacagtagcttttaaagaccacaatagtcatccatcccaaaaaatggatcatagaaccattgaaaaaacatcgacaagtctatgccccaatcatagatcagatttgctccttcgccgcaattcatctacgcaaccatagccctccaccagtactagatggaccaccggtgaagcagagagataaggaaagaggtaattccaaataatgttatcatcatctccccctatgtaacgtgccatggacacagaacccatagccaattatgcacccataaaagaaatcacagaggcaagatgatcaggggatcaacagtaaaagatcctccataaacaaccaccattaacgacgaggaaagaaagaaaaacttatttagggaaaaacctaaacaaactactagatccattaaagggtggatttcccttcccctctcgtacccgcgcgccatgttggagaggaggaagaaggggactagtggatgaaacaaggttttttttggcagcgctaagggaggctctatgcaccaaagagagcccaagttgtattgacttgacgtggaacaataagttttatttgggtgcatcttttttgttacggagagtttttttttaagtgagatatgatgagagaagagaattgcccttttatagtagtagagcaatggaactcatggaattggtttttcgaagagttttaaaacaagagtgataattaggacggtttacgcaattttatcttaaattcagtgctatgaaaatagatgcacaacggagacacgaatttttacgtgaaaaacccttgcgggaaaaaaccacgggcgccgaccggcaatgatcactatagatgaattggatacaaacgcaggggatacattgggctgtcgcaccctccctgtgcggcttacaaggaatatatataggagaaatctaggagtcctaataggaaactaatcctataatacaaagtcatattagataactaatccgaatatattgtgggcccaaaatttggatcacatatttaacaatctccaccttgagatgaatttcccttgtagcataaaaaaacttcaatctccaaacaaccttgtgatgagaaatcaatgtgctccaaaatattcacttcgactataatccataacacccttaatccagaagaggtagaccatgcttcaaactcgccattaggaacaaatcctgaatctactggtatgatattgtggaacccagtagagacgtgaaactgatgcacaaatttcaaactcaccatgggaataaaatcctgaatctgctgacattaatttctagaatcctagcagaaacgcgaaaaattattatgctcaaaacgaagtacttagatctccttattaaccttccggtttgttgggcatgatggtagcaaaattcgccggacaatttgatcaccttgtgatctagacaggagcgaggctccctcttgaccacttgaatgtgcttctctttttttttcagcatacttctcctcctaggtaaataccccgctgcaaaaattcacttggcataatgagaatattgcatctcaatccaaaagcagtagatcaaacttcaaagtcgccttgggaataaaatcctgaatctgctggtacaatttgttaaaccctagcagaaacgcgaaacactatgggtgcatataacgaagttgatctacgtatacaacctcctggtaaacatggcttgtgaacgtagcacaaaattgaacctgaattggattcacccaaacagaaccgaagcaccgcaattgaattgaatccctggtacgaaggggcatgtgcatgcagcaaaaaaccaacgtgaaattcaatacacgtgaacagtaacaaggctgagtgtatctgctgatttttctttccttgatcaacgtgctggagtagatggattgctgctttttctccaacacgctgcgcggcggcaccaaatcccgatcggagtcgacggctgactccgcttcgtaccagctaatcttatctcagcaaacaaatcaatctgacggcagcgatagatggaacgacgcgacgacacgcgcctgctactgccgatcagatcttgcgacgagcgtaccggcggctaaaacttgcagatggggtctccaagcagactaactcggcagccaagatggtagtagatcgatgctctgataccacttgttatgaaaatagatgcacaacggagacacggatttttacgtggaaaacccttgcgggaaaaaaaccacggacgccgaccggcaataatcactgtagaggaattggatacaaacgcaggggatacattgggatgtcgcaccctccctgtgcggcttacaagggatatatataggagaaatctaggagtcctaataggaaactaatcctataatacagagtcatattagataactaatccgaatatattgtgggcccaaaattcggatcacatatttaacattcagcatataatcacccttatagtttgatatatcttcaaaacatttcaaagaacaaatttcacagtttaaagaataggccatagatccagggacccgtatgctcagttggatacttggatgtggacagtgacgggttcgaatgaaatgaaaggccgaagctttaaattcagagtaaatccagctttcaagcccagttcaaaaaaaaaagaaagtcaaagcccaacccataacatagcccattcattctagcccatgggccgattcagtaagacgatcaggaagtctcctcgtggtgtcttcctctcgaatccgagcgagacattggccttcctgattcctcccttcctccttgctttggtcaaccgcgtgtgtaccgtagcgcccagctccggggggagtcgccgcgccgaggaatatccgctcgcgactcgcgaggatgatgacgacacggaacgaaaagaagcggggcgcgcgcgccgtcgctgtccgcggcagcgtcagccgcctcgcctcgcctgccgagcaccagcagacaccgcgagaaagtacaaatcggagtcggagctagcgccacccaccccgctgtcgccgcgctgaccccttccaccaccaccacccgcctcgccttccgccggcagcggcagcggcagcgccagcacgcggcggcggctagcggccggcccgctcctccaagacatggccgcccgcttcggccccctcctcctcgtactccccctctcctccgcgctgctcgtcctctccgccgccacggcgccccgtggccgtcccagccaaggtatgggagggttgtggattgttcacgatcgtgtccgtgctagagatttgttgttgttgttgctgctgcttcgctgaccaccttgttgcagtggatgtggggaggcagctgagggaggagttgtgggagagaaaccaagggcacgagatgctcaggtcgtggcgcgacggtgacccgtgctcgccgtctccatgggaagggttctcttgccgatggaaggacggcaacctcttcgttgtcaagctgtgagttccctgaatccctcgttctcactctcacgatcacggccatccattggtgctattcattcggctttgatgagaatttatttggtcgttcctttgaatttgttatatatgcaagtatgaatttgagttgaattgcaactaatgtggtacatactgatgtctttgcaggaacttttcttcaaagaaactgcaggggccgattcccgccgcgattggtaacttaacagaactagatgagatgtatgtttcactaatctttttattccaagtgtattcgtgctatctcagatgcttgttttatattcttattattaattgtgggtgcagtgatctgcaggacaacaacttcactggttctattccagaatctttctttgatctcacacacttgctgaagctgtaagtagatgctgttctttaccatttgctcttacaataaaaaaaatgactatgcacaaattccttgtgtcattctgggatatcaagagttttacataatttagatcatgctggtttcagttgatatacatctcacatatggacatgtcttattaaacatgatcatttgtccaggtcagtaaagtgcaaccccttcttgaacaatcagctacctcatggcctatctatcagcgtggaatttaggtgagatatctgttctgatgttcaacgtatatgatcttgagtggcagtaacataattgtactaaacttgcttatggaatataaaagctatggaggctgcgcttatcatagtccacctggagcttccaatcagagaatagctgttattggtggtgttgccggaggatctttggcatgcacttttgcacttggatttttcttcgtttgtttcaacaaacgtgaaaagaatcctcagaaaaaagactgctcttctacaagaagtacgcacccttctacacaagtttgttcccttatgcttaatttagatagtactcactctgtcccaaaatatagcaaactagtactggattagacacaacctattaatacatatccagattcgtggtactaggttatatcaaatccgatactaagttcatatattttgggacagaggtagtaggtgttttacactcttgcaagtctctttttgctgtttcatttgcatttatgtgtccgtatgtgcatttcgtgtgcatgcgataagaagccttcatttggtagatgaagccgctcttatatatgtctcacactttgttagatgaacatgcatggtagtaggccttgaaatttgagagccgtgtagtaaacaggtttatccaatttttgctctttgatggaggctcatcaacagaagtaggagctgcattcatcagttcatcgtgtcctataaaataaaatacacctcataatcacttattgtctaaatactcaaaacaccaataaattctttctataatgttgtatgcagatcctgtttttgaagaatgtagcacccacaaagctacaaactctgcagtacaacagttatcccttaaatcaatccagaatgcaacgtgcaacttcaaaaccttaataggggagggtgggtttggatcagtttatcgaggaacattagcacatggtgaagaagttgcagtaaaggttcgttcaacctcgtcgacgcagggaacacgtgaattcaacaatgaggtacagatgaaacctgcccctgctagtataaaggaatcttgttgtgggcttggggtgaatcaaattccaaaaaagttgttcattgtgttgcattctggtaaagaagctaaatatggattctttggccgtaaattcaagaacaaggaaatggtagcatcatcagttgtcatattgttgataactttgcatcaacaatcagttctgtttgaaagaatacattaataattagttgtttagtttttcagtatttatctactgaaatcattgttttatgcaaagttctgatcatcaatcaatcaattgacacagttgaggctgctttctgctgtgcggcatgataatttggtcccactaattggatattgctgtgaaaaggatcaagaaattttggtctatccattcatgtccaatggttctctacaggatcgcctctacggtatgaggtttcattagatttaatcactttcagtttaagacccttctttgataaataatatatttcttaggtgaggcgtcaaaaaggaaagttcttgattggcctaccagactatctgtttgcattggtgctgctagaggttagcatttagcactgtcttttttgtctggaaaggcctcatcccattgtttttattgtgattgaagaaaatcctttctgtgcaattcagggacataagttactctgcaaatgtctcaacattgcaaacgctttctatcatttcttttacatgatcgaatgcttgttttgcttgttcaggactagcacatctgcacggttttgctggccgctgtatcatacacagagacgttaagtccagtaacatacttctggaccacagcatgtgtggcaaggttgcggactttggtttttctaagtatgcacctcaagaaggtgacagtaatgcatcaatggaagtcaggggaactgctggatatttagaccctgagtaagttttttcattgctttcacaaaggaacaaaacttttctttcttttcttctatataacaatcaattatcaatgcatttgttagttgaaatgcctacctgtcttgttccctgcatatattatgtgattcaacatccggcttatcaattatgcgtctttctttcagatactattcgactcagtcattatcaaccaaaagtgatgtgttcagttttggagtggttctcttagaaattgtaaccggaagagaacctcttgatgttcagaggcctagggatgaatggagcttagttgaatgggtaagttctcattgcggaccaagtgaccaaccaccaatcacttatctatcaaaacaaatctctctcctcaaagaaaaaaaaagtgaaatctcatttgttcggacacctgcacaaaatgatttctagccactacaattctaacatgtcttaccctggtttgcaaatgtaggctaaaccatacattagagaatacagaattgaagaaatcgttgaccctggcataaaagggcaatattgttcagaggccatgtggagggttcttgaggtcgcatcagcatgcactgaacctttctcgaccttccggccaagcatggaagatgttgtcagagagctagaggacgctctgataatcgagaacaacgcttcagagtacatgaggtccatcgaaagcacggggacacttggctccaaccgctacctgtccattgataggaagatgtttgcttcgggttcagctcgattcgcatcatttgacgctacgaaagggcatttgcaaacgatgccttcgcttccggggtagtttggctgtgcaatggctattgtttttatgacctcagggggatgtcatgcttgtgttgaaggcatcaagcaacgattggcaagataaggatatggagatgctccgtaaactatacccatctgtacagatatcagaattcagagatcatgcagtgatgatatgggaaaagcttcacaaacagagcagttttgcctttgcagtttgtactgattcaatgcttctgaaagtgccctcatatactactctttggtttcggtcttagatcacttcattgtttcgattcctcctccttcagaaagtatagtacaaaggatgtaattcatttaatgctactatattgccttttgcaatctttcagacaatttgagtcgcagttatcaacaattggatgagtgcgtctttgttcaaacaaggattatcgatctggttcacttaaatcaagctgtactgttcccgatgtttcttcccaagcgctatgatacaggaagtgtcaattcaaatggaatggaacaatatggcgttactatcaaaatcttgtgatttcatctctgaaatattctagatatcttacacaggtaaatcgtacgcaacagaatcaaaaagaaaattgagaaagcaaaaacaaatgtgacaccatgcccacaaccccagccatgtgtactcctaaggaagaataattcaataccttcaaaaccaaacagggagaatgacacgattttgaacctttgacgagtcgccacgaaaaaaaaaagagcaaacaaggatcgaatgtatgtatttttggttctccattttgaatttatggtttgcttgacaagattagagttccaagctataatatggttcttatatgaattcatggttacacattttccaatttccagccactccacttgaaaagattagagttcccagctataatatggttcttatatgagttcattgttacacactttccaatttccagccactccacatagtacatgtaaaaaaaggcaaagagtataactgcaggtaaaggtccatcaaaaacctccagaggaaggtaaatgcttcagcaggtgacttccgaaggagagcatgagtcttgcgctcattggtttcttttcaattaatgttaatccaaaaacacttaacaagacacagaaggatgacctgagggtaaatatccataaaatctggaaagagcattgggtccatctgttcttgatataagcttgaacagtaggaggcatatgcaccaagctatagctgaaattggcaatgagttgtataggcttcctccattagttccttagcccaactcaaagttcgacgaagtattgattctgaacacaatatcagatcaattagttaaacaacagctaatctaacatgcaaaaggttaataaaaatccaaggaaatagctgggcatgaaatgccttacccattttcatgtgatctaaggtatgccaaataattcatgactacctttatcagcagatttgtctgccccaaaaaattcacgagtccctttatcagcagatttgtctgccccaaaaaattcacgagtccctttatcagcagatttgtctgccccaaaaaattcacgagtccctttatcagcagatttgtctgccccaaacaattcacgagtcctgttatcagtggacttatctgtgggggtgttgtcaaggacttgatactgacggttagtcatgtgccattcattgacaataatggctgaatcggtaaaatgagaactacttccctcaccatcagaaggaaatgacactgcaccatcagttaatctccgtggtcgccggacaggtctgctgctcctgcttgaagatgggaagtttccttccgcgcccttctgctttgtcccaataaagccacaagcaagagcttccagagctcgggttgttggtgggcggcttctggtactctgcctcctctgctcactcaatagcccattacaggaggcattgatgtctggaagacagtcatccatcctgttggtttcagaagaatgtatagatctatccattgtatgtgtattcttgtcagaagaaggcacgatgtagctcacagctgactcataatcagaaggcacttgtggaatattcagatcaataacatgcttatcttgggacttttccttgagtaccattttttcatcggtagggggcacattgtactgcttgtgacataaatgaatgttactcatgtcaaagtttatggtagttgatgagttcggaattgaaccccatatgaaaggcttagcccctgcgcttgcttcatttgatttagacacatcatgttgtgcggtgtcaacttgcttcccatgctgtcttttattggcagcagtatttctgcgtccagttctctcattcttacaagatactaacctccttctctttgcaacagatgctgctaagaaaatctggggctcaggagttaccctttgatcaaactgaaagtttatttcagtggaagaattagtagcatggaccctttgagtaccgacaggaagaatagttgcagttgaggaacaggcattattcattaagctgaaaccttgatcaaatgacatgtgaccattggttgatgtcattgtgcctgcgaaagtagaattcttctgaagtacatcaatatccatcctatcacctgttggtggtttacatttcttctcattgacatacttagcacctgtcttgttttgatttgtatttatatgttcataagactgagagctgtcctctgagtcagagtgttcttctgaactgtcactcccagaatcttctgaatgtggtgaagacatgtaaccatgactggcatctgtaggtagatttcttagggacctcaccttgcatggttcttctccttgaacaacactagtatccaccacagtaaatttcattagctctggtgaacacccaggttcactgggccgggtataacaagaagatttcttgtcagtaactgtgcttttctcaagttcagcatcatggatccatccattttcaatcttgaacccaccttcaccattactaccctcaactccaaattcaagcagtcttggttctgatgcaactttgcttaacacatcactaacagaatcaaaataatgatttcctctgacaagcttctttctagaaaatttctttacgcctggaatgaggaacactaaagcatgcttgccaactagagaagaatccttaggctgctccgagtgccaccctcttgcaagcaggcgaggccagacagcctcccagaatagatcattagattttgccttgcttagtctgaaatcaccagtcaaaaactttatgatgtctccagatgaaagcgatgagcaagccttgccgatagggatttctgcacgtgttgagataccatggtttctactaggatctaatgcaaatccagtcaagtcatattttcccttgccaattccaactgcctctacaagaactcgtgcgccaactgtggaccttaaggacaaaataaactcctcaaaggtagatgttccctcgttgaatgttttaaagacctgcaggacaccatatacctcttgagaaaattaacaacaaatataactcaatgcttggattctttgaaaagtagaatgacatgattttaatggttttatcatgaaatactagtgcattaatgctaatggaaggtaatcccaaagtgtttttagcataatgggaagtctagaaacaatgaaacataaatacagaagtgattgcaaacatcacctcacaacgcattaatgttcactaactcaaacatatctaacagggaatggaaaagagaaggtagtagttgagcacacctccaacaaaggatgttgaacttcccttgctataccagcaagcatacgtgacagcagttcctgctgtcttgtaccagaaaatatgcgcaacccaagtatacatctccggcttcttacttttctacatgcagcccatcgattatatgaatcagacctgaagaactctccgtagtaataggatagaacttctcccattgtcttacattgcaaaaattttgtcacctgaacaagatttttgccaaaaatatatagaccaagaagaaaagtttgtgcttcttcatcagtccaggaataatgtgtcattcctggcagaggaatataatcactggctttcccattttgtaagcagttaatatcttgttcagcagattttagaagtttctcatcatgctcatcacattcaactttacagcctggaacatttctaggaatatcttctgtgacgtggctattacattcatcttgtgaagaacatgaactgcgtcctgagaatcctgtctgctctttttttacatgatcgcttgttttttgggtccatgtgactggaatagctagtcccacaccaacaggataatcaaaaccgaaaattccactgtcatcaactggacatgaccttagtttcatgcgttcctcttctgttgctagatttggaatttccacctggtactcatcccccacacgtgggtacactcgtgtatcttcattaacctcttcaggacatatgggctctagaaaccgtggctgctcaacaagcatctctattgaatgctcttcaccatccttgatttcaataggatccatctaaaaaaagaatacaccagattgtgatccagaatggttgaacatatagctgagcaatacagtatgattatacaaatgagcatgtctacctggtactcttcatcattttttacttcaagatcatccatctgtaaaaaaaaaaaaacagtgaagtataaggagtgtattagccaactgttgagtggtcagtcgaaacccatgcatataacctgaacagcaatgtaaacccaggacaagtctgcaaacaacttggtatgaagattaaagggaaaactcatacctcaagcatcagtgagaaagcaaattttgtcattaacaaaaccaaattccagtccgatggacaactaaagctctaacatgtccaaatgtactgatttgtagagcacttaaagtataatgagtttgttgtattgaattatgccaaattccgtccttgaaagacatggtttttgtctttacaaacttgatctgacaattgaaatgcaagataaaaggcaagtacatttattagattttggcataatagataattaaaagttttatatatatatgacgggacggcaatataagagaactgcaattttaagattcaagaagcaacatagttagggccgatttaaatgcagcgtggttctttacagctcataagaacatgcaagttcaatattaggctactggtattaattattgaaaaaacaatggagaattccatgacctacaattgctagttctcaattatctcggagctagtagtctagaactcatgaacaaatgcacgccgcccatatctagacaattcaaaaaaggaaaacttttattgaggatcctcaggtgttcgcgcgggaacattggatggtacatttgatcaaaagatattcaaatacgctactagatccaaaacactaactaccttaatcattacattcctatcagcataacgaattacggcgcggaaagcaccaggagtgttcaagcactgaacccccaacccgttacaacaaaacgttcaaacctcccttgccacagagccccgatcttcgactacgcggggcaattacaacctcgaacgcatctcaaactattcccaaaacagttcatcaccacccactgcgcacatccacgccgccgctcgcgaaccacgaccgcatcgacatcgcatcccccacgcaatgcaatggaaaataatttacatccgcaacgaaggctctctgatccagatcggagggggaggctcacctcgcagtgcagcggggttagcacggccggggaccgaccgggatctggcgccgccgccgccgacgacgacgaccgctaccccgaccgtacgagggacacctgggatgggaagacgatgcgccgacctggaccctggagctcgataacgacgagcggaaaaaggaaacccaaaaaaaaaaaaaaagcggcgcggcttcgaaccagaccacgacacggccgcgcgtcgagcaggcaggcggcggcggcgcgacagcagagagagagagacggcggggtagtataccgcggatacgcggtggtggtgaccgggacgagttgatgacggcggcggcgtcgcccagttggcgagggcggcgtccccgttggaggcgaggcgagaggggggggggggggggaataagcgagagggagaaagggctaggaccccatcattcagtggcgagcgacgggggttaattttaagctgctgcttctatagtgctggtctagagtttgcttgtggactaaaaaccgcaaaagctagtacaaccctaaacatctcccccatgaggataattgctcagaatggcagtatggcacatatagtaaaaaaaaatttattagttaaggaggatgtgggagtttaatggaacatgaaaatatgggaaactatgccgaatcgatgtgtggctcgtgagatactttgtccagattatgatttcgtatatagaattaagtaagctcatatggtgactactttgtgacgtagatcggtttggatgaaataattaagttggctgctagattgaagatagtagtatagttacgactataactctacgaaacaatatgatgtgacaataaatatatgataggataatttacaatcaaaagacgtgcactgtagcactatattactaccttgcattaagaaccggtgacacgtataatttagaagtgaatgaacatatctgtggaattttatctatcattaagttgtaatttgtgaaataaatataaacatcgaacgcttttctcttcaaaacactaaaataatggaggtgcacatgataattttttttgtgaagaataattattagcaagtggttagttgaatgcctatggtctaccatgaacagtgatagtagattagcaaatgattgtatcattatctccacgattacaacaattgaaagattgggtgtgcaatttaaattgttgtgatagccaagggcccaaggcataacatatttcatagtaaaatagttaggttaaatctaaccagcaaactgaagaggaggttttgatgcttaaagttacaatgtcactcaccccgtcctattttaagtgcagttctaattttctgtgtctaacttgtgaccgttcgtcttatttgaatttttttatgattaatattttttattattattggatgataaaatatggataatacctcatgtgcgatttttttttaatttttttcataatttttttaaatatgacggatggttaaatgttggataccgaaacccacgataacacttcaatgggacagagggagtatcttggaatggcaagtccaaagtagagggacaaagttcattcaaaagttaattttaagtgtttatctgcatgatcatctgtacaactgccttgagaaagtttaagcatcaacctcacatttatcatatagtatttatttatcatacaatattatcttatagtaatgcaataatagaaactaattctcatgttgaaaattggaactcattccatagcccaagactaatttctaaagtgagtttggattggtctactccacccgtaatcatgagtatgcttcccaatctgttaaatgttgtttatataattgtttattcaaaagaatcaaaatgaacctgctttttcaagtctataatattaatacttaattaatcatacgctaaatgcctccccatattttacgtgctgtgcaaaatcccaacaaacatattcaaacacaccccaaatggacccaatacctgtcagttatgaggtatctaggctcatcggtgtaaaataattaagggcacgatttgatcctgggcaaaccccatcctagtctcttctagcaaagctacgtatttggaaccggtataataatctggcttttggcggcgagctagcttgacggaatgagaaaaatctagcttgctgatcggctctcttttgacgacaaactccattcgtgtggaaaatattggaacgaggggcaaaacaaatccccgaaattagcgattaatctctgtcacagaaagcaaaattcaattgggaaaaactcagcaacaagaggcaaactcacctgcaacaactagccattaatctctgtcacagaaagcaaacaatccaaacagagaatgcatgacaaggctagcaagcgggcaaaaaagagatggtttagcgttgccaagctagactagctgggcgagcgaaccaaacgctccctaacatgcttactgtatctgtgcccatcattgatatttagacatcgttgtgatttatcttactatttactactccctccattttaggttacaagatgtttgactgctttaagtttaactaagtttatagacaaatatagtaatatttacgataccaaattagttttatttaattaataattatatacttttataataaagtatcttgtgtcaaaaatattactgttttttataaattttgtcaaacttaaagtattttgattttaaccaaagtcaaaacatcttataacctgaaacggagggagtataaaatattaaatacatttaatttaatacaataattatcgtatgagccatcctaatcatacattttttgtttggttcgatgtgcaccctaatcataaatggagctgcaggtggtgccaaaagagggactgccaaatggtttactccttccgttcaaaaaaagacaaaccctgatttccgtgtccaacgtttgaccgtccgtcttatttgaaaaaattatgaaaaaaattaaaagataagtcacgcataaagtattaatcatgttttatcatctaacaacaatgaaaatactaattataaaaaaattccgtataagacggacatttaatcgttggcacaaaaacctatggtttgtcttttttttttggaaggagggagtagaacacgagggagggtgccgtcatgcaatgcgtggaagccaccgaagtacgactagtgtggttcagtcatgttctgactcccgacggttttatcgagtactagtacagaaggaagcaaaccaagcgagttgatgaaaactcaaaacagaggacgcaaaccacagaatgtttccgtcgctgtctttgctggctgctgccacggcttccattcctcccgtcccttcctcccactgacacgcgggccccacgtcccccaccccacgacgtctcactgacatcctgtgccccacccccaccagcgcctcggcgcgtccgcctccgcccgccgccgccgcgggggccatcctccgtggaccgcgcccacggcgtgtcccctgcgtgcgtggcgcacccgcacgttttgtcacattccgcggcggcggcgtgcgtgcgggcgcactggaccgagcccacgggctcgccaccgacgacctttctcgcccccgcccgcgcgccgaccttccgtacggcgtagcggagatacaaccgaggctttcggcgccgaatctcccgtccaccacctgcccccgtcccgatcccccgccgtccatccacctcaccgacggccggatgcgcccccgcgtggcgagatcgcggtcgcgggggcaaaaacccaaccccccaacccaaccccaccgcgacgcgagcggtcggtcaccaccgtcgcgcacctgtttgaatcccactcgtgggccccacccgcgcgcagtaaattccctccccccacccccccgagagcaaaaaaatcccccgaccgcctgagcctccgcgcccactgacaggtgggtcccacgtaatgccccgggccctcgtgtcagcgacagcggagggaggcgggtcggtttgcggtgggggatgcgagggacgtggcgcccgaggaattagaccatttaactcgtcgccaccaccaccagtaaactgcgagtcctcctcctcttctcgtcgccgtgctactctcgctttctctctctctctctctcacttgttccccaaggcgagaagcagccgccgccggcgagcgtcgcgggggaggggagggaagggagggaggagcggtggatccgggcttgattggattgggtcggattcgattttggatcaaccccggagggcgggaggtaaaaacgctactactcatttattgctttcctttcctttctccggtcgatccggccgaaatcggcgattgctcgccgcggaatcccgattgggtgtggggggatgggctgatctccttccgagaaccgggagctcggatgcgtcgagttggttttgtgctccttttgctttccctttttctggattcgggtttccatattggaaggtttcttgatctcgatttcgtggcgagagctggttgctgaatcttatatagctttccttcttcttcttctagcggttgctacagatgcgttgagctttggttaatctatccggcgagagataatgggcgagcttgctgatctcgttgtcgtgccgtcgcagccgccgctcgccggcggccggcgggacaggctggcggcgctgctggagctcgcggcggcggatgatgttgatgggctcaggggggcgctcgcggagggaggcgaggaggcggcggagttggctgatggggtcgggctgtggtatggtcggagcaaggcgtacgaggcgcgcacgccgctgatggtggcggcgacgtacggcagcgccggggtggtctcgctgctggtgggcctcggcggttgcgtcgacgtcaaccgtcgccctggagccgacggcgccaccgcgctccactgcgccgcctccggtggctcgcgcaacgccgtcgctgttgtcaagctgcttttggccgctggcgccgatccggccacccccgattccgccggccgcttccccgccgacgtcatcctagctcctccggcttcgccagatgcccttggcgatctcgaggtgctcctcggccgccgccgagcactcgccgtggcgacctcggtggcttcaggttcgtcatcccctccgctctcgtcctcaccagatgagggcaacaggtcgccctcgtcgcgttcgtcgtcgctgtctcccatcactgtggatcgtgggaagaaggagtatccggtggatccaactctgccggacatcaagagcagcgtgtatgcttcggatgagttccgcatgtttgcgttcaaggtccggccctgctcccgtgcctactcacacgactggactgagtgcccgtttgtgcaccccggcgagaacgcccgccgccgtgatccccgcaagcacccatacactgctgtgccttgccccaactttcgccggcctggtggctgccctagcggcgatagctgtgagttctcgcatggcgtgtttgagagctggctacacccatcacagtatcgcacaaggctctgcaaggagggagcagcttgcgcccgtcgcatttgcttctttgcccatgatgaggatgagctccgccatgtgcctcacaacagtggtgccggcctgctgtctccccgcgcttcttcatccattgatatgactgctgcagctgcgctcgggcttcttccaggttctcctaccagacactttgcaccgccgcctgtgtcaccatctgctgggagcaatggaggagctgctgctgcgcattggctccaaggcagtaggctgcgttcttctttcaatgcaagggatgctgctgttgatgaccttggcatgctcctcgaatgggaatcacaataccttggggcactctgcctgccacccagcagccgcccccaaccacgcctttcagctggtctgagtatcaggccaacaattgctccatccaatcttgaagacatgtatgcttcagacatggcaatgtctccgaggttccctaatgaccaaggtcactcagtctactcaccagcccacaaatcagccctcctcaacaagcttcatcaacagaagggcctcttatcacctgttaacaccaacagaatgtactccccaagggctcttgatccgtcatctttggcacattctccatttggtggcatgtctccccggtccccccgtaccatggaacctacatcacccctaagtgctcgtgtaggagcccctgccacacagcggccttctgttggttcaccacggaattccagtgcttggggcaccgtggggtccccgatgggtaaggttgactggggtgtcgatagcgaggagctagtccgcttgagacgccctgcacaaccagggtttggagaagatgagacagatgtatcatgggtgcagtcactggtaagcaatgctgagcttaatggcaagaggggcgaagtacaaggcatgcctggtacttctgcattgatgaacaggcctgacctgaacaatcagggtgacttgttggaccagacggtgatcggtgcttggcttgagcagatgcacctggatcagaagtgatttccaagggaagccatgaagtcccaaagtggatgaagcctttattttgccaaggttatttaccaaagaatagttgttggtcctagtaaataataatttattctttttaattcttgaaatttttggtgggcaaagtcagagatggtggtcaagttcaacaaaacatttggtcacagattggtagctgaaatcagttccagagattggtaaacaacctcattacttggggtcctaactagtattcttttgattagctcagatgagtctttattttagtgggttaaaattcatatgttccccatggttattatgtccatgatctcttcctaacaaaagagagattataattgtccatttttcatttatcaatgaatgattttgttaaaacaatgtaagttacattcttaattttttctctgttcaatggaattaccttccttggttagtcctctattggattgtgttttgatgcgctttctgactgttcctatcaatgtttgagacatgggaatgggccactgccataaaattgtgtgcataaccatagttggaaatttgacctggctaggcaaaggcagacactaatggacataaaaagcgatataataactgctcatggtactgtatctaactgctcccaaaaatattcattatgtggaacaatggaaggttcgttctccatgattgttatccatgaaaccagtattatatttatttatttactaaaaaaatgcccgtgcgttgcaatgggtgaggactattttaatcttattattgttgtattatttagctaaagtgaaattctgggaattcgcttggatatttttcttacaaaattataagatacaattaggagtccgatcatctcatgttagcccgcgaatttgtttaaagagatttttttatgcaactccttttgtatttcaagtgtacgaacttaaaaaccgactcaaatacattccaaaagcgaatgacttaaaccgactcaaacacgatgacgcaccaaagtactgtatttccaaaagcgaattgacttaaaaaaccaactcaaacacgatgacgcactaaagtacgggtaaaaaacaacttcaatttttataatagtagatatttttataatagtagggatagagattactgcgtgttctgcaaatatggtcggctgttttctctatgatctactcggagtaagcctgatgtgtggttaatgccctcggattattcctcaaatcagatttattttctccattcatgcgacttaaattgttctccacgaaactcacgctaagggcaatagtttgtgttaagagacctcaattcatgtttgaactctgtaatctgaagttctgtaagtttacaatcgactgcagtttttccctttttggccaaaattgaatagtaatgaactgcgttgatcggtcttgtgtgaaatgagatgcattcattttcgcatcaaaccaggcagacagaaaaacatttacagaacctcatttgtactaggggaacacatccttgcacacaaatttcccctgtacactccgtgcagatcaactagcaagtatgtttccttgtactagatgcaaaatctgaaacgttaaattaccacatctcatgccaacagaataagtggtttgatagtgtcgatctagcttaagcgacacagaacctgtcatgctcatattcacattccactaacaagctggaaatcccatgaaaaatacaaagctggaaacccctaaataaataagctggaaagataatctaaataaacattactgtagcacatcgacacaaatgtatttgctgtgcccttgccaaacacacttaagaaactgatgaagtcaagctcatgtttcatttctgggggtgccagcctcttccgttgtggttgaatttggcccttcgatcgctgctctgaccgcttctgattgttcaggaccgtttattatataatttgctggtccaaacataagtagcacagtttagtttgcattgaagctgaaggttttagtgcaaaataagatgcatatcatactaatgtatatggagtgctgacataacacaggacaaaagcaaataggatgttgcacgggctactaaagcttgcaatattaaggtgatgaacttaatgtctatagtttaaaatggtaaaggactgagtgcagatgattgagaccttgaatgagacaaacacaagacataagagataagctatgaaatcgtgacgctgatgacaagtccacagaaatgctcaaaactaagctaaataaattgaggtcccaattcatctcgctattttatcatctgctcccagttgttaccacagttcctagttttttgttgaagcagaggtttgtcagtctagagaatcgatttcaaattctgtacctgttgaagcacccctggcggccatgtgctctatgaaatggatctcatcttcatggctgctcacgaacttgttctggtttgattagtggcaatatgatttgcatcagaaatacattcacgaaaaaatgcctaaagaaatgcatactagaagcagatacttactagttccttcgatagaatatttaggattctatcgatttttgcttgatgtttcaggaaaaacggccgcatataccttctatatacatgctttgctccctaagtaaacaataacaccattatcagcatgtacagaaaatcaaattttctagttcaccattcatcgatgcagatgtatcaagtgccaaacataggtcacaccagtcaacaaccttacaaccatccagaggaacaatagaacaaatctagccacaaacatagaaataatgtttagctagaccaaaagaataaaatgtttcctaagcgattgacagaagacaatgccaattgaacaatgatatcaagaaactataatcacaggttttcatctagatgatcacagcaagtgcttgaaatggaaaaaaaattgggcaaagcgatgcacagggaacatatgcaatgaacatactgattgagctatcatatagccaagcctcaaaatgctccgggatggattgtcctaccagatatatgaaccttgtcaatcacacgtgtcatgtctagataccactgaccaaataaccatctgacctgaccctgttagagactatattctccccttgattttgccattttgggttcatgttcatataaaacgtttgtcatgtggttttcagataatgaataccataataatattcttcagttcaggtcttatttcttgatagcaagaacatagtaatgctttctctttggtcaattatgtagaaatatgaaaatatgaggaaacattttaagatcagagagaaaggggaagggggggaggggggcttacactgtttgaaggaaactggagccagacaagaatagcaaacttcacgtgataatagaaaggaacactgcagaatatcaccagagtataaatgttcgaaaagtttacaaggacatcaaactttacaagattagaaacatcaagttaataaaggcaatgtaaatttaaacccatgcccggcgaaactttcaaccaaatattcctagtaatgcaatttctttcagttaatgctacattccgcacatatactgtccccatgcactgtcaactattcgtagggtcctctttcacacatcctctccactggaatgttttgatttattccatggtttatataaacataaccagaaaggcagttagaagctgatcaataaagatcagcaactcgccaggttatacaggaaaattccctggtagattaaatgttgtgtcttaatgcaccatgttcgcttttcttaacttgaacatggacaagctgattgaccacgaccaccaagtagtgagaatggtgatgaacagcaaggattacttctttggtttcggaagtactcggcattgtcttggccgatttatatagtttttggtcagaaaaaagaaatgatctactagagttcaatagctgtaggcagcagtatattgtgtgctaggaataacatctccagaatgctacgagtagcactaaattcccataccttgaaagaatctgatcagcaaagatttccgcaatgctaaaagatccatatgctgcaaaacattttgaacaagagcatctaaaggtcaaagcagtaagtttgatatacatctgtatcttttctatttcttagagatgttcatttagatgaaagctgattacacaaataattaaccaactgcctttgtaactataaaccataagatcatacaggtatgtcctccaaggatgcaagtggccagccgctaacccacaatattaaatggccttttggatgggatagtaggctggcccacttgcatccctaaactcctcagcaaagtaaccatgttaaggtgataggactagtaaatgtgcagagtattagctttgacacttcaaataactttctgagcatgcagacaccatataaataactttcgaaaaatgcaacaacctccgtcatcatttttcttttactttagcagtaatattatagcaattggtcacatagagtacctatcaatatactgaaaaggtgcttcaaagttaatagtgaaaatttcataggattttgttttattacagacctgcccaatacaagagccaccgctctttttctttttgatccttcttttcaatagctctgaaagtggagtacacaggcagaccaaccccaattgcacaactgcaaaagcatgaagtgagcataataaattatggacgaatttcttttccacaacagtaatagtagttcattattttgaggaaagtattgacagacaaaaaatatagtttttaggtttattgcagttgcagccattatacggataggtgactctaaatcaccactgtgtcgcctaatagccaatatgaatattgcagtttagattctgcttatctcacatcaatgatgtttatagatgtgagcataaacttgcggtaacgctttccccataggtaaaaatctacgtcattgcaatgtgctaatagcctaatatacgtaaccgttgacaacacaacaatgacagaagtgaatagctatacaatgaactaattgacatactcttatgatggtcctaaagagaataaactttcgatgtattattagaaaaaaaatcaatcaacataatggacaagcaacgcagataagagtaaaaatgcaatgaatacctggctgtacggatgacaacagtagagcttagtggtgccagtaagagccgtaaacccacctgtcataacaaatgcaatttcaatacaaagtttcaataaatctctgtaagacaagtatgggggtcatggaacttccaggaatccatcagaaaacacattatgagataatatgcgtaatataaatgtaatctctacctcatacaaacagattgattagccgaactgccccaaataaaaaagaaagaaatttgaagtgccatatttagaggcgttgcaaagtgcaaaaaattacaaaaggccataaaaaatgggctatcaggaaaacgttaatgtactgataaaaagggtatctatctgtttctgttggcagactggatatatagatttgatcaagagtgatgctcattgcaaaacgaaaataagttaactcaaagttaatttttccctaaaagcaagcccaaataaatttgaacgcgctgaaaaacgataaggttgagtcgtgtctgccaaattcccgtgagatgaatcctcacgtcaacgggtggtttggtggatgaactagaaagcgttcagcacaaatcggaacccacgagaaattacaactcaatcagctccacccccaataccatcccaaggcaatgggagcaaaatcgcatggctccggaacacaaaatccaccgaacgaagaaacccccatgctaacccacaatctaccgtgctcttcccgtacaatgaagaagaaagcgtaatccgaggcgcgccctcccccaatccaccccgatcgtccccccgatcctcaaaccgaacgcgccgccgacagcaacgtctcaagcgatctagggtttccgtacgagccagccaaagggatcgtacctcgccggagatggcgggggccagaagcgccatcggcgagttccgcacgccgcgcgggggtggaggaggaggagcaagggatcccgccgcggaggcggaggcgcggctgcggtttgcggcgtggagggcaaggaatccgcggcgagttcgcgtctccgcgggtaggtctcccctgagtccaattggtggggggatggtggtggtggtggtggtggaggaggaggcgccggcgaaagcggggggagaaaccagaaagcggttagatggaatcgggtgctttgggggcccttttccggtttagtcccaatcttactctagatttttaatttagagtccatgtcttctttcgatttcagaaatatattaaatttcttcagataattcaggattctagaaatttcgattatcaataaaaattcaatcaagaaaaagtaactttttcttacttaaaaatatattctacttcctctgtcccaaaatgtagctatttctagcacagtaccttgtcttgaaatgaagctatttttccacctacctcctcctctcaaccaattacaaatattctccttcacctaccttttcttttcatccaattacacaacttctccaatcattctcacatactttcttaatacccgtgccaacataaaaaatgctatattttgggacggaggaagtaagtaatttatgtatagaaagattatgtaaaaattgtaccgcttataaaaacaaaaaatgtgttcgtgccataaggagaaaagaaccgggccctaaagaatggcaaattatcaatcgagttttagataagggggcatttaactatttgctactcttaagatgttatgataacagatttgccactcgctgtctgtaacatgtgggttctcatgtgtctatgatatatgggtccaatggcaaacctgttatcatcgcttgtaagagtagcaatagttatttattccttagataagtggcacatcctaattaaagtgctcgtttgaagggtggtaatagggcataaagagttatattaaattatcccacattcctacttatcaaaccgtagcggcccgtttggttggattgagtttttaggagggattgggagtttagagggataaagctattaactgttttgtttggttgtgagacatggaaatttcggtgggatggggatgagaaattgaggaaggaactacctcattttcaatacatgggtagtggtggtaattgggagggaattcctcctttactctgcctagaaaggaactccctccttttcaatacctggcagggggtggtaattaggagggaattcctcctttactctgcttaaacaaatctcaaccatccgttttcattaatgacctaatcttcaactaaactctatatcaatttccaccacctctaccaaacaacatattgggattaaaaaccaaattcccatcttaatctcaccatcaattaccttgtgtaaattcccaatccccttctctgaagttgccaaacaagccgcagatgagccctccattttcttctcagtttaacagcaaattgatatggcgattgatacagtgaaatcaatctcagtgagtcgtgaaacagacaaacagtttaatggtggagaaaagagtctcgagtctgctgaagacaaacttcatctttgcttgagacggtcagcttgcaatttggctgtcacaggcaaatgcagcttttagtaagcgtgattccagccttcaaatttgaaacgaacgggtaaacatgattttcaccagtagtttttgggaacaggttcaaagcagagggaatgcagatctacacatttcgagaaacagaacgacagaaaactaaaatacaggaagaattcaacatatccgagatatctaatcttattgctgttcaaattttgttgcaacagcaaaaggtgatgtttatagcaattacaggaggcttagaaaatataaataaattaaatacagtctatataactgtaagcagctatgacaaaataaactactaccctacttgctcttcttcccttcagtcttctgatactgatatggtgggcagttggctacctgaacagattcagatcagaatggataaatgccgtgtgagatatgaaagggacattcgggtacatcccagcaagagcgcatcgcatgcactcgagcactgtgaagatctgtatgaaagcaatagccatccagaaatactgcataggcgtcccctgatacacgatgctgggcatccaggtgcacattgttgccactgcttgggagccagtgtccaggaggatagccaagatgacatggaaccttagaaagtgcggcgaccacttccgtctcacgacaaagaagtacactgtcataaaaatcaccagcaaaagccatcctggaaacagtgtcattgtatcgatgaaggtgtacaccaacgaaaacccctgcaagtatgtgtgtagctggtagatgacatcggcatatgaccacatgttgtggagtggaagcaagtagggcacacatgctacagtcctccaccaccatctgggtttcgaagtcaactcagggtagctgaatgacgctaaagaggatgctcgacagccaacttcaagtcttcgatgctgactgtgtcgtgctgccagtgatggaatgcccttgatagaatcatcccttccgaacgatgcaagcatgtcattctgaacaaaaccagtgccaactgcaagatatatcagatatatcagatatgcgtcagaattcaaagctctgaattacaaacttactgagaatcaaagacaagtacaacctacacaaaaactgtctcactgccgatatatgttctggctaacatctaactagatagcagcagcaatacaagctttcttcaatgtatcatgagttcacgatgatatttatttgacccaattttttttcgataagctgtagacccatttcaactaccacctttattaaaacctaataaaatcaacattttacacaatgtggtgcgtatttacttcatatattggcttgtacttgtactgtctacaatatacagttcatattggtccttaaaatgtgaccagtgaatccgaaaaccagaagttccagaagggtatacaagtgcacaatatcagactatcaactggaaaatagcaacgcaatatattaaatataatcaaatataattgacccgaatccacaagatgttgtcagaaatcacaaataggataatatggcatgaatatgccaacatggcaacaactacaaaagaaatggtagttcagtgctaccagccctctggacaaacgcattgtgtttactcgtaagtgctgaagagaaaggaaagaatgtagggcaaagagtgagcatgtcatcaaaattccctagtgcttcatattttaaaagaagttagcaaaaactatgtgccttatattatgaaattgaaaaggtaaactactacttataatcagtcataagtcatcataagtactatgtgctgcgtgtacacttcgagcagcagaaaagaactgcttacggtgttagaatttgacagaagccccccagaacataaacaaaggttacagccactcacttaatgtacaaacagaattacaaaatttgtgaagctcatgataatatggttgttataattcatcgcaacatgcaagtgagagaaattaaggaaagcattatgggtaataaagggcatataaatgatacatcacaacaaatttaaatgagagaagcaacttcgtctaatccatacctcgcaaagctcccatggaaaaactcttcctttccgcatgaagtcgcgcacgttttacactccatgatcccgccggagtacccaagcacgatgttctcgcgaaagagacattatgcttagccgcaggaaaagcaagcagctgagcgtgtccagcagataagccttgacagagaaccattctgcataaatacagcccttgccgaatcaccgaattacctggacagacatgtgagcgaatcggatcactggatcgcagagagcgaaacatttgggttagatttgcgcccagagaataaaaaaacaagaacaacatcaaaacaatccaatcaagttggaatccatcacccaaccactaaaaccaatccaagtccggatggatccccacactaagcctgatcagtatcgaggaggattgcgagagaaggataccttcacaccgagccgaggtggcgcttcggcgagaggagacccgacccgcccacccgcgtgttcgccggagagaggaatcgatgggcgcttccgccgagacggggaggcaaagaggcgattgcagatagggttctcttttccccgatttgcagatcagcccctacagttgcgggaattcgcatagagaggatattcttttttttttctctcgtgtaacctgtcaaaagcaaaccaagggtccaattctagaatcgcaaaacctgtagctttaacatgcttcaaccaaaatctgatagtagaacatgctccatctacagaataacacggtaaaacacgaggctaaaaaacagcaaaatggaaaacgcagtaattagggacatgatttctctaatctcttattcactgacattctcttatccctaagcctcttggctaactcagcttgcctactttgaggctaggcatacacactagataaaggaaaaaacaatgagattagtctgttttagagagttttagattataagaaacaactagtgaaaatttagccggtgagaatatggttttttttagcctctggcttctaatttatttctttgattcgacaattacaacttcttaaaatctggattaaaaaactgaattatttaagagaattttgaattcaaggagaagctacatctgcccaaaaactctcacaaacatgccattaacatcatgaaaaatctactccaaaatcctctatacaatttccatttgatatcagaaatctattaacttattaaaagaatagaaaaaggagcctccacgttcactctcacggcttagaaattctcatattaatcgaagaaaaagaaaaacagagtccatatagaaatacaatttagaaatagttcaaattcgaaattaaaaaaataagaatattggaagaggagactagagtccatatagaaatataaattataaataaccaaaattctgaattaaaaaaataatattataagaagagtatagagtccatatagaaatacaattaagaaataacaaaaattcagaattaaaaataaggaatattagaagtagattatagagtccatatagaaatacaattaagaaataacataaatccagaattaaaaataaaaaatattagaagtagagtatagagtccatataggaatttaaaactaactaaaactcggaataaacataataaaattaaaagaatagtttacaaataactaaaaattgatattaaaataattaataactaatactatataaaatacaatatgaatattatacattagtagtttcgtaaagttagtataaaatttaaaattatattgtcattttaatatatttgaataatacattgagaaaacatatatgctattatatgagagaaaatataatgatgctagccgcgcaatctacgcgggccaccatgctagtttcaaaatagaaaataatatgtaatcttatgcttcaaagtgctctatagaatattcttctctaataggttggaatcctataaaactcctatctttctcatacaaaccgaaacgggcataattttttacttgctccgatctaaaatgttgttgcaaattagcctccaaaaaacatgttatacatttcggtaagggaccacctatacatttatcgacaaattttctactaaaaatttgacagatgtaattatagtacaatcgtagtgtaattacactgtaaattgtatgtaattacactgtaactacagtgtaacttgtatgtaagtttcatgtaattttgaatcgttagatctattacaagatttgttctggtgaggaagaaaaaaatcatagcacacacatatgtgaaaggatttgttcccacgacctctattttactgaaataacatgttaccgagagattcttgaaagttacatataatttacattatagttacagtgtaattatatacaagttacagtgtaattacactacgattgtactgtaattacatctgacaaatattagggggagaaatttgatgacaaatatctagcaaaatcgtttcggtaaattcggcttcttcttttccacctttgatgatctcccagttaattgggtctcttttatggacctggaaaaagtacttgtctacttgtacgctataaaaagattggacctctacagccccacccaaacgggcccctgacgggctccatttagacatggcatgggcctgaaagactccagaacaactcaggtgccccttggggaccaacagtcacgatcaactgtagatttaagagcttgtagctccatctctgagctagagtttaattagacggttttagatttatctcaaaataaagtggagctaattaaagtgttctcacaaaacaaactaaataggtaaagctgagtttaggctgctcaataatttcactctagacctaactcttaaaagttaaatttaaaggttggaaccctactattgatggtgagagagagtatctctctgtttgcatgccttctttctataaagtcatataagtttttaacacgatctccaaagaaaaaattggcaattattttttataataatttagaataactataaaactagcatcatatgtaaatatttaaatatgaatatttatatcacatgcatgactctgcatatgtctttttatgatatttattagtcaaatttacaaatgtcgaccttttttttaattacgtacatgccttatatttatttttatatgtgggagagtagtacttattacaacggtaaataattgaactcactaaagttttattaaaagtgtaagaccgacacacaattatatacaccacgggtaagacttgtctaacgcacgttagaaggatatggtgcactgacatgtgagcccataatggtgggtcctacctgttagggacccacatcgctcttattttacataaaatgagctacatcctatacaccataatcatgcccaaaatatatccacgccacacgggtatatcctagtatgtgtgtgaacaagattggttggctagcatcgtgtggttcatgtgtaactgttgacatcaaaatttaaaacctgacatcctgttgttatcgggtggagttatccatctacaactccaccaccatacatcatctttttcggttttcattgtaatagtatgtttatcaggttttatttgtttcgcagtaatggttaaattgtatttcaaataccatgtattatattccaaataaggcgtttttaatccggtgaccgggggcggtgggagacagccatttgtggtagggtgtcatcgattcggcggtgttagctaatcgagagcgtagtcatcctcatgaaattggcttgcaaggtgagccatcactagatcttacaggaaacaggggtactgccagctttgaattggctgatgacacgctcctgcaatgcattgctggccttgtccttgtgtattaatcactagagccacatctccagattttttttaggagaaaagtgtcactgggccaaccttgcattcagacgtagtaccagccagtcattaaacgtaaatcatggccaaaaaccaaatgatttgctggaatacggcgtcttgatgaagagagactgcaacttcttatccaggcgacgcgataggaaaaacggatccgcctttatcggaggtctaaatgctgaggatgagaggacatgttcaatttctgaaccatccgattgaaatcctatggctgtgatcaagtgatacaaaaggaatgaaacactgcaaaattcgcagaggcagtacatccgaaaaagggtagccgaagtacccccaagatactgtttgtgttgcagtgaaccgatgcttgtcttctgggactatgcttcaaaaatcgtcaaccaaatatcgctccctagcagtttcgtcctcggaaactgacaaaaatgagtgaaattcagatagatttttatcaaaaaaataaatttagtttgattcttattttttaaaaaagaacttgggcgatttaccaagtggtttctggccacaaccagctcaaggcagctaataaccgcgataaccaagcggtaaccgtccattttccaaacctgtttgggacacaaaacgctgtagcgtctgcagctcgtgcggcgtttaacaccaaacaagttgagagaattcagggggcaaaaggtgggagtcaagccgggttagcttcaactgcaacagaggcttgtccgatgctacctgacctaatctgcatccgatgccggcaagacgaagaaactccggcctaggggtggtcgcagacacctgtgccaactaaacagaaagcaacgcgtaccggccagatccaaccaattctaggcacatttaagtgctgctttgctttgtttttgtttcgttttggccccagtgatgttgcaattagattcttgaccagttcagaaagtccaactttaggtgttcaaacatgtaatacagtcttaattaattgcccgtctaactagtgctgcagtgtacctgtcccatctttttttttatggcagcaaggccccagaccttattttctgtggagacaggaaacattagtttgggtatgtatgtattgctcggttgctcctcatcagatgggcaatagtacactccaacattagaattctttcatattttctgaatggtcacagggggagcacctccatctgaataatgttcattaaaaatcttcatgttaaactgtcatttacacacaacaaaaaagaattgtaggaaagtaatgttctacagatttcggataacaaaataagctatacacaccagagaaggaagagaagtagttagccaacagattttggaccatccattgcgtgtgttgtaagttcagtctctgactttcagtttcagagtataaaccaagcattcttaggaaaaaggagtaataaaacagaacaaggttaggaatgcacaaaaaccacctacttccttttcctttctcttgtacagtacatttcgccaaatgtttggccacccgtggggcatggatcaatataatctaaatacaaacaaacaaacaaaccttccaacaatcacctaatgcttcatacggggcaccaaaatgaaaaatagagcagtggaaatctcgagaaatgagaacggaagaaaatagtcgtcaacaaagaaccaggaaagctacacaaggttttcatctggggaattcacaacttgcctattccgtcatctatctattgggtagttgttaactgcaatgatccatctttctgaagttttaggctgaggctagtgaaccgttctcttgaatattgtcttgaggctttcctccaatctgttccggccttcatcattgccgcaaactcatcatagcttatcttgccatcctgaaagtacagaacaatgctattaatactttcagagtcatgtgtgctatgaatcattatgtcaaaacattttgtgcacaccaccaaattaattaaactatttgaagaagaaaaaactagcagtctatcaatttcttaaaactagtcaatgaagagccacaaaccttatcagtgtctacatcacggatgatggcattgataacctcttcatgatttgctcccaggtcatcagccaatgattcacggagctcatcgatttcaatatatccactctggttccgatcaaagtatgcaaatgccttgtgcagatgctcatcgttgccaatctttctcaggtgaacagatagagcaacaaactccccgtagtctaaagatccatttccatcgacatccgcctggcataaccatggataaatagtaaatatacgaaacccagtagtcattcacaacaatagtttgggaaaaatgcattcgagagcaaataatcttttctagttcaacaagatataaagatagtttcccatttttttcccaaaatttggaggggtgtttggggagagaggaagaagggtggcttagggtaactcacagcatccattagtatttggacatctgcatcagccatttggtgcccaagtttatgcaggccaagcttcagctcatcaaaattaatcatattatctttgttgagatccatcttctcaaacatgtcctttataccagcaacctcttctactgaaagatgctcagctatgacctgtagtaaaacaaaatgtgagaatccagagcaaacaagactactattgaaaagccatagttaggtttgagggtcaggtcaggctgaggagtataccctaagtgcatgcttcttgaacttgttcatcacagagaattgttgaagtctggccttaacagtttcgcctaaatttacatttggagccttcttaatgttctgtaaccaaggatgatctggaagaaatacaagataaggttgtcagccaaaaacaaccaagttaaatgatataagggataacatcttcagaaaatcattaagctttatcatttctttactcatccttttgcaaggtctgtgatatcttggattagaagttaacaagttatagatctttgtaactcagaaccaccacattttcaagcttgaaaatttttggtattgttaaagaacaaaagaaataccaatggttggaaagtttctgtatcagtcaagaacagaaggaaaaaaatacaatatattaaaccagtgtgcaaattgattattaccaagcacttgttgagcatttagccgccgcctagggtctggattgagcattcccttgacaagatcctttgcattatctgagacccttggccatgggtctctcttgaagtcaatgacagaacggataattgcctgagcaacaccctgttcagtttctgcattataacatggaaacaaaagaaggatcaggaatagcattcaacattacaacattgccaggtctacaacagacacagacaaaagtaaagattgacagtttctaatgtcgcagactgcattagtgcagaaatgtgatcagaagaggtcaacttctatacactaaatacgtagtatttaatttagtttatacatttggttatcagaattgaagaattcatgtacaaaactaacctgcccaaaatggagggactccacaaagaagaatgtaaaggatcactcctgcactccaaacatcaacctcagggccataatttctctttagcacctcaggagccatgtaataagggcttccgacaatctcagtgaaccgttcacctgcacataatcaataatcacttaattagcccatcggaaaaatatatacacgcacgtatacaatgtgaatagacaacctaaggtaagcccttctagaggcactgtgaagtcatcatttgacaactgagaactgactgacaaattaaaacagcacgcttgagatataggaaataaggacattgcgactgttagactgtacctggggtgaaaaaaacagacaggccaaaatcaattgccttcagagctgcagtttccttcttgtttgcaaacaagaaattctctggtttgaggtcccggtgcatcactccatgcttatggcacatctgatgttttacagacagacaaaaatacacgttattcatcacactatggaagaaaaaagaagttgcaacaatctagttaccaattcaaagaggcaggcatggataactaactaaaaccgaaactgatcagagtctaattaatcagacaaatagacaacagaatcatctggcatgtagcaaaagaaaacgattcccacattattggagaaacaaaagcagataaaaacatgaacttttcagttgttgtcatctagtaacaattctaccataaatctccaccagtgaactcgatttcttttcattatactgtgagactacctcatcgataacgacgacaagaaatcaaacaggatcatttcagaaaatacagtagaaagcaacgaaggaatagagaaatcaccgaagctaccaatctcacctgcacgacctcgacgatggtgcgggtgaccagcgcggcggcgcgctcggtgtagtggccccgggcgacgatccggtcgaagagctccccgccctcgcagagctccatgacgaggtggacggcattgtcgtcctcgtaggtgtcccggagcgtgacgatgttggggtgcttggggaggtggcgcatgatgtccacctcccggcgcacgtcctcgatgtccacggcggtgcggagcttcttcttggagatggacttgcacgcgtaggcgtcccccgtctcccgctccgtgcagaggtaggtgaccccgaactcgccgcgcccgagctccccgcccagctcgtaccgcgcggcgatgtcccgccccgtcggctcgcgcagcaccaccagcctgtgccccgacggcgccgacgaccggttgtactcgatcgagaacgggttcggcttcttccccttcttctgctgctgctgctgctgcttcggctccttctgcttctgcttctgctcctgctgctgtttcttcctcccgcggccgctgccctccggcgtcacgcagcagttgcccatctcgcttcagccaagatccgcgcgacgcaagaaccccccgcgaatcaaagatctgcggcgagtgggaggccaagaaatggcggcgtgacgcgttgggggagggaggagaaggaggcgagaggggggaggaggaggaggagggggttaaattgggaggtggggtggattcggtggggagacggggtcagccgtggcggcggctggggggcgtgtgggaatccgccagtggtaaagccaacgacgaggccgcggaggaggggaggaggaaggtaggagaagacgggggtgctggtcaaagatctccctctctcactcggctctctcggctctcctttttgcatcctttgccctcttctcttctccctagtttttttctttttctttactttttttttccttttcctctcatttttttaagggacatttaacttattgcaacttttaagctgtagcaattaattatttgtcactcgttttatatgacatgtgaaccgtcgtgtctctatgacatttgggtccagtgataaataatttaacaccacttgtaagtggcaaatatttaattaattctttttttaagctcttccttttcctctcgtgtttattttcccctctgttccccttgcttgtgctatggtgtgtgtaccaatggttttatgttaaagtagttgtttagggcattggtaatgtgtgtgttgattattgttttttattaataaagattattaaaatgtatgtaagaaaagcttttaagaaattattaatgacatttttgcgtaccaaagctttgggatgagtctatattataccttttataactgtcggatttatctaaaaacaccactcaactataaaaatggacactttatgtcactctactatgaaattagacaatttacacttacgccactcaagtattaagatatgagaaaataccctctaagagtaatacaattcggttttggaggtgattttttaaaaacattttgacatccaaataattttttttcttatttgtatcgcacccaattagtaagatatgtaaaaaaatcaatataaataaaaacatgtattttgtttttctcttatcatgaaaccaccatcaaaatcaagttgtattgtccttgggagaggtattttgccctttttattagttaggagtgtacaatatccggttgcatagtttttaaacaaacccgataactgagtgatgtaatataggcttatccctacattttaatatattttcatgcattaattggttaagattttgatgtttacctaaaaagtcttaaattgataactgtttaagaagggactatgttgattgtgttgcttctctcgttttcctctttatctcgtctgatgatcttgttttctggtttccccccatccccccccccccccccccacatctgatatttttgtttttttgtggtcctggtgtggcgttgtttatgaggaaaatgactttgaacaaagttttcatgaagtgattgaataggactaaaagataaggagagggttaggtgggtgattaaagtgacattaagcagcatttgtccaggtttgctgcctaatcataagggggcaacttgacgctttgatgggtacgggaaggtagtttaatcagattgtggaaaaatctagctgatggttaatgctaatcggtttagctattggtactaagatggtgtaatttcaacgataaatcaagaaaaagttggtcgtactcttgttgtaacaccaggatattctttttcacttcctgatagaattgtgaatttatttttcgaaatagaccctcgttgtaaattgtaaccacttgtgttctgacaactcctgttacagaaaacaaatctagcgtcacagttttactgatatggtggttagtcgtgaattatccgaatatacatttccttctgctttgcaacatcagtgtatcagtattcagtcaaggttttgaggggcgactaattctcgcctaatttgggattggttctttctttttggctactgcatgcctgctgtatcaactcctgcttgtcaaatacatctatatgtcaacttccaaaaagaaagcatccttgtgttcagctaaaatttcttctgaaacatttgcagattcaacagaaagtcaatcgaagccaattcaacacaaagtccatgggcaatgttacacacgagggaattgacagctgaaatgtgaaagtgcgtaattcctcagttgttcaaccgcctcctttttttttgcgcaactgcatgcgttgcgtacgttttcacaagctgaatttgttctttagcttgtcgagaagaacgtccactcaaaagttttagcttcaactgtggaactagtattagtatttgttctttaactgtagagtagttgctatcctgaacattttgtagagtttaaaaattttggtcaaatctttgtactacttccgccggttccacagtacttaatgtgtcagggttatggatatcacatacctaatagtagtcgactaaatctcggcaggacccaacacataccatgtcttatacggaaacaacctccggatataggaggagttccacataagaaaagatgaatagagtttctacatggaaacgataaggactactcggattgtatccatattggtctctctgttctatttggacaaggggacacctatgggtataaatacaagaccccctaggaggagagaggacacggaacaatagatcaagacacaagatcaacatacaagccaacatgcgccaagataagacgccggatatcgacttcagagataagcatagctagtcccctacgatgtctacgaatactgttaggagagacatcgcgttgtctctgatctcgccgggcacgaactcgatgaggaagactaccctattttcgactacgggatggtttcatggccgccatatcgacaacagttagataggctaccccaaatattgcactggtgtgattatggtgaataagagcaacgaccggcttcggccaacatgatgtagggctattacctgacaattcaagggtccgaacctgtataaaaatcctcatctctgtctcttttacctaagtctcgcatatatcctggtaccaacgatccccatactatgcaaataccggaatcgtgacattaaacgtcgacataatgttttggataaaattaagatcaaaattttataactttaaacttcacacatatttaactttaagacactataacatataaagtactataataaaagtaaaaatatataccatccctccataaaaaaattcaaacatagctataaatttgaacacacatgtgtttctttctatctagaattaggtttctttaaaacagagagagtatacctattatatatatatatatatatatatatatatatcataatagaaaaatatagttcaagatatattttaaagaccgtgttattgtttaaaacgttaagaattatatagctagagaggatatgtactgtacgacggaattctggtggtgttcttttctcctgaagatgaagataaagattaagttttttacgtaaaacaaggtggtattaatgtatgatttattgaggtttaattattacaaacttaaaaaacatattaatatgatattttagaggaactttcatatagaaagttttcgcacgaaacataccgtttagcagtttgaaaagcatgccatgaaaatcttaatcttcatccaactcttatcggagagaagaacttgggcatgtttagatcccttggtaaaattttatatcatgtcacatcgaatatttggacacatgtatggagtattaaatataaacgaaaaaaataactaattacacagattgcgtgtaaattatgagacgaatcttttgagcctaattgcgtcatgatttgacaatgtagtgctatagtaaacatttactaatgacagattaattaggctaaataaattcatctcgcggtttacatatggattctgtaatttgttttgttattagactacgttcaatattttaaatgtgtgtccgtatatctgatgtgacacgccaaaattttatacccgtggatctaaacaaagcataagtttgaacccattttcctatttgaagcagacgtggccactcgttcatctttttcatgttccacgcggtgggttctgtggctgttgcccgtgttccttaactgtcacaggctcacagctcacatcgtcatggtttttcatccactactcgtagagatccacttctcatgaattcatggccgggggtcgctgtctgcacgaaccgggcatttatgtttccgtgttgtctcgccttgcatccggtggatgctaaaagcgccccagccgaagagcgtgccaagagaacagcaagggaaagggacacggtcaggtgttcacaccctctgcggtggtgttatttatttatttatttattttgttaagatacatattttacctttattttgttagcaatttttttcaatcggtttaacagtatgtttttttccagataattttctatataaaaactgttttaaatatcaaacaaatctatttttcaagtttacaataattataactaatcatatgttaattgttttttcattttacgtgatcttactacaacatcattgtttcacctattcttatacttatttgtatcgcttattgtaaataaaaaataatctatagcatgttcttaacggtaaaaggcaaatgttataaaatactatttataagtgtgttaatcttcgtcttcatctgaccaagttcaaatgggacctgtgtctcgcggtttcgtggtactagttaagatcctacacggagcattcggtgcatatatagtgacttggtagtcatatcatgtgggtgagatttctccgtggaattacgtgatctaccacaggactttaagtgagtagttgtgtgtgtggggtatgagattgcgttgcaccgtccatgagctcaaggctgcaccataggtcaagagtttgaattctgttcctacctgaatgtgaaatagaaggataaaaagagcaggtttgtacattttctcaaagaaattgtcaggttttcgatcacttggaaaataccataaaattaatggctaggattactcgagattcgtggatacaataactttatcccctcatattcttccccgcaagctcgtccgctcgttctcatttcatttgacgccttacagattgaagcgcttgccgtcgtctcccctgcccgactgcaacgcccctccccggtctcaccgactaaccgaaaagcgtgaaagttattagtaaggcccaacg

SEQ ID NO: 12778 - DNA, 3051 bp, Oryza sativa
accctctatagctggctggctggctcggtcatcatccaaaatcgatttatggctctacttgactagataaacactatcctgattcccgagtctttgacgagcaatggctttacaacgagtccctagatcttgaagcgatcaatcaggacagaacccgaagaaatagctgagctaattcatgcagcatctttgataaagtttgagctccacttgatacgctcgcggttttagttcgcccgatcttttgttgagttgataataactaaaatttagaagaaatgttcaatcatacaagacgctgctatgttacgccttagtgattgatacatctctctgtgggttgttcatcttgtcggtgcaatatcaacattttttttgcaagtataaatcgaagaaacaagtacggacaaaataaaagcaatatgaattaaagctcacgataaggtggagttccgaagacgagtaaggctatgttcggaaccatgggttcccaacaagcacagtgtgcacgaaaaacagagcagtccattagcgcgtgattaattaagtaggagtattaggtattttttttcaaaaatggatcaatatgatttttaaagcaactttcctatagaattttttttttgcaaaaaacgcaccatttagcagtttgaaaagcgtgcacatggaaaatgaggcggaggagctaggaaccagcagttctgaagacaacctaattaggcggtctagccgacacgtgtaaatacaagggctaaactttaatctaaacaaaacctgaaaaactctgaaggggtacctatttattaatggaggtgggaggataaccaaggggtcactagggtcgtgctccactagattgggacgcaccccacatgagctcaacttgggtcgaggtctgaaacgaagttacaagcccgaaggtcattataggtgacgcaacacattgtttcttgaattgtggccgactgagatggagtttggagatgagcctggatctgttggaagagaacttccatagctttccatcaagtactcatggatataaaacggaggtcgtgcacatctggcatccgtttcaagtcaacgctgctgcaaatggccgaacttgtctccagaacttgtgcgacttgtctcctgattgagctataatgtaagtaatggttgtatcaatagcagctacggccacatcacatctctccgtctcctatattgtctctggaaaaaggatcagatgcagccgtttttcggagcatgaggacgattggatatataaactgtggttttctcaagctacaacactaaccgatctctgggagtagtataatttaataaaaatctcttaggctaacatggcctaattctctctgaagccatggatatttttattaatgccttctgccttttatttagaaaaccttccaatgcttttatgccttaaaagaggttgttatctttaccaagtaacttgatcatataaataaaaagttcaaatcttgggacataccgcaataaaagaaacagtgatgtcatctaccggacccatcgttttgcttattcgcggcatatttacaaacaaaaagtaatttgtgaataaaacttttatatacttgttttagcgatctaaaagtaaaaaccgaaaaataaactttgatgagaaaacctcaaaataagctccaaattaaaaattaaaaatttaaattttggctgataagtataagtataaataaaaatatgagtccaaataagttttcaaggaggggggattcttttgcgctgtactgtaaaatggtaccgtgttcgagctgtaatctttcgtttgagtgttttgagatagtgatactcaagatcatacttacatatgattagtacgagtgctgtggttatctcatctattaagcttcaaaataaccaaatttcaacctcaccaattgttcgtaagtgtcatggagcatttatcttttaataaagttgctccatatattttctcatattcacacttcgagtagtgctaatcctaagtaagggtgtgagatatatatgcttgtacgcgtttgtaccagcgctaaacaccaaccctacctcactgttactgttaaacccaatatgttcatccagtatgttatatggccattgtgaacttaagtgacaaaacacatctattatatttgcatggattatgtaagagaaaatacatctactatattttgtatgagttatggaagagaatatttattttgtatgagttatgtaaaaaagataagggtactaaatatagtaatacccgagattttaaatgttcccgcctttttatgcacttacatgcacgtgggttttacgaataaaatacaccactgcataccataatatccaaattttaggccttattttgaatgcaagcaactttccctatttccataaaaattggacatgttattacgaaatcattatgtttttaattaaagccatgtgcacgaacaataagtaaaaaaactgtatcaaaaacaccaagagttgcttgaaaagataactacattaacccctatacaaatatgaaaaattcatattctttttcttcaacaaatacctagaaaatcaagacacatttaataccctcaaaaatactaaagatgtcaacctgatcctaagagactaaaattcttggtaatttcttgcaaatcaataactcacaaaaaatatacgttttcgatcatattctaaaaaaaatagttatagagtctagaaaaataaacttgctgcttgtaatctagtaaaccctacaactaaaacaactggatccacacaaagaagcatacacaattcccctcagacacagaaagagagcagcccgggcccacgcgtcagcctccaccgcgcgccgatccccgtcgtccgtccccctatccgccacatccccagccatgtctctagtcgcaaatccttagactcacccggaaaggcagcgacccaaactctccacctcctcttccagccctccacaccccccacagtctcccccacctcctcccccaatttccctcctctcccccggcg

SEQ ID NO: 12779 - DNA, 17063 bp, Oryza sativa
  unsure (1)..(17063): unsure at all n locations
cgcgtgggcgcgtaaataggagggagggggggaagagagccatgggggagggttcggagaggcctcgctcctcccgcgccgcgcgtgcgcgaaaccctagctttgaggtggaggtggtggtggaggaggaggaggaggatgaggaggaagcggctgtggctgcggctaggcgtgtcaagagggaggtcgcggatgacctgaacggggagcccgcggaggaggaggatgacgacgaggaggaggtggtggtggaggaggacgaggaggtggttgtcgcctccgacgaggagggcggcgacggggaggcggacggcggcggcgaagtggctgtggccttcgagccgcgcacgctggaggaggccctcgttccgcgcgtgggtgcggtgttcgactctgtggacgaggccttctcgctctacaagacctacgcctaccgcacaggcttccacgcggtgcgccggacctgccacaactacgaggggctccgctaccgctctacctttacctgcactcatggtggcaaggcccgggctgacgccagcccgtctgatggctcaggcgcccgctacccactccgcagcagcaagcgtgcggccaacgcccaggagaagagggctcgtcgcggtgcggctgagaagacaggatgcaaggcgatgttgatcatccgtgacaggcgggcggatgataagtggaaggtggagttcgttgagttggagcataaccatccgtgtacacctgacatggtgaggttcttgaaggcttacagggaaatgcctgactcagctaagaagaaggccaagatttctgatgagatggatgatagggtggagaaatcgctgagcgagattgctgagaccaggaagttcccaactcggcccaagcggagtgttggtggtggagcctctgttggtgggttcaggtttagtagaagcgacagttttgtgcagcggtttggggatgatgaccttattgcactgaagaagtttattgaggcgatgcagcgcaagaagccaaactttatccactactgggatcttgatcaggaaactcatgtgaagaattttttctggactgactcgaggtcccaggcacaataccgttattttggtgacgtcattacacttgacgtgatgtatttacagcattcgcgtgctagccttccattggccacaatccttggggtgaacaaccatggtcaccttgttctgcttggttgtggtctgctttgcagtgacaagaaggaaaactatgtttggctgttgaagaggtggttgggctgtatgaatggcaagccaccagaggcgatcacaaccacctattcagatgccgttgcagaagctgtggctgaggtgttgccaaatgcgaggcaccgtttctgtttttggcatatcttgaaaaaactccaagagaatgtcggacgcacaaatgagaaagaggcaatttccttgagattcaaggaggttgtttatgacacagtcacacttacagactttgagagagagtgggggcccatggttgagcagtacaagctcaaagacaatgactggttctctgctttgtacagctgccggaaacaatgggcacctggttatgtcaaccattcattttgggctggcacttctgctattaggaaggtcgagaaaccagatccatactttgatggcgtggtgacaactaaaactaccctaccagttttccttgagcaatacgagactactctgagagggaagctggaaagggaggcatatgatgatttgcgctcctattactctaggctcacttcgctgtcgggattaccctttgaggaacaactcatggagctctacacagtacctatgttccaagcattccaagacgagatcaaacaattaatacacgtgatttgtaaagaggtagacaggagtggaaattcaattacctacatggctagtgagttgatacagggaaagaaggtcaactatacagttgtctacaacagtgctgacaaggatgtctggtgcatttgtcgctcctttccgtcacgaggcatcctttgcagccatgctctctccgttcttaagcaagagaatgtgttaatgctgccatcaaagtatatcctcaatcgttggagaaaggattttagagtacttcatgcaactgcaagttccagttctatatcatctgatagagatttgagcattttcaatgatctctatgtccgtggccacgagtatttagaagatgtcattgacattggagccagagaacctgagctcaaagagtttgtgttgacagttatgaaggaagcgaaggacaaactagttaggcctgaccatattcatcaagctgatcagcgggttgatgtaaatatgtcagtgactggccaagtgtccgcagatagaggagtagatgtgaacatttcatcaaatagcacatccctgattcagggagacagaagggttgatacaaatgtgacctcaaacaccacagccatggttcatggtcatggggattccatgacatcaaacaccacagctatgattcgtggggatagaagagttgagatgaagatcccaacgccccaccttattcatggagacggaagaattgacatgaacatggcatcccctctcttgatgcagagggacagaagagttgacatgaacatggcctccccacacatgatacagggggacagaagagttgatatgaacttggcatcaccacactttatacaaagcgacagaagggttgatatgaacctggcatcttcgcatctgatacaaggggacagaagagttgatatgaatatgacatcccctcacttgatacaaggtgacaccagagtggatatgaatatggtatctactgctcagaatggaatgcactcttttgatttggtgaatgtgaacctagaaagtggtcctttgccaatggctgcaactgatttcatgcaaatgcatcagcacccacccgtttaccatccaaaacaactcctcaatatgagagatcaggtgatggacacaaataagaggcccaatatggaaacaaacacatactttatgggaggtggaatgcatgtgggatagtttcttgtctagagacccactatgtaatcttttctgtttggaaaggagatgcctttccttattttatattgatatgtatgttcctacagcaggcagcaactaatcaattaggttgtagtaattgcagattaatcttgcagtgctggtagctttgttgttgtatccttctctgttcggcagctgtagcaattacttgctattgtcttgtacataagatagtagaatgcaacaaccttttcttgtcacccggtacatcaaaagtgtgatatctctagcttcacaggttagctgatgcatgttcatgagtgttgactgatgtttggtttacacctgtcgtacatctttgtgtcttgtcatatggtttagatgcactagtactttagtgtgaagggcgctttttttagcggctcacttattggtaggtcaaatgccgtttcatgtttaaaactcattttgatgatgacgcaacttggtcatatgtgtttgcaaggtagaagtatattataagttagcagaggcaccttgcttttgttcggtcaacaaagggtattggttgtaggactcctagctgatgctaaagggaacaagttaatttattgtttatagacaatgttagatgtatcttttttgtagatatatgcttcacatcctcacctttcagtgaacacaggtcttgttattgcttgtgcagttgtgctggctgctagcttcctattttacacatgcctaaaagctaacattgcagatcaatggtcattgaacactaacgttatccttggcttctccgtagctactattattagcaacttctgtgtccaaaccaaccagttcttagaacattgcaatctggaaagtgatgaaagatggatcattctggtcctgcagggaaccaaagaaagtcacctttacaggctgaagcaagtgtttcacaataaacaataatgctgcaaacatcacggggtacgaaagttttcgactttcagcaaagtgcattcttcagctgttcacacaaggggtcaaggggtatatctattcaatgagtaaaaacttttgcattttgttatttatgcagcaacagaacagcaatcttatggacttccttaaggtggcgctgcgtgcaagatacctctgttcagacttcaagagtttcagatgcttttcttcacacaagtgcatcagagtttcaggtgcatttctagatagcaaacttacaattcaacagatgaaggtgtgctttatatttgattgaaatacaaagtatatctcaaaagaattacaaaagattcattgccttgtacaattgtagagattcaccatgttaacaagtacaactcaatctaaacgtacgatctaacagcttgcaaggctccaaagcaatttggtattatttattccttttccacctgcatttgggaacatttattccttgttggttgttgcctgctttctacacagaaggttttcttgcttcaccccctcaaactacttttgtttcctactaacgagcactatcaaacctgtcaggagcatgcagcttccaccactagactttttgtgaccccactgcatggatctccaaagttattcgatgacactggaacactgcaattggtcattccaacacaggcctgcagagttcaacgagtaagaaaaacaccactggcattgaagcatgacaagtatggaagaggataagctcagattacctcttgaacaactgcaagagcctgagagctgctgcattcaccatggttgtagttcccacaggtgccactcggtgtcccaaagcttgcaaacttgatgttgctgatgacctgaccttctctagggcactccaggcgaagtgctggtccctgcgtctgagacgtctgttggggagagatccagctatcgatttgggctggatgcatctctgaaacatgtgcacatatactacttgtctgccttgttgtgaaggatatcatgcttggatcaccaccaactgctcaaagaggactagatcattgctaccaggttggagaaatgacctgggcacgtggtacctgtttaacaaggtaaggcattcaatcagtcagcataatggatttcatggtgaccatagatacaattttgagagtgtgccttcatattttgtagtatattaaatacatcaatgcttagtaagtgctgaaatataagtgaattttcatgcacagctaaatgatattatcactaaaaagttttcatattggaacatgagaataaattggagctggctctgcattaggaaacagattgtagatatgaaaaaaaactgaagatcatattctcgtgccactgagctttagcagaactcttacagagtttgtgatggctgcccacatttctttaggcacttgttcgaactataagctcctctgtagttgcatgagtttacacagccactttgtggagccaaatttgttggccagtagcgaccaatgctctggccattcacccatgcctcccctttccccattcctgtgaagtctatggcaacagggtcatcacctgcaggagccgtaaacttggtctgcaattggagcatttcatttagcaactttgcacattatcccaaggtaataattgaacaaaaaggattgatcaaacaatggagtgtatagatatagcttattgagcccaaagccattttacatgtacacaaacgtcaaacacagcttaattactgggtcagaggatcatactgaccttgtaccatatcaatggttggttggtcgggtatgcgttgtctgaaacccattctggtgaggcttctgaaggattatacagatgcaagtcttctcctctgagtccaatctgaagcggtgaaaattatgatgagggaaaacaaaccatgttatgtttacggttgacctactgtaccgaaggcattctcaaaacagcattagccaatagtttccttacaaaaaaaatctgaaacagtatatgaatagatagtagaatacctggtatgtccaatctgtagaagatagattaagggcaccatttggtccactcaactttactggaccagtgactccagcgccaaccaggtcaaagaatgcaccataattctgatgttacagaatacatagttgtttattaaatagaaagaagtaaaataggatattagttttggtgcatctcttctagagtaagtgaagaataaattaccgatagcccaactgttgtgctcagaagatctattttgttcttcccaggtacaagtgtaactggtgtctgcaatgagatgagcgagctgctagcactgcccttagcacttcctggcatgtgtcaacaattacatttcagcacacaaatactacttgtgcgtgtaagaccaatgttcataattaacatcacaattcgaatgtcatttgaaaggtctttgcattgtgacctcaagctttacctgctagtttgccattgatgtagatctgaagaacatgtccaagtgagttgacaagcagattggactggctgccgtttagatatggttcatcacctttgacaacgatgctgcagaaagcacgattaattgaaactggtgagtaaccttgtgactgccagttttcttatatatatatataggagtatatggacaattacacctgaggcgtgtgagtgcgaaccctgtaccttgttgagtaccacaggaaatcactggcatcggctgtggtgtttatctgctccatcagtccaggtttcgtcaaggcgttctcctttgtaataccaacaggctctatggcataactccagccagctgtagcaagttccggtgtgattaatgaatcatcagtatcttggatacttgatcccaggcttctcatttctgaagttgttacctgagaattgatctgcaagggggcaaccacatccacatgcatcagaatcagttctcaccaatgttctttctcaaatgcagatcattgtctagcaaagtgagggcaaggaatgcacatacctgggctgtgttcaataccacatttttgcagtcaggaaggatgcttacagaccaggcagggagcttatacgtgtttccgttgaatttgacagttttatcagactgagcatccacgttggcaaggaatgctgcgcatattgaattgtcagcagtctgatatacggttgcctgaagccagaagagtacaaacacccatcatcatgtgtaccggaacagatcatcaaggtaaacaaatattttatctctgaacaagattagctatacatctctagctgctccagcaattttgattgactcatctttctttttcgttaattaatacacgggttagtcacttttcgaaagagaggatcacatacctcagtattttgacccaaagaactatatgatggctcagctgctatgagtgctggttcgcacagctttattgccttgtgcacatcccttaagtggccccactttggctgcctgaccatccctgaaccacaatattgcaaaagatagtgattcggttagtgagatgtgtggttgtaccggtacacccccaacacataggggagccgtttgggctcaatttttttggttcatatctttcttataaaagacacacggttcctcatggatattcatgttctttttttaactgtgactagtcaatactagtattcccagacggcaaacatacttcaatttaacatagctgccattgacaggcatacatgtggcagtaaataagtacagctagctgctgacagtacactcaccatactcatcaataggagcatcgtagtcgtagctcgtggcgatgaatggccctcccgtgcttcgtccgaagttggtccccccgtggtactgcaagccaacaaaaaaccagtgttagaatcgcagagcgcctctgtttacccaagcgaattggcaaaacggcggtaaaaaaggaaaacaaaaaagaaaacgtctcgtcttcgcgcgcgagctgcttaccatgtaatagttctggaacgtgccgccgcgctggtagaatcgcgcgacggcgaaggcgaggtcctcggccggccggtacggcacggcgccgccgaaggagaggaaccacccgctccagttctccgtccacatcttgggcttgctcttggagttcggcgtgaactggtcgcagtagaacccgttgcacgtgttgatctgcatgcgcaagcacggagaaacggtgccacgtcacttcagtgtcgccgtgtcggtggttcgttcacggcaccggtgatcgatggcgattggcgaagcagggggaagaaagacttacgagggggtcgggggcgtcggactgctggcacatgacccacggcacgccggtgtcgagggagacggccatcccggcggcccaccgcatgtaggccttcccggcggcgccgtacgccgagtcgatgttgccgtactcgttctcgatctgcgacaggatgatcggcccgccctgcgacgcgtacagccccgcgcccttcatcgtgtccaccaccttctccgtgaaccgctgcatctccgccttgaacgcctcgttgtccgtccggaacttgatccccggcacgaagtgcagccataccggaaaccctctgcagtaatacttgcgtttcttaccaatctatcgatcaattcgcccagcgatagccagtgcgagagcatgagagagatgtgaatgcgaacccgtagttccactcggcgcagacgtacggcccgatcctgaggtgcacgtagaggccggcgtcggcgacggccttcacgaacctgacgaggtccttcctgccctcgaagtcgtactgttctttttttttcgttgcaaattcatttgagtcagtcagttagttgatcgttaaacgtccgtgtagcagaagcggagtagtgtgataatgccgctttagaatttccagataatgatattactaatactagtagcagtagcagttcacggggagaaaatggggagaaaattgtaatattgggattgcaaacatagaggcttcgctgttttgacactctgagtgaatgacaaatgggtccatctgtatctataaaatgtggatccaatgtcattatagtaaaggttaatgtttacaccgttgtaattgtaaatcaccagttcacgggaggcagaaagcctacaagtgagtgagagaataaagcatagggtgcagaggaagcaaacaccgccctttgacacatgacggccaggagggagaggagatgatgtcggaaaaaaaaaggagagaaaagatatacacaggtcattaatttgataatttcattgtggtacactattaatggagaatactactactactagtagtggtactaagtagcagttgagagaggagtacgtgcctgtccccggacggcctcgtgaatgtcccagaagacgtacgtctcgatgacgtccaggccgccgtccttggacttctggatcagccccggccacatctgcaaccggcgaccgccaccgccgccgccgccatggcaacataatgtcagcttttgtaactagcaatctgtctgctcatcaagaacagaggaggccgaacgagcggtgcatggggcaaaagagagaaaggcaagagacggcgacgtacgtcgggggtgctccgcgggtagtggatggacccggagacgagcacgcgtcgcacgccgtcgatgaccaccgcgcggtggtcgtacgtcacgttcgccgcccgcgacgcgccgacgaggaggcttaccaccaccaccacggggaggagcagcagccgcagcagcacacccaccgtggctgccgccattactgccgccgccgccccgttcggtgtcgttctattatcaccggcgctagtgcggacgatgacgaggagcagcaggaggaaggaagaacagagttgctcggtgggagaggccaaagaaaagaagaagaagaagaagaagaagaagaagaagaagaagaggagttgctggttggagtggccggcgggacggaaataaatggcacgcactcagcggcagcgacgaggctcgctagcggagcagcgggagcgaaagcggctgtgtctctttcccgcggatgcgggtggtggtgcatctgctgtgctgtgctgcctccctccgcggctaataaaaaagcgctgatcgttcgcccgcgcggcgagcgatggggtgggtgggtgtggagttgagttcgcggctgcttgcaagcaacggcaaaagccccggcgccgtgcgtctagcggtaggatcgaattgatggatggatcgagcaaaacataattactgctcggcttggctagttaatggaggcgtactacgtgatggttcggtggcgcacacggcgtgggtggggggggggggggggtgagcaaacgccacggccacgccatgccgcatctgatctctctcccgtccacccttttgcttccgctgctgcatgtgcccttggcattggccgcacgggctcacagctaggacggaccagtaaacaaaaggtgccggtgtgaccgaccgacagacacggcatggcaggggtcgtgcccgacccgacccgccgttcattgccgctcgatttctttatcagtgatgctagtactactagcactgcgtctgctcgggccaagagctaagcggcccttgtcgcttccggtctcgctcgcctatagtacctccgtcccaaaataagtgcagctgtggatatctgtgttcaatgtttgaccgtccgtcttatttgaaaattttatgaaaaaaataaaaatatttagtcacacataaagtactattcatattttatcatctaatagcaatagaaatgctaatcataagaaattttcagataagaagaacggtcaaacgttcaacgtgaatagtgtaaaactacacttattttagtacggagggaatagctacttcgaccgtgatggcgtatgatatgctgcactagcacacggttgccactaccaatctagcagtagatagtggtagtgtcatggactgtactccctccatcctataaaaaagtaaaacctgagttttcgtttccaattttgactgtacgttttatatgaaatttttttataattcgtattttcattggtgttaattgataaaacatgattaatattttatgtgtgacttgtctttttaatttttttcataatttttttaaataagacggacggtcaaacgttggacacggaaaccaaggtttatctttttttttttgaacggagggagtacgtctgtactgctcgtcttctttttgtttgggggaggtttgaaaaaaacggtggcggtggtcagaccgtgaaaaaaaggctaagcatttctccctctttctttcatcctttggggcggtggaaaatgatggtgcgcggcgacgacaaaaatcgtgcgaaagcgggagagcgagttgtctatgcagtctgcgctccacctgtggcgtcggttcatggggaggggaaaggggctagggtcggactcgaccacaggggagcaagtgaaaggacatggaaaattgtatgcaaagctttactgctgatgcaagagagtgacttttatatattgtgtttgtttgccatttttcgtgttacaagcttacaaggcttgtactacgaaagcttacaagctttcgtgtttgccattttatcttatcaagattcaataaggtaggggtaacaaactaaacggcctccgtatccaaccaaaatttagcatggttaaatttgatatcaaaccaaactgctctacatatggaatttgtaccaaagcattacgctcaactctacaaaatctaccaaagatacacgcgccctttttgtttgaagaaaaagctaatagagctaaccaagtttttgtggcatgagaaccacgtgaggcaactgctacactcaagtacttggatttctaagaggtagatatttcttttttggctactgaagaaactgactgcataatctttctctggatgctcgaatataatgtagttcaatgtgaaatcgacatggcacacgccattgttaacctagttgggtgacccacctgattgcattcacagcatatttgcccgggctatgcaattagtactcttcacaagtcacaagcatatataaagacctatggtagtgcagaagcctattgtttggactgtcataagctgggatgtttggaacgctgtaaaattcccgtacgaagaacggttttctagtaaaaacttttgctgaagataagccaaattaactgaagataagcaagcagtcactagcttgatattgtagagtcaaacctcaccatttatcgatcagtggcgcgtctaattgccgtctatcacattgactagcgtctgaaattagaacacatagtaaccacaaaaccgagaatggcgatgccgaatcctgaacctaacccactacagaggctcctgaatcgaattgaacatctggttcttctccagagcaggtgctcggcttaggtgtggctcagctcaagtcaatcgtatttggtgctgatttgctacttacagtgggcaaaccacacatcttgcacgtcaatgtagaaggcgaccatttctcgattcacttttagtagtaacgaaattacctacgccaccttgacaatctttaaaccctttttttttgacacagatgtaccatagtgtcctgtcatctgttaacacaaggaaaatccagaagtgtcatccgaatgctgtgcaagaaaggaggcacatggattcaaaagaacaaatccatattttctgaaaattgttgactaccaaaaacaaaatcttgtgctgctccattcgccacctcaaccattccaatacataaaaaaccggataagaggggagcgaaaatgagaagtgaaacgggtgaagcagagcgtccagggcttcttcatcatcatcatcatcagagcgtccaggcctttaattgaactcgcagtcgggaggctgcaggtgcggcgtcactgttgccgcggttcgttgcggcatccttgtagcaatagcagcacatcggcgcgagatcgctctacgtctcgacgtgcgaatctgatgtaactctcctcgtcctttgcggcggattcgtccgggctctccgtgcgtaggtgtgctaccggcgcgcgcgtgcggcaccaccggcactgccactgccaccaatgcgcgagaacgtaacaaaacgggcaaacggcgccttccttctccactcgattccttgtcgtcatctcgcgtcggggtttttggagcagcgtgcgggagagccggccgggccggtcacgccgatgtggatgtgggcgatgtgcacgctgcgtttgtgtgccgaaacgagagaatttttcgccgatcgatgtgtccaagacttcccagtgtaatgggaactcatcggattattctttttgattcttggttaccttaactttccttttctttgctcggtggtgttcctctctcgttaataagatatatacttttcaaactataaaacggcgtgtttcttaaaaaacaatttatataaaagttgcattaaaatattaaataaacctatttttcaaatttatattaattaaaaaaataattaatcacatgttaataactttttcgttttgcgtaccctaccttcgtcttcatcttcactatattctaagatgtttttttttaaatctatctggtatggggtttggggcgtacaaggtgagccaagtgatgccattgatgaggagagttttgcttggaagagtcagcaaagaactgggagagttcaccggcttgaagcctccattttctgcacggatgcgattgcagcgtagatgatgccgcggcaagcaaggagaaagatgagctcggcgagggggagagtgacacgctgacagggatactacggagcagataagatgcacggagcaccgctgccgtgcaacacggcagcgtcgtcgaagagcggcacggcacggcacgtctcaggatactactagtaataacttcgaggcagcgcgacaggagcagactacgtgaaacgatcgccagcgcagcttctggcacgagagagtttctcagcgagatcgacaaggacaatgatgaattaatcgatgaaatctaccgtacaacacaaggcaaaaaaatgggagaggcaggcagccaggcagggcctgatccaaggtgcactggcactaaaaatctgaaacatgttctggaaatggaatgccgaaaggcgaaagggccaaaggctattatcgctggatgtcgtaacattatcttgtcaagatccatctgataggagaatggtcatagcagcaaaggacggggccaaatcattgaacgcgacagctttgatgaccatgtaatgtagcagaagggatcagtacggtatctgaagccaaaagaaacggagagaaataaaggagaaaaaaggattagatctgacgtcctgcgttttgcacgttcacgtactagctccccttgcgcaattatgcaagttacctgcagttatggagtgcacacaaccgcgcttcagatgtacagctagtataataacatcaagcatcaccagagaatcaatcaacctgatacaggtgaacaataataatatcacgcggttgcaggataagatttgtgtaagatgctaatctgtcatcgacgaagtgatggagatttgagaggacaatggcggcaacccacctagcggcgagtcaacccagaacaaaggactaaaacagaaaggaaaaaggaaccaacaattttgctaatttcatggaaaataaattagccaatggtttaaaacaaggcagacgagagttgagagttgtccatactctttgtacttttctaattacataaagagttgttcatacaccctttttttttaagatagtgaatagaaatcccgtctctatatctatcaacggatagatatataaccaaatatgtatcacgtacttttgtgtccgttttaacacacgcttaaggttacacccaccaagatttaaacaccattaattacactgccacaccaaatatcctttccaatcctcttctcttcttttcttttggataccttagtttgaccataattagtgggtaggtgagaaaagttgctgataactgataagcgtagccactatgcattagctactctatcctctagggtgctctcaaaagatatgtgaaggtttgaggccatccttccgtgtcagttgacgccttgccaaatccaccacaaaaggctagtgcatcaacatcatcaccattcatcacatgaggacatactacacatgcaacaagcctgcccgacacaggaaccctttagattattagcaattgtgaagcaatgtggagatcggatcaagtgatttactaatctactagcaaggcccccccaccaacaggaatgtcactaacctatcaatgtgatgactgttcctctgaattcttcctgccaatgcattgctggcttttgggtcacggattcacagctctggagtctggagctgcaacagctgacgacgaaacgacaaagcaggcacaacaactcagagctgccaagatctgatcagagcaggcataacaacctaagatactccttcagttccggtcttgcaagctcaatcattactgttgagaagccgcactccaggaaaatgattgaaataaaatccaaaaagacgattactggattgaacttagtctcacattttaatccacataaatgttacttcctccgtttcatattataagattttctagcattgcccacattcatatatatgtaaatgaatctagacagcatttatatgaatgtgggtaatgctagaaagtcttataacatgaaacggaggtagtatctcatattatctatctcaaaaccaactgtatttaatacagcattgagaatatctagaggaggtatcaaactctctcaagggccagggcaaaaaaatgttctacacctcacactacaaccttatattaactattagcaacccagcaaaggactacatttccacttctgaaaaaaactctgaaaaaaggaagatgccgatggattgtacaagctattataagtgggaatcattttgattgttgaaagactagtggctaacaagaaaatgacaacatggagatttcctacttcaggaaggccgatgatacaaaaaggagtgcataagtaacacatgcagtgctcacttccaagtttcttggaccaggcagtataggcggaattacagaaaccatcaagaatgtggcaaggaaccaggaagcaaagaaggatccgaacctgaaaaatcagacaaacttagcatcaggaattgaccacacctatgcatagccagagactatatccttttgcctattacacaaattatacatgaaaggttgacaacacattaaagtcacctaaatgataaacttcaaatcatccaatccttaataaatgaatcctatgaaagcaagtttaaagtgttactagtattgacatgtctattacacacaactgcagtatgccatcacaaaacaactactctctgatccatcacgaattcatgatagttgcctcaaaatatagaacttttgtagaataaacaagattcacacattttgcaccattcccattgaagaaaagttctaaaaaagcaatgagattgacatgccataataggtggcgcctaggttgcacttgcacataataagaacaatgagattgatagaagaatgaataggcatagagtgaaatacgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12780 - DNA, 8972 bp, Oryza sativa
  unsure (1)..(8972): unsure at all n locations
tttgtgctcagccccctccacatataccttcgcacataacttgccttgactagagcatttcaacccaaatcccccaaaatatccctaaatcggctagggtttcaacggtgaggttagcggaaagaggccgagaggtagcggctgtggcggcctcggcggtgcgataagtggcaggaggaagcgcagtgcagcggggttagcggtggcacgtttatgcaacatgttgtgatgtggagggggctgagagcaaaagtgttgcctacgtggcaatgccacgttggcggtcaaacgcagtcaaaggatgtttggaccggggtggtacattaaaccaaattcacggacctaaacatgcaattttcaagttcacggacctaaatgacaccaccacacaagtttagagaccggccatgtatttcactctattatttatttgataggttctcaaaacatttgatgagcacctggcactgaatagacagacactttgtattgtgaaggctgatgaatgagttcataactcgtggggtaaatcggatcatggatccaatgaaaaacaaaatttgaagaatattctggattaaggaaactggttgcattatcagttgacaatataaaatgatagtgatatattctattatatacatcaaatagtggaaacaggctcccaacattattttgataagaaagctggcctaattacagtagatatcataatatgacaagaatgatacattctattatgtatttcagaggcaaacccttttacttttaagtcctaaatatcaaaagctaccatagagtgcagaccggcagatattaaattgtcaagtgaaaaaagtagaaaatatttaggattcaaaaagcaatccaaaattgaatcccaagccaagtactacaatccagtccttgtattacgggcttgaagttctagaactgcccagtgcagcatgatctgcacaacataaaaaaagctcccagaatattttgaacgatgcagcacgaagtttacaacacgccaggtgtggaagacagagagaaataagatgtcctcgctttcatgaggtgagaacatgttcttgtgtgcattttacatatttgtcctcggaaactatgcagagttatgctttgagcagaggagtgatcatgtgctgtgtaaacactatagtgtatggaactaaccatagattactcggatataccattagctaaaggctaaaacacacaaaaaaactgcaaagaggaagaaaacatacccataaaagaatgttcgccatccacttttcagcctctgataaatgaaatagatatttgctgcacaagagatggccacctggagagttggcccttcttcagtagggaaaacaagggtaagcactccaagcaatacaaaagttattgctgtctgccaaatcactttactagaaggtgtttgaaatcttccctgaatagccttgactggacgtgactgagtaagttccctatactttttcttgagatccacttttggtttttttctatcagagaaactctgcatgatgattctgtcatgggcagactcaattgcatcaacacttggcttatgccctgcatacttgtttatcagaaaattcctggcagctcgaatttcttcttcagatgcttccctgctgattccaagtcgctgatagggatccttcacatggattctaggaaagatggctgaagaaattaagcggttaaaaagtgaggtgataattacaaaaaagaactaatccaaacaacaaaaccgacaggacaataaaaagtatatgtgatctcaaataaaacatgagaggaacagattgtgagaaaaagtatatgtgatctcaaataaaacattagaggaacagattgtgagactaaatggcgtgattttgatataatgtccaatgctttggccatggtatagttaggtatttatacttttacaatttaatatcaagcatgccttacagcaaactacacaatttgttacagaggtataccaagtggttcctagtaaaccatactgctcgttactataattcaacatgacaaatttggttggtaaaagtacatatatgtacttactatgttacatttttttcttacatagccctaggaagttaaatacttacgagttgacgagtcagctgtgtcaccaaatgatgcagtagcaagcggtgtgattctggtgtttcgcggtgcataacagaaaggagtactatactttgtgtatctgcatgaaggatcgcaataagatttcccactgcataaactaaagaaatctttggcagagagttgatgaggccagaagaagcacaagatacaatacctatccacattgatgaaaagtttaacactttccttacgtcccctgctgaaggccaacgaagagacaagtcccaagggtgcactcgacgccctcgaagtaaccggacatcgagcagcccttgaaggattgattgctagactatgtgccaacatctcaaggaatagttgaacagcctaaattgaggcctttcccctcctaagcacaacaacagtaaattcatcaatcacctagaacaaatttagcaaaggaaaaccaatgccatgcacaaagatacacaaccgaacgctagcagattacccacacccattaattaaaaaaagtacaatcatcacaatatacaacttaggaacctggataagaaagcaattaattcagacaaggaggaacatatcgagcgattagcagccaaccgaccgtcaccctcagaaatcaaggggtgtgtagcctgaaaaattcacaccattcaccacacagtgccaccggaaccctacatgccattaccaaccctacaacccacggaccctgcacctgcatcagcatccatcccggcgtctaacctaacctgtcctaacctaaccatcggtgcaccggcgccgcaccggaatcgagcggggtcaagaaggcgaagacgaggagccttaccgtgggaggtgacccgcgcgtccggcggaccaagagcggcggcgctgggcggaggaggaggccgcctccgtggataagggggggcggggtggtgtcgcgtcggtgagggtacaggagaacgctgcgcagggtggtggtggtacttccgtaatttccttccgatttcctcctcgtcctagatggccctatactctcagggcctaattgggcccagcccaaccgcgatcccaaaaaaggagtgggccccacctgggaacggaatgcaaatgcaatggccacggtcaaggtcgtcccccttctcctgcaggtgggccctgctctcccacgtcagcatcactccaagtgtactttaatgtgtgtctgaggaggagaatgggattgagtagattgagaagatacgtaaaataagatgagccattagctcatgattaattaagtattaactattttaaatttcaaaaatgaattaatatgattttttaaaacaattttcctatttaatttattttaaaaaaacgcaccgtttagtaatttgaaaagcgtgcgcgcggaaaacaagactcaatctcccctatcaccgaacagagcctaagtttatccacttggacagtgggggtggatacacgcacgcacgcgatcctccgccgtccgcttcaccccgcgcgggcgatcctccgccgtccgctgggctccgcctcggagatccggcctcatccgcctcgtcgtctcctctcctcctcccccactcgcgtcgcgtctcctttctttaattgcttctctctcttctcccaattgcagtcctctcccccccactaatcccacccggtaatccctctcacgatgaacggccgcggcggcgattctccggcgacgaattgctgcaggggcggttcttcttcttcgtcttcgtcttggcgccggtcgatgtgggtctggtcgttgagtttgtatgcgatttgaccgctcccacgcacctgtggcgtagttggttgcggtgcaactgttcgagctattgactgtttggctggctctctcctcggcgttattctgtggccgtttgggggattgggagtattggaatcctactcttccaggtacccatgataataagttcttccctccaaaagaattcttttcttgaccatttcatcttgccttttggagttttgttgacctgggctaaagttcacttctgtctttgcttaatatgcgtgtgggagtagagtgttctgcatgctataaatggaaggtttcttttttgtcatcgtgcatggacagggctaagcgctcgaacagttttggagtgtttgaccgttttatgtgtgtgagaagtggatccctggggattatatgtgttatttctaggcttgcagcggaataaggtttattgttggaaactttctttctaagatcttgttaatttcattgatgggactagtgcacattcaacaatagtaagttttagaaaaggaacaacaaaggtgcactttcaatatgactaggatgtttgctctgcactttagcccctatagtttcctggacacgctaaaaaaacgcccttcacacttatcttaccttatactaaagccattaaacttaagggattttttagacaatttcttgttttatctcctagagctcacaactaggtgctttaacctccgaccagtgcaccgttcatctccatttttagggattaatcagccactttttgtttaatcatccgactaatcgtccgcatattgcacttgattatcatttaaatatcttttatgaacttcatcttcaagatgtttaagaatattcacaccacagagtacttctcttgatgctcataaattagcagttccagtttgatattaaagtttttagtcaccatatacctttaacttcccaatctaactttgttaagatccttaaattatgtactttatggaaaatcaataaataattcaggtaaatacgatctgttttttgtttttgcattatccaaatagttgttccagataccttttcggtatccatatgtccatatttacttactgcctgagtaactgagtactttttctcggtaatttcatatgtttttgctaagctaaggttttgggcttataactgtcgagtcattacagttttcctttacaagatatgatgatttttcccccaatatggcaatatctaatcattaccttcggattttggaccagttctcctaagttcttcacaggaacaagtctgcaatcaggatggtttctgaagtctttgctaactttgagcttagtgacttgatgggtaattgattctcttgggtgttgttgcatttgtgctgtaacgtggataggagtcatggaaggtgtggtaaccagttcagttggtgaaccaaatcaagacaatgagccaagggattcttcaatagaacttcccagagtcattactgacatggagacttcagccatgcatgatcctgaagctcaaaagctaattggacatgaagctgatactgaattaacgccttatgaaggaatggaatttgagtctgaagatgctgcgagggatttctacagcaaatatgcaagacatgcaggttttagaattcgaatcagcaggtacactcgttctagacgtgataattcaataatttctcgtcgtattgtctgctcaaaagaggggtttcatgaaactcgtgattgtgaaaacctccatgtggaccagaaacagcaagcaagggtaggaactagagttggttgcaaggccatgttaatgattaaaaagtttgggcctgacaaatgggttgttaccaaattcataaaaatccataatcatggaccggttccaccaagaaaacctcatgctggagaacatcatgattgtgatctaatggaaaatccacattctattgaggtggaccctattgatgagccagtcgagggtatggaatttgaatctgaagaagctgctaaattattctatattaactatgcgagggttaatggtttccgtgcacgtattagcaggtactgccgttcaagacgtgataattcaatcatttcacgccagatcgtgtgttccaaggaaggcttccgtgaggttcgagccagaaaagatattacagatggaggcaaaacaacgaagcgccctagaatgataacaagagttggatgcaaagctatgattgtagtgaaaaggatgaactctggaaaatggatggtttctaaatttgagaaggagcataaccattctttgttatcttctagagcagtccctattacatcaaatgattcttctagagaagttattgattttgctgcaacgagtaatgatcctaatgaagtaaaggctgaaggatgtagcacaggaattcaatgtaattctacagattcactaactgtcctttacaaccatctatgtcaggaagccataaaatttgcaaaagaagggtcagttacagaagaaatttaccatgtggcaatgaatgccttgaaagaggctgcagagaaggtttctgaagtcaaaaggagtcacccgacaatgtcacagagtaaacatgaagttatgcaaatggaaactatgagtgcttcgcaatgttcaaatgatgacaaacagaaaacaatgacaccacagctcaagtttttgcaagagcccagtcccagtcttgtgctaataccaaccaaccttttgactcattcaagctcgaattgtgctgacaatattccactctcatgtgatttaactataaatggtaactatgttatgataatgataagctaatccattgctttgttagtgctttctccacaccgaatgatgttgggataattgttttatttgtaactgttgcttttgtatcaacagcgggggaagtcaagcatgtatcagaaagttcttgtttggctgcgaacagaaaggaagactcttcgcagaaatcccaggttacaaattacctgcttgcttatatgtcatactgttactaagggcctgtttggcacagctccagctccagcttcaccccttctggagctggagctcagccaaacagtttcggctccaccaaaactgggagtggagctgagtggagctctctcacaaaatgaactagagttgtggagctgggtttaggcagctccacaactccactccagactcaactcctggagttaaatttaggagttggagctataccaaacaggccctaatatacctagacgatttgtgtattctgtattggactagaaagatcttatgcgtagttctgaccgcggattccacttgtaatcaagccttacagggaaaggatgaaaggtttcatgtactttctaaagaaactacggttgctattcctgcgatacctctcacgctgtacatgcctataatgaagaatccaactggagattctgcaggtaatccatttccttctgctgtttacaggaaataagtgtaaaagtaatatttaaaattctagatagaaattacagatgcatcagtttagaaatctattagatatttatgcctgtcaattgttttcttcatcatatgtggcaagataagatagtaagtttacaacactaaaattttagaaatgacccaataattatatgtttagtaatgcctcttgacaccattttcttttgaaggaacaagaatattcgtgtgtggtctgttgtcctcatctgcaaaaatttaccaattgttttgcctactatagtagtttgcctgacaatttagttcgatagatcttgaaactcttcagtttggcatttctttgtttctttggaatgataggtggcttggagcattgtgtttatctgggttactttttttcttttttgcaatccaagaacataagtcatttaggatacttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12781 - DNA, 1516 bp, Oryza sativa
  unsure (1)..(1516): unsure at all n locations
tcctgcagcccaagaattatttcgcaatgctgttccacatgttgatgaccagtatatagtttataatctgtgaaattgttcaagcatgtacggaaagcagagcataaacatccatacctctcgttgttgttccgggttcgcagaagccaaggaagtctgaaggttattgcttggagcttgcaattcccccacgggcaccacatgcttgacagcttgttgcattggctgcattgggctagagaagcgatggtgctgatgcaacattgctgggttggccacaccattcctacgatttggcatgtgtctgaagccctggttggcattttggtgaaacatctacaaagtaacaagcaacgatgttaagtgaagtgaatcctagttaattattaattgctccctccattttaaattagtacttctctttctagacttattctaagtcaaacattttagtttttgacaatcattttttctaaactcatgtagtttgacatcatgatattcatggatttagattcaataccttcataatatataatttacttgtcaaagtacactgttttttaaaaattaatggtaaaaaataaacatgtttgactaagagacacctagaatgataagtaattcttaaacgggggagtagctgaagttgcgagtaattgacaacattagcaaaaataagtagatatgataattggatacaattagatgctggatctattgtgttaaaaaagaaaaaaaatatgacaatgatttagccaacaggaatacctggtgaggattatgcagatgtntaggcattcctccatgcgaaggaccactcctctggccaggctgcctttgcatgttatatggcatcatcatgtttggaacaaaatttggttggaaccccaagcctgcaggtggtggtggtgggaacaaggcaggcacaccatggccaaaattgaactgatggggagcaatgtttggccctaatgtaggtgccattgttgctagggctctaacacgagcaaaatgtgcctggcaaacaaagaagatatgaatatcaagcttaacaaacgacctttgtaacatggaaaagttcaatgttagcatagcacacttagtatcaagtgtcaatgttaagaaacaaaatgtactttcagttttttttttcatgaattacaaaactcacaagaaaagataacaagatgtacaaaacctaccctaaaaatcaaattcaaatgtaatagagttagtacataccgctaaaaatgcctttctctcctccttccgttgagctacggcaacatataatggctttttcccaaccattttcccgttcatttttaaaatctataatatttttaaaaatattaattgcataatactgaaaaatatttagaactatggaattgggagtatgaggatagcacaaaagaatcattttttaacatacagcattgttagcgtcttcaacagttgcaaaagatacaaatccacaacccttgctccttccatgcgaatcaagcatgac

SEQ ID NO: 12782 - DNA, 1505 bp, Oryza sativa
cgagatcaagtatattgtagtgaagtatataactgatgcgaacaatatggtaataggaatagcaataaaaaaaatggttcaaatgggtgttgtggatgcgccacattaatgagggactttccaatcaatcaagttactaaggcaatgatgtggccacgaaggagaagaatgaggtttggacaatagagaaaatatatatctatcacctacaatgtacaaagagcctctagtaaagcccttgcaattttcatgaacattgtactttcatcaggtccagtgttcactgttctgcctccggacaggcagctgtttaggttaaaccactaccaaggggagaccattggaattcatcaagaaggttctcaatgaaccattggctcattgcagtgtcatcagtcatagttaatttgcaaagggcccaagaacaatgagtacacaagaacaaaacaatagctggctttcaactaaatttggcaaccaataaattaaagctactaaagaagcataaattgcaaggagccaaggatgacagaaaggtagcaactagcaaggatactgcaaaagactatcgaaatacaaggtcaaaccaggtcctattagtagcttcaatgttcacaaaacaaattagcttgtaggaggagtgcctctacattccttttctttatattcttctactatatacaatctagagaggaaattatcagctgataaacaaacataaatcaaagatcattgaaatgaaaattgccacttaaagcacacgaaggcgtcagtcacaagatgccaattccatattagcatcaaacttcagtgaatcaagccactcgatacaaaccaaaccaattctcagtgaaatcttaagtatgcaactaaacagcaaaattctttcggcacataaatgaaatatagcacataagtttgattgtacaaaagaacaaaagattcaccttccagcaagggtggcgtcaaggtgaaggcgacgaggaagcggcccgggcactcctcatcaggctcaatccgaagagtctccttcttgaggttgacgtcgttgcggattgtgatagccttctggtgctcgacgtacggcgtcggcatggccggctgcaatccgcaggggtgcggccgcccagagaccccaggccaccccggtaatggtggcgggggccccaacggcgggaacttcctttcggagggcacccccgcgccgccgcccttgtggtggtggccgaaccggcccgggaggggcacctgcagggacggcggcggcgggtaatagttcccgtactgagggtagtaccgcggcaggttggggttggtgtactgcgccggagggtacggcgtgccggcggcaaacacgtagtggttcggggacaactccggcggcggaggcgggggaggcgaggacggctggtggtggtggccgtggacctgatggtggccggggccttgggcggcggagcctcgtcggcggtgaccaggggaaccccctccgccgttgctaccgg

SEQ ID NO: 12783 - DNA, 730 bp, Oryza sativa
gctcaactgcaatctaacggcggtgaaagaagacctgattaagcctgttactgtaagcttcaaagagggtcttggtcagaagttcagacagccttctggcactggaatcaacttctccgtgtttgaggattccgagttattgaagcagggggacatggatgtatatccacttgcagttaaagctgaaacaaccatgcctgttgatcaaaagttggaaggagaagatcaaaagatgaaaactccaaactcacagatcacacaggctctgtttgaaaagaaagaaagcggtgattatcaagttcgagttgctagccagatcctttgggtcaatggaactaggtatgagttgcaggaaatatatggaataggaaactcggtggaaggcgatgctgatgccaatgatcctgggaaagaatgtgttatttgcctctcggagccaagggatactaccgttctcccatgtaggcatatggtaagtatccgatttgtgtattgactagttcatgtgcagcattaggggtccatgatcaagttaaataaagctacaaagttattctgtttctaaaaccatactttttatgcttatggcttacctggttcacatttcgtattctgaaaactatttcaaacaaatcgcggctgttttgctgactgtcagccatttccatgcatttttagcatctccagtaaaccctgacatttgtatactctggtacagtgtatgtgcagc

SEQ ID NO: 12784 - DNA, 3800 bp, Oryza sativa
tgcgctctcgccttgagcatggggaggagatgtaacagatgtgtaccttccagtgtatgttagcatgtaagcttctggcataatgtggcttcctgacctgacctgtgtgggtgaaggtcttagatgccaagaggagtggagtgggtgtaccatatacacatcacatggattcatgcgtgtactattgccctaacctgaagaagtggagaacatctcatacttaatgggatttccctccatcaggagtaaaaagagttacagcagatggactccagatttgtacaaaatttcctcatgattctcattatatttttgccttgatgagatgagatgacaccatatatgttctgctctgattgctcttaccttttgcatggaaataaacttgcaacatggccagatagctaattgcaatggtcaagctgccgttgccgttgggatcacgcttcaaactttgttcttttttgctagtggtaaaatcaaagtaaacgtgtgatcccaaacctttggttacctggctgctgctgggagttggaataggcgaccactttagaatggccgatggcgtcctcggttggtaggtgttaccagattcgatcactccatcagaatggcgaggtcagattacaagtcaaaatctgacaacgtctgtccggttcaaacaccggatcagtgaatcggccgggcggttcaagctagttcggctggtgaaccgggcggtttttttattgaaaaagaatcccattccggtcggactgaccggaccggtggtcgtaggtgaagagccgggcggccggagtgggagaggggtaggtggcgaggcgacacccccgtcgcgtattaaaccggcggcttccttcctcctcccctccccacctcgcgtcctcgcctcgcttcggctctcaccaaccaaaccaacaacctcgctccgatggccgcgccaacgtcgtcgcagccggtggcgcgcgtcctcccccgcggcggcggcggcgggttccgcgccttcccggagtccgccccggcttccctccgcttctccgtcggccgccgccgcgccgctcgcctaggtccgcctattggaatcgtttcgcccccccttgtctgggtccgttcggtggaattcgggtagagtttgcttcctgcgcggctacggggcagctgggaattgcttggctggcctctctcggctttgagttttgtctggtcatctactcgtgggtgaagagggttgccactcgttgtctggctaagaaagaatcttaccattttttagcatttttttatgccatgattgtgtctattgtatagggtaatttgaaaggagagaaaaacggctgcttcgttctatcctagcatcaagagtttgtttagtatcattgagaatttagatcttggggattaggatgacaactagctttaatgttgccgtgtttggattttgagtgtcatcgtggatactgatcacgtatcttagttagaaatagagtatttaaatctgctactttgcattacttttgttctattagaaggatggcgaaaggacttaattaaatccgttgctcctgaaatttgaaaacagaggtgaaggcgtctgcaaatgtatttgggaactacttccaggttgcaacttatggagagtctcatggaggcggtgttggttgcgtaatcagtggatgcccacccagaatcccacttactgaagcagatatgcaagtagaactcgaccggaggtttgtctcttgaaaaatccattatttctgtgctgacagctggcttctgtcaaaaacaggattatgcaaatgcaatcctgctaacctcttgcagaatatgattgttatgttacattacaccataatgttaactgacataaaattttgattatcacagacggccaggccagagcagaataaccaccccaagaaaggagactgacacttgcaaaattctttcagggacacatgaaggtatggtgtctttcaggacatgggataaacttggaaaaaatatttttgaatttagagtattagcttgtctcatattcacgatagcattgatgggttttctgcaggaatgaccactgggacaccaattcatgtttttgtcccgaacacagatcagagagggggtgtaagtacctaagttttttcgcattaatgtattgaaatactacctccgtcccaaaatataacaacttttggctacgaatctggacacacaattgcccagattcatagctaaaaatgcttatattttgggacagagggagtaacatattaaagctggaaataaccatattcattcccacaggattacagtgaaatggctaaggcctacagaccttcacatgcagatgcaacttatgacttcaaatacggtgttagagcagtgcaggtactttttttcatgttttataatgtgtaatatagccattcattgaaccatcaactgtagtacctaaacttctcttatttgaatgtctaaaactgtggtacctaaacttctcttacttgaatgcctaaccaacatcttctatcaaccgaatgatagggaggtggaagatcatcagcaagagagaccattggaagggtggctgcaggagctcttgcaaagaaaattcttaagctcaaatctggagtagaggtgtgatcctacttggcaaccttttactcttaactgatcaagatttgtatcaagcatcgcaattgacatgtttacttatccatgaacaattggacgctgaagaaaaatgaatcagcattcgaatatacatcctaaatatgctgaagccatgcaacaaattctgtccaatgtctcatagcagcaaaatattttcaattgcagatcttggcgtttgtgtccaaggtgcatcaagttgtactaccagaagatgccgttgattatgacactgtaacaatggaacaggtctgtggttcccaccattttcaagtttaacacttctggacagtctctgaaggcatttgctgaatattatatttattttattttccagatagaaagcaacattgttagatgtcctgatccagaatatgcacagaagatgattgatgcaatcgataaagtacgagttagaggtgattcgattggtggtgtggtcacatgcattgcaagaaatgttcctcgtgtaagtatttaaaccctgcagttatgtttattttgatatatgtcctccagctaaaataaactaaataagctcatcgtttgcactctctgcttatgaccgccctgctttggaatttgcacaaaatctgtttgaacattgaagcttgatcattcattagaaaaatattttttctctgttgagctactgatatgatagagcaacgacaatttgtaggggattggctctcctgtatttgacaaacttgaggctgaattggcgaaagctatgctttctcttcctgcaagcaaggggtttgagatcggcagtggatttgcaggtaattgaattaatctgcacataattagttgatttattttttgcaaatagctgtgcatgccaactactttgctactggcctcaatactaactaataacttgtgcccaggtactgactacactggaagtgagcataatgatgagttctatatggatgaggctggaaatgtgagaacaagaactaatcgttcagccggtgtgcaggttttatcctagtcccctgttgttttacagttatattatttattgttttcgctacatctagctgcattctagattaaaaaaataatagtaaatagtataacaccgttgtcttagtatttataatgtgtatgtccatgca

SEQ ID NO: 12785 - DNA, 3696 bp, Oryza sativa
ggctctactacctccgtcctagaataagttaatatagtacgggatgtgatatatccagtataacgaatttggtcaaacacctatccagattcgtagtaggatatgttacatcccgtactagattaacttattctggaacggagggagtacctaaattttccttcccttaaccactcactcatgatagtataatctgacattttctcaatcaattaactcttgtagctgtgccgatggtggagtccatggccgcattagtcctcatggaccagctgatggcgcacattgctcaatgtgagatgtttccactgaaccttgctctacaagaaccagttggctctgccagcagcgtacctgcatttgcaccagatctatcataatgccccctcccccccccccagcttgtttatcatctatcatatttctgggttttctaaggggttcgcagttttgccacaaagcctgtatcctagtttatatctcgagttattgtacccaaggaatccgttatacagtgagcatgaagatagaaatgcgttcatgcgtgttttgtgatatggacaatctgtgcttacatcaggttattttgagcaataaaaatctccatttatgaaagagactgcctcctgtatcactgaagacgtattcatgaaacttcattacaaaagccaagtggagagcatccatcaatcatgagatggaggttttacatgtcaagcctatctatcccaggttgatcagagagtcaagaaagattatggagaaaacctcaagcgttggcataaaaaatacggcaattaggcccttcctactgagagatgtaatttttacgttttcaagagtatcgcataagtagcaaggtagtttacgtactccctcagttccaaaataaatgcagttttatcactgttcatgtccaacgtttgactgttcgtcttatttgaaaaaatattataattagtaattttattgttactagatgataaaatatgaatagtacttaacgtgtgactaattttttaaatatttttcttaaaattttcaaataagacggatggtcaaaacgataaattcggatatctatggctgcacttattttgagacggaggtaataccctataaagaatccgtcactgcccaaaatttaaatttaaaaattaattaggagttagttttcttttccaaaagcccatgcaatttggatacatggtcctttagagaaaaagataaattctacatgttgtcgctaccaaagagtttggttttacaaactggacaaagttacggtctacaaatgccaccttacaagcgtatttatagtcccctttttttttcactcccgttagaattactatgtcacttgacatccgataaccccgccaaaagaccattttgtccatacaatggaattttgcaaataattgaatggtaaaaagttttgcatattttgatatgccattctgaagataattttgcacgtgcaaatttggtagaaatataatttatgaggctatggccaaatatgttattattttaaggacaaaatgatctttttagaggggctagcaaatatcaaatgacaatagaaacgtgaaagaaaaggcttgtacgatgatttttttaagttctatcagggctttgcctagcagttatttattaagagcagaaatatatgtacaaagaaagaacagaaaaacaaaaacaaaatccctagaaattacaaactttgtaactagctaagaatgggagagctaagagtatccttcattttgcaagcatgcagaagaatttcattcttgaaagcatcaaccacctataatggtatttttgtacaattcaacttcgttgataccaaaaataaattttctcacggcataattatctttccaaactacttccttccatcctaaaataaagcaaattttgtagttctttcgtaccataataagttcattattagcatcttccattaatataagttcatttttagaataattgttgcatcaaagtttgtgaaagtacaaaataattgtactgtgagtagataaattgagaaatagttgcattgagatttgataacgtaggaatattttagtttttttcaattttatattggtacgtgtgggatgggtgaaaaattaatttattttgagacagaggcagtaatacctatccataaatatagacataggttatgtctagattccatgtataaatgttggtctattttgagacaggttatttataggttccatgtataaatgttgatatgttttgagacattaagtgctacattaggcatcacattttgttaagaaatcttgctaataatggtcagttttgtttcttaaccatcaggtcattaaacaaaaggcatttttttgggttgttgaaaggtcatcaaaaagcaaatccactccacccagccacaccggatttctttgcgttaatggctccagcggacccccaccaccttttctccaggggatttatcacctatcacatccagtggcctatcacagtcaataagtgcatgagctgattgatatgttgataagcagatgataagtacacgtacttatcactcctagggtaaggtgttccatctataaataagagcatccctgaataattttctcatccccttggtctccatatgctagctcgcatacgcggatctgcgccgtcagccgctttgatttacatgtaagggtttgcaaatgttttttttattccatttggttttgtatccatgaagatggttgaagatttgatttagaggggaaagcatatgtgattttttatcagacaaaaaaatctctagccttgcaagtatattaagatggactaaaagatttagatttttgtcatgtttatttcaaaaatattaacttacagatttattggtttcttctctaaagatatgtggttatctcagggttcatggtatcttcaatcgtttacttttttatcttatactttatatcaattatgttatttctcatcatcgtactttaagatctataatcattcctgacatactcttcacgtttacaaggtgatactactacgttttatagatcttgtgatttctcttctttctaggcgctataataaatttcgtgttcgagacaaataaggttttcggacacacgtagggtataagtataataacgagtacaacgtcacgtgtaacgcattaatactaccagagtgtcggatcgcttcgtccgctttcaatttttggaaacgtttaatttcgcatcattgtaccacttgttttaaaaaggcacatgtacaatagccatccaccacatttattaaggttttcaagtgatccgttcattcttcgctgcgcctgcgatttgtccgttctctatctgggcgtgtattactgtttcctttcccgataagaaaattttcccccgcctattataaataggaaaattcagggctcccccatttctaaattgttgacttaccatactacccctcgctcagtctcatcctcctccaggctcgccctcgttcctctctctctctcctcgcaaagcgatcgaggcaaatccggagccgccgccgggccctcgatcttcgccggcggccgcccccacctccgtcgacgagcgaagcggcgccgcctctcccttctaccgggccgacgtggagctgagcggaacggcggggagggggggg

SEQ ID NO: 12786 - DNA, 8124 bp, Oryza sativa
gtcaggggagatccacgcgagctgatctcttccgtggtggtaaagccctaactcgctcggatccatttcgcgctgattcgtgtcgctgaagccctaaccggccttcttgttctccttcttccgcagtgtgcgccgtgcgggacggggtcgggtcgttttctgtgacctgtagaatagggtagggtttgaggcttttgagcagaggcgcatccgccgcgtgggtgggtgggtgcggcggtggaggggaggatgtcgtcgctgagccgggagctggtattcctcatcctgcagttcctcgatgaggagaagttcaaggagactgttcacaagtgagtgtttcaatctaggctgaaaaaaagggtgaaattatcacatgtctgtctagcgtttgtttaactcagttggggttccggcgctgttgttcaggcttgagcaggagtctgggttctacttcaacatgaagtacttcgaagacgaggtgatcaatgggaattgggatgaggttgagcgctacctcggtggctttaccaaggttgatgacaaccgctactcgatgaagatattctttgagatccgcaaacagaagtatcttgaggcccttgataagtaagtatgggagggaacatgtccctacaggaattttaggtgctggagtggaaagcgttgctaactgggtttgtttgctgctctgcaggcatgatcgttcgaaggcggttgaaatcttggtcaaggacctgaaggtcttcgcgtcctttaacgaggagttgtttaaggagatcacacagcttttgacgttggaaaactttaggtatgaatgtaatgtaccaaaatggtggtctgacactttatttatgtacattagagcatggccattaattttgtggctgtaactattacttggttgctcagtctatggttttttattttgtcttgatagggaaaatgagcaactctccaaatacggtgatacaaaatctgccagagcaataatgcttgttgaactaaagaagctgattgaagctaatcccttgttccgtgacaagcttcagtttccaaatctgaagagctccagattgcggacacttataaaccagaggtagcacatgatggagaaacacggcttccccttacattcaatcatctggaattttgtttcttgcaatacagctggttacataagtacatctcatgagaggactttaactcatgtcagctcctgacagttccagtgataatgttatagtttataagccaactactttgttccacaggacccacaatttttttctcaagtttatttaaatcactgcttcttgtttagcaaagataacctgctatatttagcttgaactaaatgagcaatacggctcatttatgacactcatcctaatgaagatttctttttatgacatatgtggtataaataccaagttttaaatcttctgttgcattattcattttctgggatattggatagacatatagagcttgaagttgaaaacggaaaattatctaatgatttactcacgtcacacaccattgtgtggtttatctgtactgttttctttatatgttgcgaattacttatcactatttattatctgtaagatttggctgtctacttggtaggttgtcagaactcagaattagtgcttgctgattctaagttctagggataacttcacagcaccatgctgtatacttttgatttatcatatgtttaaaatttttaatgtggaggagggataatgcatggacctttgacttttttataatatgttgcagcttaaactggcagcaccagctttgcaaaaatcctagacctaaccctgatatcaagactctgtttgttgatcattcttgtggacaaccaaatggtgctcgtgctccatcgccagcaaacaatccattacttggatctataccaaaacctggaggtttccccccattgggtgctcacgcggtaagtccttttagcatatttggatgcttcatgtttatgtgaaggacacggttgttttgaaatcggttccattccctttttcagccatttcaacctgcacctacacctgtcccacctctggctggctggatgtcaaaccctccagcagtaacacatcctgctgtgtctggtggagctattggatttggtactcctacaaatcctggtacctgttctaattactgttacaaactattattaagtggtctaaattggaaacagcacacatagtctgttgattcatggcattcttcttttaaatcttgtagctgctatattaaaacatcctagaacaccaacaactgccaatccttctatggattatccatcaggagattctgatcacgtctccaagagaacgagaccagttgggatgtctgaggaggtatttgtcacatctctttgaaatacattttgctatttctagtgtacgctgacactttataataccattgcattttgcctaatcattattgacatatatacttgattgtaactataatgatctaattttgcaggtgaatcttccagtgaatatgttacctgtgacatatccacagagtcatagttacccgcaagatgattttcataaaaatgttgcacggacattgagccaaggatcaactccaatgagcatggacttccatccagttcagcaaactctccttcttggtcagttcttaaattcttgttgctttctcatgataaatcaaattttgccccttccatagcttctcatatacactgcttatattttagttggtaccaatgttggtgacattggattatgggatgtcggtaccaaggaacgacttgttttaagaaacttcaaggtttgggatcttacaaaatgctcaatggccctccaggtttgtccgttatactatgttatttgagtttttgttgctctttattagcctcaatctaactatgaccatgtaaaattgtaaattcttcaataggcatcacttgtcaaagaccctactgtctcagttaaccgcataatatggagtcctgatggaaccttgtttggtaagatgatgtggacttgtgccttttctatcctctacccacagtttctaatgtctctttttaacaggtgttgcttattcaaggcatattgtacagatctattcataccatggcggtgatgatatcaggcagcacttggaggtatgaatgcatattcgttgttcttctttccttttttgttttgacaggaagttcttccttcctaattggtattagtttcttattgtataatcgtctaatctgattcctgaatttgattaatccctcctttcttaactagattgatgcgcatgtcggtggtgtaaatgacattgcatttgcccatccaaataagcagctatgtataataacctgcggagatgacaagacaattaaggtgagtttctgtgattgcatgagttctgggactgaaagtctctttgtttaacccagaagtgctaagttttatgggcaccatattctaggtctgggaggccactagtggagcaaagcaatttacatttgaaggtcatgaagctcctgtttactctgtttgtccacattataaggaaaatattcaggtgcacctgcagtttttatgctataacgatcaatattaactattggaggctacttttccttacctgttgttatttttcttcgtgcagttcatcttctcaactgctttggatggaaagataaaggcttggctatatgataatttgggatccagagttgactatgatgcgccaggacattggtgcacaacaatggcatatagtgcagatggttcaaggttcataattatttctttgttagcatgattcatgtgggtaactgggtttttgtctttgttttcactgattctttttgcccttgtgagtaggttattttcttgtgggactagcaaggatggcgaatcacatctagtggaatggaatgaaagtgaaggagctgtcaagagaacttaccagggatttcgcaagcgatcgatgggtgttgtccaatttgataccacacggaacaggtttttggctgctggagatgaattcttgattaagatatgggacatggacaacacaagtcttctgactaccattgatgccgatggtggtcttcctgtgagtgttttcctttatctgtagatactttggtaaatggtgattggttcaaatgaaatgagtaaggaaatttccatcttaatctaacctagcatgcaattattaggcaagtccacgggtccgattcaacaaggaaggtactctgctggctgtttctacccatgaaaatggtatcaagatcttagcaaatgctgatggagtacggttgctgcgcacattggaaaatcgttcatttgatgcttctcggagtgcgtctgagactgtaacaaaggtaagttcttgtgaccatttaaaattacaactaaatatttttgcaagcttgacccaatagatccatcttggtgcagcccctaatgaatccattgactgctgctgctgctgcggcggcgtcagctgctgctgccgggactagttcaggaaatgctgctccaccggcaataactgcactggtttgaccatattcacaattccttttctattgatctttctctttctatcagaaaaccttctatagtgacccaactaacttgtacattcttggaaaaattctacagaatggggatagccgaagcttggttgatgtaaagcctagaatagctgatgagccattggataaatcaaaagtctggaaacttatggagataaccgagtcaagtcagtgcagatcattgaaattaacagataatatgaggacaagcaaggtgatattttatccctcttgttgcaatctgcagtataactgtctcagtggttctataaaattaatactttgtagtacattattaagtaattttttaggctgagttctttcctctcctttcccaactcatctccctctttttccgtgcacacgcttttcaaactattaaacggtgcattttttttacaaaagttttcaataggaaagttgcttcaaaaaatcatattaatccattttttttaaaaagctaatacttaattaatcatacgctaatgagctgctttgttttgcgtgcaccaaggattagttcccaactgtgtctgccgaacacagccttagtgtgtatagaacaaacaccatatgttttgacaagtttccatagctaatattatttgatttattgcagagtaggggtgggcataaaaacaccgaaaaccgtagaccgaaccgaaccgagccgaattggtggtttcttcggtcttcggctgcttgcttgctcggtttgattttttacatcatttggtgtgcggttttttcttcagtcttcatctgccataaaccgaactaccgagaaaaccgatctgtgtgtgtctccctcctggcccaactacacaaggcccattaacttttccccatatccctaatttgtgcgtggggtcgtgtgggattcgtgtggtcgtgctgctcgccgtcgcggccgagtgcagcaggggttggcgactagcgctcctggagcttgtgctggacgattaagcagctttggtgattagtggttggacggtggaagatcagaggcatgtcgtcatcatcgagcgagctccatggctgcgtgtgcgtaggtcctcgttgagcgcggcattcttcggtaaaaaccgaaagctgataaacccgaactgacattaatcagttttggaaagctcagtttttatttttccatagctaccgtcggttagtattttacataaaccgagttatataaaaaacctaaaagaccgaccctattaaaccgaaaaaccgagtgcccacccctattgcagagtatgattgttaattgaactaaagccactgactgtttccgtgaatgatgcttgcccaatagaatgaaatgttttgtcacctcatattttgactagcattcttgagattcttctgatccacatccaagtaccaactgctggtttttatctgtaagggtttccatagatcttatttgttttgaactgcagatttcaagacttatttacacaaattctggtgtcgctatcttggctttagcttcaaatgctgttcatctgctctggaaatggcctcgcaatgaccgaaactcaagtggaaaggttaaatctggattatttacgcacataaatatgctcagttttacctacctgctctgtataccaggtccaggggcaagcaatttgtgcatatgattgttactaactttttatgtttgctattgactcttctaggctactgcaagtgtttctcctcaattatggcaacctccaagcggcatcctcatgactaatgacataactgacaaccctgaagaagctgtccattgctttgctttgtcaaagaatgattcatatgtcatgtctgcatctggagggaaaatatctctgttcaacatgatgacttttaaggttagttacaagtttatttctattgtttgtctcttatgtagaaattgaactttaatcatatggtgactgcagacgatgacaacttttatgcctccgccgccggcggcaacgtttcttgctttccatcctcaagataacaacattatagcaattggaatggatgactcaaccatccaaatctacaatgttcgaattgatgaggtattagcacatctaatggcattgctctgcgttattcttataaaaaatggaacaagattcaatcaattttttttttgattctttgcacaggtcaaaagcaaacttcgagggcactctaagaaaattactggacttgctttttcaaatgtattaaatgtgttagtctcttctggagctgatgcgcaggttatttactgaactatcaactcacaccatagagcaagccacttctgtttgtctttactgtttatacttttcctccttgtagatatgtgtgtggagcacagatgggtgggataaattaaagagcagaatgttacagataccatcaagtcgtccatcatctataatcttagacacacgtgttcagttccatcaggatcaattgcactttcttgttgtgcatgagacccagattgccatatatgaaactacaaaattagaacccgtgaagcaggtaaattctctcttcacgtgcagttcaagttaactacaaaggctatttcattactcaccttaactttactttcagtggcctgtccgggagaactcttctccaataacgcatgccatgttctcctgcgatagtcaattgatttatgcaagctttctggatgccactgtttgcatatttaatgcatcgagtttgagactccaatgtcgaattcttccagcatcctatcttcctcagaatatcaggtattctacaaaaactcaacaggacacaatatatcctttatatattctaacttactggattaaattggtactcttgcttctgaaaacattttgtcttgctgttctcaatcaatctcattagtttagtcagtgcactagcatattatgctaagaaactaagaaaatatagagtcgaggtaattgaaaacagtacttggggtatcaactacgaacacacatagacagaatagctgcaataaatcactaagactaattggactttgatgaaatttaccttaagcaaccagatctttacaataaatagttgtgtcaaccaatcctaggggatgagagatgtcgtaattatctttcaatttttttggcttatttttcacatttgattggctaatatatttattgagtgcattaatacatgtccaatgggactgctgaactgaaaaagaagtttttggaggaaaagtgcatattatctttgtttgctcagccaatgtttcttttgttcaaacttatttttaacagacaagttattaaccattatatgttccttgtttcctagctcaaatgtttatcctgtcgttgtggcggcacatccttcggaagcaaatcagtttgctctaggcctgactgatggtggtgtttatgtattggaacccttggaatctgagagaaaatggggaaatcctccaccagcagagaatggatcaaccagcgctttgtccacacctcctaatggagcatcaagtt

SEQ ID NO: 12787 - DNA, 3829 bp, Oryza sativa
catgatatatagaacaatcataatgcatcacttgcaatgattagtgtgataaatttaccactccatgattagtttgattaatttaccacaaaaatatctactggattcctgagaagtgtttttgcacgcatgaagaataatatatgttctccttttctttagttgaggatgcacacattttggttgacattagctgatatccaaacctcacctttttcagcctgacccctcttttattatgcagacgatgcacttcactcttacagcttcccttccgtagagctggttccaaggggtagtcgatgaacggacggaataaaaagacaagcttaacagcagttcatttgttgcttatatgtctcactgttatctgtattaagtgagggaagagttagtcctagtatttaattttgctgtctgtcgtgctgtgaaaaaagatgtttgcaagtagcttaagctgtagcaacaatttgtctgaacttattatcaccttttattcacaactagaaagtaaattgctgctcctatcgtttgtgttcatctctgttctcttgatgcatgtcttgcgctgtttcatccagtcgtgccacccgcgtagcacggtgtcacaatgcagctcgacctttacatatccactttgctagattcaattgctatttgagcctttgccttaaaattgctggggggagattttacgcgcatgggttatggtttctctatgctgcagtacatgttgacatactgccgtgccatgccagcgaaacaacggagcatcagccgcttttgcagcgtgccgtttcatcgccggccaaagcaggaaactctgacaaagctatcactaccatatgtaccttcacgtactactccttgtcacttaggtttgctgcgtgctagctgccgcccttcaattcttgcacagctttcggcagcaaaggataaggccgtggcctgcgtagtacgttcgtaccacgtatgtatcgccggaaatatgtacatcggcgaacaaaaggagaggcgatcgctaggcaggcatggaaagatttgaaagcgatcgagcccactgccgcgtcggcgtcggggtcgtcgttgcacgcacgcacgcactggggcgggcagggcagccagatcagagacgctctcgctggggaaagggatgcaaaggactggatggtgttttggcatgcatggctgaatgccagggagagacatggtcggtggatcgccatagctgggggcagctagcccagctgctgcactgcactgcactggttggatcagtacatgtgaccagtgtggtacagcgtactagtacgtgcagtggtagtactggtacttgggcgtcgcgttctgtttatcgccctcgtacacgcactactacgcagcaaatgcgaagctgcccaggtggtcatgtggccatccgctagatgaccgtacgttcacgggggacagtcctgtgtacggtcgacgcaggagaggtggagttaggctgtgtttagttcagcgtaaaatttgtattttggttgaaattggagatgatgtgatcgaaaagttgtgtgtgtatgacaggttgatatgatggaaaaggactgaatttggatccaaactttagatctaaacacagccttagagaggagttggcgtgagtacggctgagttcagtactttactcctaccatcacataaaaaccaacatagtaaccaatattataacacattataatactgcgaatcttttgtttaaatttatggtattaagatgtgttacatctgatattagattagttttttttatgagacgaaggagtagaatgttagcagctgattagttaagtactactccttccatcccattttgggtgagacggtggtataattgttataaattttcaaaacagttttgtttatttaaaatatatatatatagaaagcatttgcactaaatatagctttagcaatttggaagtatgaagacaaccgggtccatcaactcaatatcttgaaattaatcatccacggctgggagaatcaagataatttgatgcagtacttcaaaaaaaaagttaggtcactttcaaactgaatgatggatagattatggataaaataaaattgaacatatagatggattaaatacatactccctcaacaggagcatgtccagactcgtattattagaatatattatagtattagaatatatcacatccagtattagatttgtttttataggacggagggagtataacctagaaaaggttatctaaactatgctgatgtagcaagttcttaaggaaatcatatttttgaaagtgtgccacggataccatgtagtatgtatctcaatcgactacttagaacaatcctactatacattttgactcactcatccgatcgacgaacgactgaaacagtggaacactgaagtgcggatggcgtgaggctacactatgacttggtccgacgcaatactacttccacatcataggcaagcccatatatacagtaagtttaaacttagagagacaatgtttgacatgaccgcacgccgcttctatttttagggggggggggggggggttatattaatggagttattcatcaggcctagaaattcagaacctaaaatactaggaacaaataaatatgcggctttcttataccttttgttatgtcatgaacgtgtatattatgccatgtgtgtagcatttagaaacaaggggagtatcattttatttctcagtctatttctccatcccacctgtaacaaaatataaggatttcattgaattttaactttaaccttaatttctgctaaaattcttactctagtactagtactttcgaggtggggggagtactccacccattacctacagtaattctcctcattgatgattcgtccatcgtggaggacaaaaattgcagtggcaggatctggctgctctactcccactttggatgaataacaattgcagcagtggctgctgctgctgctgctggagcagcaagttttccgcttttacagtccggcacctggggaagctttcacggctgcctcgcgatcatgacggagaggaacgttgcgtttcaacgaaaacagaggaattgacatgtaaagattcacaaaactggtggccagtgagctggagtacgaattaattttccggtcgcaaacacgctcgcaaggagccttaatcgcaaggcggcgacgtgttaagcaacgagatagtcagaaaaaaataaaaaaaatgaaaaaaaacggaatggttagggtaattatcaactgattatgggcctgttcactttgatgccattttcaaccataccatttttttggcaaagttgctaaaaaaatatctacgtttagttcgtggccaaatcttggtaaatacaaatttgataagatttattttggctacaatctgaacaagtcctatgtgctggaaatggcttgagatctcagggtcatggcccaaacttctatgccggcgttaagttctgtgatgtacttcctccgtcctataaaatacctaattcagtgtgtgtccagattcaaatctagaattgggtttttatgggatggagatagtacggttggtttggtcaaaataggtgggcaattttggcgcgccaagttgtaaaaatgttcatcggaatcgccgtcgttttgttctaaggtgaggtgcttgtatttacttctacaaaaaaattatgcatcgtgttgtttgatcaaacttagaacaatagtctatgtgaacttgattgctgacaccagcacgtggcactctctcagaggataaagtcacaccattgttgatggatagacaat

SEQ ID NO: 12788 - DNA, 1667 bp, Oryza sativa
cccccccccccccccccctcaatttttggcagcaatcacacatctcagaggaaggaatctgcttcaatttctagcctcctggaattgttgcattggatggaaatttgggcagtcgtctactgtcgagaatctctgcgcatcactgtgctagctaaaatacgtaggagtagaaaacaaacaaggtaatgtaaccactcaggagcagagtgtattttggacatatgaatgcagaaacatatcatgcactatacacatgtgactgtaacaggctatccgatggcatgaaatcaccctccatcaatcgatttccgtggtgtaatgtaacttttgccggacacatcaaccggcaggttgagctttagtcatctcttgtctgtcgccgaaagacgcctcatccactcaaaattagtcttgactttttgccaatgggtctccgtttcatcagttgaaatcgacgtttactaatgcaacgtagtttattatcaattttttttaacgaatcgggcagggtgccaatttcattgagtatagtagaagaaaaatatttctgtactaagtataatggaaaaattgtacaagggtgttcacgctatggtatcatcaatgagaggtgcttactgatcaagttatgggctcttcggcaacttgccggtggtccgtgtcgctcccgtcccaggggcgacccggacgacgaaaaatcctccgccgccgccccctccctcctcctccccttcgtcttgccgccgcccgagcggctcgtcggcaatgccggacggccacaaggacggcggcggcggcggggcgttctccccacaaggatgcccagcggcggggaacaccgggggcttctccacggtggcgggtcacaggaggtggtggctggacggtcggcgcggcggattaggccacgccggttgcgaatccaccttcctcgacgccggatctagcctcgccacggccagatcgggtctaggcgaccccgacgatggcggccggaggaggcgcgacgtctcggctatgctgggggtggtcttcgagcggtggcaggcggcgaggctagccccagctcgtctcttccccctctagctcccagtggctaggacggcggaggaggggaggtggaaaggcgttggcgacggagtcccttcggacggcgcgctagtacaaaaaggctttttccatacgggcaaaaggcatctttgcatgcggttggggcaaccgcatgggagagaaggtctgtaaaaatcacccttttcgcatgcggccggcccaaccgcatgcgaaaatcccattttcgcatgcggctgcttataccagccgcatgcgaaaataaattcagcaaacaaaaaaaaataaaaatccaaaatatcctaaaccctagcccgccgccgcatggtgccggattcatcgcccccgccgcccgccgtcgtcgccggcaccggatccatcgctcacgccgcccgccatcgtcgccggcactagatccgtctcccccaccgcccgccgtcgtcgccggctccggatccgtcgcccccgccgcctgccgtcgtcgccggcaccggatcgccgcccccgccgcccttggcgctggatccgctcgaggcggcagagccgcccccgccgccgcggcggtgaggaggggggaggggcggtgaggaagggattgc

SEQ ID NO: 12789 - DNA, 4377 bp, Oryza sativa
tgcacccccattaaatctaattttgtggtattaaatgaactaatgtgaaaaggttgtcaaaaacaaagttgtagagatcattgagatctaccaattttcttttggtcatttctccatccaagtttgattgagctatataaaatttgaattttaaaatataagaaattcaaataatattttgaatcaataaatgatttcaaattgaaaagttgtgatcaacaaagttgtataacttatcaagatctataacttttgttttggtcatttttctatatgactttgtttgaacaatttgaatttgaatttaaaattataacaacttcaaacaacattttaaaatactatatagtttataaaactataagagagatgtacattttgtgatcaatcttacaaaaatctttgtcggatgaaaaaaatgaccaaaataaaagttatatatcttgatgtgttatacaactttgttgttgatgactttttcagctgaaatcaattactgcttcaaaatattatttgaagttttgaaattcaaagttttaattgataaaataaagtcacaagaaaaaatggccaaaataatagcagtaagaacacaataacatgatagaggatgattttagaaacatttagaaaaaagaatcatctaatttggagtgcatatgagtgagatacactagtttcaaattttttaaattttatttttgtatatgcctccttaaagtggcccgtatggaaaaatcgattttcccatacgggcgcttaagtgagccgcatgcaaaaatgagctcatttttgcatgcggccgtcttaagaggcccgtatgggaaaatcgattgttccatacgggccactaaaggggccgcatgcaaaaatgaccctcgatttttgcagacgccactagttatggtccgtttgcaaaaatcaaggggcctcgtacagaaaatacacttttgtagtagtggcggtgggggcggcagaggactgcggaggttggcggcggcccgactgctcccgtcggcggaggcggccttaggggctgctgcggaggacggtgatggctctcgtcgacactagcggccctaggggttgtggcgacggcggttccaggtggtggcggcggactagaggttgcgatggaggacgggggtggctcccgatggcgttggcggccctaggggctgtgctggtggctcccatcggcaccaacaaccttagaggttgcggcggaggacagcggcgtctcccattggcgctagcagccctaggggctgcggcggctatcgtcggcgccggtggccctaggggctgcggtcgtccaggacagcggcggttcctatcggcaccagcggccctaggggctgcggcggagcatagcggcagcactttgaatagtggatgtctaggaattcggtgaggtcaaagtcgatcccgtcggtttgtgtctggttggctagttccgactatacgacaaatgacgacgattgagagtgggctaacaagctgcgtgtgacgtcagctcacctgaaattgatgaagattgcaccaatggaggtttgcatcgacggtgcactaggggcgaaggcgactggtagacttccactagtcaaatctggccgtttcaagagactatggcaggatgcagagaagcaggatgtgccgaggtcatttggttttgttttcttttttggttgtgttcttcttcttgttgaggtgtgagcctaagtacttttgtatcattttggctgtatatatccttcgtggatatagaggctagattaatggaaatctattatctaaaaaaaaaagttatgggctcttcttttgctcccagtgaaataccggaaagctccttgtgcaaattttggtctctgttctgcatgacaagccagacgagcattttgcattttttttcaggccccatggtttacatatatatgaagatgttgaagtttggattgattgaccccataaacgtggtaaaagttttgtagcaatttgattggattgaaattgaattgccccaggagccatgaaaaaaaaagtttcagcatacaacatactaggtgcaattttgaagggctcttggaggaattaaacaaaattctatgaaaattctgtaaaatttatactgtgttttacggagcccaaacattagtccgttaagacgacattatgcatcaagctagacaatatattgccacgagcctttttctaacctactggctacaaacccacagaaccccttgttatgtgctctgcacgtcgcgggaaagaattgtcattgtttgctgggacagcatttctcgtctttcgatgcaaagagagcacaaaaatttgggaaaagcagggcgcagattaaggggaaccagataacctatccgtgccagtactaacgaccaaacggtcggttctgaaacgtgcactttgacctgtcaaatctcaagcaaaggtgaatttacccggtggagttcatgtttaaccgtgagggagagaatgcctctgtggatataggctgcgtttagttcagcgtaaagtttaaattttggttgaaattggatatgatgtgactgcaaagttgtgtgtataacagattaatgtgatagaaaagaactgaagtttggatccaaacacaaccatattatggatatatggagcatagcgaaatggaacccacgcggcacaacgtgctaaactgctactctatggcatttggatatggagtagaatcaggcctatatttagtaggaaaaaaaaaactagtactatatccgtatcggtacaactctgcagatcatttcaaagtttagccacagaggtacagtcaaacaagtctacaaagaccgtgtttaattcaccctaactacccccaacttccaacttttcatcacattacatcacatctaaaacttttctacacatataaactttcaacttttttcaaacttctaacttttttcaggaactaaacacagccgaagggtgtgtttagggcccgtttagttccccaaatttttttcccaaaaacatcacatcaaatctttagacacatgcatgaagcattaaatatagataaaaagaaaaactaattgcatagttatgggggaaatcgcgagacgaatcttttaagcctaattagtccgtgattagccataagtgctacagtaacccacatgtgctaatgacggcttaattagtctcaaaagattagtctcgcggttttcaggcgagttctgaaattagttttttcattcgtgtctgaaaaccccttccgacatccggtcaaacgtccgatgtgacacaaaaaatttcattttccccaactaaacacacccttagttcacgccaaaattgaaaatttgattgaaattaaaacgatgtgatggaaaagttgaaaatttatgtgtatagtaaagttttgatgtgatgaaaaagttaaaagtttgaaaaaaaaatttggaactaaacaagctcaaaaggtgaatgatgtccgaatcaaaatttggaactaaacaagctcaaaaggtgaatgatgtccgaatcaaccgtgataaaaatgtggctgctactaactaaacgcacctaataaaaaccctcatttcataacaagaatgatataatatgacaaaagttatcgaaacctgcttcccagccctagttcttaaaaataaaagttatcgaaaccgaaaaaagttcagcattttttcagatccagctaataacagagacgctatatagtgaaggatcatgaagtggttgttggttgtgttgtgtcgggcatttcacccaagctgtaacaccttgacgccgacgcgaaagtgatggtgagcactgacgcatacagaaagaaatagtagaactttaaccccttttagtttggcaaaaagaattttaaaggagagtctgttttcataattccgcggtaatgagggtttgagccttttcgtcttcatgttagatccgcccctcgggacgagcaacggagggaggagatgtgatcgcgacgtggtgttcagcgacagcaacagcgatgccatgccccgctcggtcgcgagcggtagtagctccgtgcgttgcatgccgtgctcctcccgctgccgcctccgggcgataacaccaaaaaatacgacctgatccaacaaaggcggtgcaccaaacaccgtgcaaaacctcaattactactgccactgatcggtgtaccactaaacctccactgttccgtctccacaacctcaaatctgcaccggtacgacgtttccgggttgcagtttttgacgaccaatccttgcattccagacagtacgtcgaacgcaaattctagtaggagtatatatacctattaagtattaacggctgtgatgaatcactcgggctgcagga

SEQ ID NO: 12790 - DNA, 2247 bp, Oryza sativa
cgcaaattctagtaggagtatatatacctattaagtattaccggctgtgatgaatcactcttcttttatctgtttttgacatgaattcagaacgaggagataagaagactgaaaaaaaaggaggggcaaaggttcagggttagtagcagggtgctgtaacaactaacaaccgagtggcactaatgatctctgtcggttgacaaagttacggacgggcgccctattccggcatcttggcgtttgatgtgatcctctcttcggacagcgaaatatgctgcaaactcccaaacccaacaaccagcaatcatggggcagccaccgcccgattcccatcacggtctccaaacacgacgtgttcatctccaaaccaaaaccaaaccaaaccaaacccaaaaccaaaaccaaaaccagaaccaaacctgcttcgacaagaaagatgattacaacatccaagaacagccgagatgtggcctccaatcagatcatgggcgttgcaatcaacaagtgctgcgagagcttagtgacagcgaccacgcgtgtcagctaatggggcgttgcacaaacagtagcgcgactatgcaactgagctaagccgaagaaacagctcaaagtgacaaagctcattattgtcatgaaaggtttgcttaattgtttctatgtggctgccgacggtttgagaagagctgaagagtgaagagttgtgtgtgtttgttgctgtaaaaacaaaggttacttgatttagtgtacttggaggaatctttagacgctttaaacaacacggtgtacgttgtgatcaggatcaggatggcgatgggacatgcatgtacagttctctcctttttcttatcgcagacaaagatctgaaatatgtcttcccttttttgtttgcatagggttgcttctgaagaaaatacagtgcagcaacatggctgaaatgctgaacgttcatgttcatgaccgtgtttagttttttcatgaacaagaagaagaggttcccagacataattgcaggtattaggtaggttcatccagatgtctgtaggaactgatgaatgctcaaatggaagtatatgcaagtagcagaagcaagagttgacatggttgatgggtcatctagtcatcaagcaaaggtagtggaaatgacaaagatattcagatattcagtactggaaatgagaagtactttgaactggaaatgcattcagatattcagtacaccacaccactgaccacttggtaggtagacccatgaaaattgatcttctgaagatcaccatcagatatcgccgttgcatccacttaccaaagaagattaatactgaacaccaacatcaaagtatgtgaagagaaaacaaagaagcatatgattctgaagaaagatgatactagtacaattctatgctaaattgaaatgaagctgaaattatatatcacagatgttctttcatattttctccaagtcgaatttcccattggcaaaatgcttcttggagcaatgccactctgccacgtaaaaaatgcagcaggattccagcgaaagcaagaagaaagagagggcctacatgtccttactccacagtgcacgcggccaccggctcagcccatcgccgccaccgccgccgccggcggctgcttccgcggcgcctgcttgaacgccacggtggggccaatacgggagcccctgctgcgatgctcggcgacgagctcggcggcgaagcagtccagcctctccgcgttcgtctgctcgccgacacgcctcccttcgaacagcaccgactccacgttccggtgcttcagcatctcgtccgccgccgcgagcagcgcgtgcacgttcgccggggttgggtcgtactccccgtccggcccgcacggcggcatgctctcccgtttcgcctgatcatggcggagaatttgtaccagggttaatccgagggaacgttcgttcgaaatgcgcaatgcagtgggagaatttgctcacctgaatgcgcaggtagttggacgagcggcactgcccgaaggcgcgcgccacggcgtggtcgacgaggtcggcggcgccgtcggcggcgatgcgcgcgatggggcgcgcccaatccttgggaccccagcggcgcaagcgtcggaggtcggcgtcggccgcggcccccgtgccaccggcggagcatcccccgatggagagcacgaggaggtcctcgacgccgcgcacgaacgggaactcgtgcttgttgtgaagcacgtgcgtgattgcgg

SEQ ID NO: 12791 - DNA, 1797 bp, Oryza sativa
accacaccgcgcggccgacctcgaagaggcggaagtcgtagctctcgctctccagggcgtcggcgcgcgagaacacgagcggcgcggacgacttgaggtcgtagcaggagatgagcacgggcttgatggtatcccgcagggtgagctcctcgccgaacgccgtcttcatggccgcgtccagcgccgccgtcggcgccgcgaggggccgcttcttgggtcggcagaagagcgacgtcgagccgccgcggccttgcggaagagccggggagcgtggtcagccacgaggcgccatgtgtcatcggcgtggaacagaggcgcgccgcgcgagtgcgtcgagaacagcatcgcggcgaacacgccgccggcgcccgtaccggcgacgaggtcgaagtagtccgcgacgcgggcgtccgggtcgcccgacgcgcgccggagcgcggcctccaggtgcgccagcgcccggccggagagcagcgcccgcagcccgccgccgccgccatccacgcacagcacgcacaccttcccacgctgcgccgccttccccgacggcacggccgtcgccgccgacgcctgcgccgccggcgccttgggcagccacagctggtgcgggtccgtgtacccgaacaggaacttgctctcgaggatggagaaaatctcgtagctgagcttatccgtatccgcgccgcctccctccacctcctcctgcatcctctccacctgcatctcctccgcctcctccatgccaattgccaaaaccccccccccccctcctctctcccttccccctacaaagaaacaatcgaatcgcaccaaagaaaagacagaatcccttgatgattcgcaaggattgccgcccaagtctgcccacttcgctttgcccctctctctcttttgagatcacagccgatggtcgattggtctctcaactctcaactcaagccacacacacacaaacacacactctctctagtggccggcgccttttgattcttgcgcagcggcagagcacgcgaggaaagagacgaccaacacagaaaggcgcgcgcccgatagagagagagagagagagacggcgagcgcgagaggaagctaaagaggaggatgaggagaagagaagagaaagaaggaaacaacaacaaaggtcgtcgtcgtcttcctctctctctctctctctcctttgatcgtgtcttgctgctgcgccgtaaccgatggaagaaatgctcccgcttgtcctccagcgcgtggacgctccgcaccaggtcgggagacgtggaggaatctcctccgtccgccgctgcctcgagatccgcgggtagacccccgcgccgtgcaccaggtccacgagtagccgcggccgccgcgcgcgcggtcgtcacctggggttcggcggggtgattaaacatacaaaaagtaattaaaagcgaaggaaggaggtgattaatccggattaaagatgcgtggtcaagtgaaaatcatctcggaggcagcgtaagtggcgagttaataatgatggctgccgttggctgggtgaggtgacgacgtggacgccagttcatcagctggggagcggggtacctaccttgcatgcacccggtccacagctaagccgcgaggatgatctgtcgggagcagaagcaatggacatgtcagcgtgtaggctctgctttgttggtgtggaaacagtagagctttttagccgaaggctgcaacctcaggtaggattagacggacctgcgcctgcgtgtccccgtgtcgcgtacgatccgttttgctgctgtggtgtaccaaaggctcggt

SEQ ID NO: 12792 - DNA, 5081 bp, Oryza sativa
gcgccgcgccgaccaagcaggcaaggcaagcacggcacggtgcgtgcacggcagcgaaggcgccgcggccggtcgcggaggctggagagggggaggcggcacgtacgatccgatcccctgtccccgttggtggcacgagggcaggcagccggccgcacgctattcttttggcctatttagtttgatgctattttcaaacttatcaaattttggtaaagttgctaaaaaagtggctatatttagattgctgccaaattttggtagctatatagaaaatcctgctaaaattttggcaactatgccaaaatttttgtaatgccaaaatttggtaaggtttttttggcatcaaagtgaacaggccatttttcttgtcaccgctgcttccacgatcgggagcgtgggggggaaggcggtgtggacatcccgctgcgcgtcgtagatcttgtttggaagcttctaatggctataggttctcctataatcttcagctatcagaagtttcttctaacaatttagtttgtcgtacagattctaagaaatctaaaaaagtaaattaggccctgtttaatacagcttaggattattataatatggattattaggagtaagctgaaaaaccagatagcttattatgatatattattataatttataagccaagttactataatctggtaagccactctaaaggtgcttattttagattattgggtgactaacaactaacaaacagattataatctaacttatggtaatctagttctataatctagattacaataattttaaactgaaacaaacatggcccaagatagaggttgtataattattatttttttaagatttccacaaactgaacagaaccgtctcgtccgcgcctctcccggtcgtcggtgtgggactgcatcgtgagactagcacacgcgtgtgccggtgtgagcggcggcggtgatggatggaatgacttcctcgttgtcaacgagctgaggcaatgatcaacgtcagggcggcgtacagacgagattgacgagctgaatgcacggtgacatacaaatttaatttcacgataagctagctaatttctcatcaaataggccttggtttcttttctcttttttttttttgacaactgctcgatggggaattggggatcgtgtgcatttacggggtacgcaatagctaccgtaccgatgcattccggaatgatttggtttgctataattaatgttttgtactatgtggttcatgtcttgcttgatgtcgaagttgcctgatactatgagtgagagtaaccgtggaggtacggggagacggatagagagatgtcagtgataaatgcatggtgcagtcaattgtagaggatcctgatcgcaggaaaacagctacaagtaggagagtatactacattgggtgcatggtggtggtactcaaatcaagtattgttcatcttttttactacctccgttctaaagtaaattcatttgtcatccatttaatacataccaatacaaaactaaaaacctaaaatatctctgctttatcaaatcccaatatataaccattcctcattttatctacttcaaacacaactattttctactttcataaactcgaatacaatgaccactctaaatattttgggacaaatgaaatgagctaaaataaatttattataggacgaaggaagtaagtatacttctattttaccaaaataactgttattatacgggttgcagaattgatatgcttattatgtaatcgtctaggtctatcgggtgttaatttacgaccctgggcgacttaggtgagagttgtttccttctgattacaaaaggcgtatacacacaactgtgacttattcaagagtattgcattattgtaagtgctgttattaatagtctgaagcttaggtgctgttattaatagtctgaagcttaggtggccctattggaaaatactgcagctcgtgcagtttttgtatggttatgtatcaccaaacgtgttaaggtgttgatccacgcacgtttacgtatagattaactcaatttcgtttaactatcattggaattaaaaaaaaagaacctgtgcgtctttaaattaagaaacaagataagcagacaagaaaaggaacagctgctcctcagcacatagaagttagagaacaacacgagaccaactttacataaacaactacagtatcaagggccagatcacattaacaaaaaaaaaaaaaaaaccttatcgatacactgcacctgcaagagacaccactgctgctagtactaatttcttcctgttattgctgaacagagccaaacggaagttcccgatttcccggttcatatggaatctggtataagaacattgtcctacctgacaagcttgccaagtgattgcatcctattatatggcgaaggaatgatgggagtagacggtgataaaagtagagcaaccaacaaagataattaagtaattaactacacctctaatcatcttggcgacaaaaaaaaaagggaataagactataagaggagttctccagcatgcatattgctcaattcgcgtctaattttgatcatgtcgccaacacgattcggattcacctaaaaaatttaggaaaaattgaaaccatgccattataattttacaaaatttgatatatgacatccttacaagtcattgagataccgatgacatatctcaaactttgcaaaattataatgacatggttccaaattacccaaaaatttacggcgagtcactaacaatcctaatcttgagaaaaatcctcaagtcaagtttagaagatcaaattcaggtagcggagctcatttacataaattgagacaaactcccgtcttatagatgtaacggaagattcacaagacaaatgtttaaagaggattcgcactctcacatggaggatggatgtcttacaacgcaaacaggtgaagatgaacgaattacataaaaagtatatacaaaactgattgaatgattctcaattagctaatgcgttgagtgcagcttatctcttaattaaactagccatgaacgttataaaagggttggtcttgcctttcattgatccatctccatgtcttactaggacaataaaccaattatgactcgagagaactcaaacccaagcaagaaagtatgagaaccggcaaattaaactcagagtcgactctaccggtcaaatgttattggttcgaccagccatctgccgtcggtcgaaccggtcctaagccgactgttagatcagcttcactcacgcaacacaccctgaatctttttcaaactttagccgtgtttccttttttattttggacgtcaaatttgaggtttaatacagatatttacacaacatctctatttcaaaatatttaagaaagcagacgcacggatagcaactggagcatcgtctagaatcacatggtagctaaccttttattttgaaataaagtttaaactctataagttaatttattttgccacaaagggaacatatataaatagtgcgtaccatatgcttatgagatgagccgaccacatatgaaaaagtaccacattaatttgatctaaaatatagaagtaatcaaaatttgtttaaaaatcaggcattttctctatcaatattctcttcttaaccaaacaaaatattctcctatttaattttgcgatctatatattttatcttcgtaaccatttgtaacattctttgaattaatttcatgtattatcttcgttgtagaatatagctacgtagaagtaagcgtagctcaactgattatgttcctatggtgtaaccatcccacctggactcaggtgctagacttaacatgggtagttgggtactcatatttacggctaaattattatctattatattattaaatgaatagaaaaaggagcctctatgttcgctctcatggcctagaaattctcacattaatcagagaaaaagaaaaagcagagtccatatagaaatacaatttagaaatagctaaaattcggaattaaaaaataaggaatattagaagaggagactagagtccatatataaatacaatttagaaatagttgaaattcggaattaaaaaataaggaatattagaagaggagactagagtccatatagaaatacaattaggaaataactgaaattcggaattaaaaataaggaatattagaagaggagaatagagtccatatagaaatacaattaggaaataactaaaattcggaattaaaaaataaggaatattagaagaggagaatagagtccatatagaaatgcaattaggaaataactgaaattctaaattaaaaataaagaatattagaagaggagactagagtccatatagaaatgcaattaggaaataactgaaattcgaaattaaaaataaggaatattagaattggagtatagagtccatatagaaatacaattaggaaataataaaaatttggaattaaaaataaggaatattagaagtatagtatagagtccatataggaatttaaaactaactaaaatttgaaataataaacataataaaattaaaagtagagtttagagtccgtataaaaatacaatttacaaataactaaaattataaattaagaaaaacatgggaagaagagtttaaggtcaatatatgaatacaaatataggaatacaatttagaagtaactgaaattcgaaattaaaaattaaagaatattgaaaaataagtttagagtccacatagaaataaaattagaaataataaaaatttagaaataaaaataaataatattagaagaagagcatagagtctatatagaaatacagtttacagaaaattcggaattaaaaaaaagaaatattaaaagacgagtctaaagtccataaaggaatatatataatttacaaataactaaaatttgatattaaaaataattaataactaacacgtatataaaatataatatgaaaattcagaaataaaaataaataatattcgaagaagagcatagtgtctatatagaaatacaatttacagaaaattcggaattaaaaaagaaaggag

SEQ ID NO: 12793 - DNA, 4332 bp, Oryza sativa
ctaacccatacacgcagagcaaagacccacgaggggtcggggcgcctcggccctcggggccgaggcgggtgcggcccgaccccctcggggagacaaagaggagggcgaacacatcaccctcgggcccgacgccccccgagggtgccaggccacgtgggcgattgtgtctgcctcaagcctctagtcatgatactcccggtcccatgtcaccgacagtagcccccggcgttatgccagggcgatcgccctccccgagggaagcggtcgggcgtgacgccacttctaaggcctggtgacaggtggggccggttcctacaggtgccgtcgaacaacatcacccagagggcggtgtgaggcagctgcgatgggctcgagctggcctcggggacggagacgagctcgggagctggggtccactccaccacaaagtcggcgagggcctggctcttgatcgcgtggcttggttcaaagcgcaaatcgaattcagagagttcgattgcccatttcaccacccgtccagtaccctctcggttatacaagattcggccgaggggataagacgtaaccaccgtgacccgatgcgcctggaaataatggcgcaacttcctcgaagccatcaggatagcataaagcatcttctgggcctgagggtatcgggtcttggcgtcccggagggcctcgctaacgaagtagacgggccgctgcacctttcggtggggccgatcttcttcgtcaggggccacatgtccagggcgctctccatccgagaggccacgcggggcgcactcggcttctgtgccgacgacctcggggtcagagggcgacaggcgcggccttcccgcagtggcctcggggccatcctgggggtcgggggcgcctggcaccgtcggacaagcaggcggagagccagttccggccgtcgggggccttgggccgccgttcggctcgggggcctctcctccctgctctctctctctcttcgggcagaatcccggcggtcgcaaatcgcgcgcatcagcaagggaaaaccgacagtggcgacgaggctggcgacacgggtgcatcggagtgagcccccaggcccccgccaatctttaaatagtttcttcttttccttcttcttccgaggccttcgggcctccttcttgttataggctgatttaatctgcaatcaaataaagaggaaatttttgtgtcaatttcatttgttctgtgtatgagacgaggatggtctgtgccacggtccttctgtgtcttggcttgaacaagggctcgtgcccaggtcccagcctcaaacggcgcgggtcaaggctagtgcctggggagatccacatgtcgagactggccaagccgggagcgtggtgaccgagggttatgggtgacccgattgtgggtttttgccgattccctcccccccggagttcaccacgtcccggggcacggctcggttctgggccccgtttggcgattttagctgacccgagcccccgagggcaggattgaacacgagtgacctatttcaagtcaagatccttcaaaaggaaacaacagcacagatacagcctttaggaaatcgaaaatgcttttattgaaatacggaagagaaaaaagataagcccccggccaaccctgcacgcccgggggggtgcggggttggcccgagcccaagacctgacacccgacccccactaggggtagaagcgacgaaggtgttcgatgttccatgggttaggcagctctgtgccatcgcccgtggccagccgaacggagcccggccgggggacgccgatcactcgatacggaccctcccacattggtgagagtttgctcagtccagcacgcgtttggacacggcgtaggacgaggtcgtcgacgcagagttatcgggcccggacgtggcgctgatggtagcgccgcaggctctgctggttgcgcgcggctcgaagggccgcgcgccaccttcgctcttccaagtagccgaggtcagggagcgtcggcttccttctttttgtcgctcgcaggcctcccctttcgggtggcccgcgaagcgccctcgacggcgaggagatgaccctcgtcgtcggtatgggctgacctcttcttcctcctcctgtcacgccgccctgtctgagcagcggatccgggggcggccgaagctgccacaccggaaccggaggggttccaggtccatgcctcctccttacgagccactcggtccacgagctgaaaaagctccgcggtagtctggggctctttggaggcgatcttttcgagcatgcggttgtgccgcacaccccccctgaacgcgtagatcaccgcatgtgtagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtacctgtcccttcagggccatgggaaagaaattcgccatgaccctatcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccgcgccctccgccttgacgatacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcaccctggggcgtgctgccgtcgccgtagacgaggaggcgacgctccccgtctcgccgtccttctccatcacccgtggatgtggaagtcgcggatccttcgaccctctcgagcacctcctccctcctaggactttggcgtggagggggcgatggagtacgagctcgacggcgtgggtttgacttcccatcgtcaccgctaacgctcggagagaggttgtgcgcctttgcttgttcggccattgggctgaacaggaaaagcttggcgcacacgcaagagtgcgagagctcagaagatcactcgcagagccccctacctggcgcgccagatgacggagcgtggggctcctcaccgggagaccgcgcaggccccccctttgccggttcggccggggactcagggtgagattctaagctctctgtatgtggaaggttcgcgagaatggaaacacacaagacacgggcgatgtatacaggttcgggccgctgagaagcgtaataccctactcctgtgttttggtggatctatgtatgaagaagctacaaagagctggagaaccagagagctcttactctctccctctctgatccttctccatccgaaaaatccaatccccatctcagtgggcaaggtcctccttttatatcttaaggggataccacatgcaccatttctctctttttttgtggggacttaccccaccttttcataaatggaccgagatttgtatagttgccgtccgagtcaccttctgatgagacgggccacaactacctccactttcgccgggagcaggtgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgcaatggttaggatgaagcctggcatatatctgactaggactaacgtgccatctctgggaggtaacacgctagctccagctggggacgagcgcctagaagccctcgtcctgacgggatggggcaaggcgtgtgtcagatcgcctgtcgccacctaacccgcgatctgaccggtctgtgactggtcactgactggataaactagtgcactgcactgcgttacatgcggcgtgacacgctcagccaaaccgcaataaatgtggttaggt

SEQ ID NO: 12794 - DNA, 2982 bp, Oryza sativa
ctaacccatacacgcagagcaaagacccacgaggggtcggggcgcctcggccctcggggccgaggcgggtgcggcccgaccccctcggggagacaaagaggagggcgaacacatcaccctcgggcccgacgccccccgagggtgccaggccacgtgggcgattgtgtctgcctcaagcctctagtcatgatactcctggtcccatgtcaccgacagacagcgagatgctccgtggtgacttcgtgaatctcataatatgccagcccagtctttcatatgtgctcgtacgggtgggatgtacgtgtgtgcttttataggggtgagtgtgtgcgtgttaaaagtttctgcgtttatactgcgtttctaaaaatatgtatacataatacttttttaatattatgttcaacctagattattttttatattttagcacggggcagcagtaggaatgataagcagacgggtgctcatgaagtcgtgatttggcataaaagaacagttctccttgtatcttccataatggtgacgagtcgccgtcagtatgcgctagatcaattcatcaatacacttcaatctaatatcttgcgtgtctaagtccacttacggtaggctgtacatcctaatccttatacaggtgacaatacatcgatccatcaggatattggtccctgcctttttatggaatgataagctagttatttagtagcaacttgcaagcgcagactgattgtctttggtgcctgaaatagcatagattaatatcctgagacgctctgtctatgttgccgttgcaagtatatatagtactagtaacatcttcctttaagattgatgttcggtgacccactgtccactgacttatcaatctaaccatggagtaaaacaaatgggcagggcttagacaaacgcatagctgaataattgactgaaatcaccaacaacaagatagagtagatagtgctacgggtataagataattgcaagtctggaaccagctgaatggtaatatatacattaaaagaagaatcgaggtttagtgggaacgggctagcggtcttggactaattactaggacatgtatccggaatcatgatttgcgaaaccattcagtcacagaaatcactgcctaccggaattgttcctttttcattcctgtattaatcgacgagagactcatataggaaaagaaaatatcgtttatggactaaattattctcaatagcatggtgcgcaattttaaattattttattgttacaaaataaagagcgttagatttcaactatatactagcataactaatactacctccatcccataattgcataatcaaaatctcttatagtaaactataagacggagcgagtaatatggtaaaagaactttatctataaagccggtagagagtggtaagtggtttctttgatctttttcttagtatttttttctgtattgtaatttatacgggaaatgatcatgttactgttagaaacaaacccaaacagttgcatatcctacgcttatgcgtagaagaacggacatgaatcctggccgtattggccgtcggcgagacaacaagtcaaccagctcgcagttgaagtcatgattttctccaggcttacagctcccctggctggtaaggtacgtaagtacagtcgtacagatgttccccggatctaggctttagggtgtactacatgtcaaccccgttggatttctaacggatttggttcaggtgcagttgctactgtgactataaattaagcagtcacacaagcaccactggatttgaaatgaatgatccagatgcaccgcaatactgtagcaagtactgtagcgcttttctgaaaaaaatatatatatttcagaattcactgtggcaagcaatttgaaccattggatcaagaaataaaaggctcaaattgtgtgcagtggcaatagcaactgcattggatctcaatctatttctaacacagtgccactagccattttacaggataagagccacattatatacatgataagccacccgttaccataggtactcctccatatggccgtttgcaccgacgatacatggatcgatcagagggagagactagaaaacaacgacgtaaagctaaccaaccatctgatcgatcagatcgatgatgggccggtcacgtctagccatgtcgcttctcctttctcttaacgacaagtttgtgagtataatcaaccaaccgacgacgacgatatgtttgcactgtcgcgctcgataaaaacgttaaaaaagcatccagctcgacttaaagcactgtgataaactgatggccaattgtagctagtttgacattagtgtttttatcctatacacacggagtaacaggatcgtgaaggggcaaggacacatgtgaccgccccgtcgcatcttgttcggttaatttctctcataaaagaattaagaggatttatttcatgtctattgtatgtaaaattattcttcctcaatactatcttttttggggggattaacctaataaagcctcatggattttgtaggcatctatgggtgatgatgcagcaggggccaaaacctgtgagagctggtgctggttagtaggggacaggggtgactgttcactcgttcattcgcccagtgcgtgcacgcgcgtagtatatattttatagtaggagtaggagtatttgtcttcctgggtggtgttggctgtaattttgacaaattgaccctttaagaaaacttattttaaaattagatcttgccaataacttattgcagaaataagccgttcgctcagcgtcatcgaggtttgcgctgaggtataacgtgtcagcgccgagatcctagctgaggtggcagtggatttgacgtggcgggtatttggcgctgagcgcctatacgtgttaaaaacaaactaacaatgaacaatcacaatcggtggttggcaggggcagatccaacgtgggtgcaggggggactcaag

SEQ ID NO: 12795 - DNA, 2706 bp, Oryza sativa
cacccacaaaacctatggatacccccctaagccccccttcaattttttcatcatagttgataagataggaggtgctaaaggtcttataatagcattttagcatagtttaataatgagattatatgtttatatcggtgtactcggtatgttgagtccccccaactttttgtttctggatccgcccctgatggttggtggtgagcttttgcatgcatggcatcctgggttcgattcccttgccatgcaaattttgtctttaatttcccttggtgtatgctccctctttctatttgactcagtgccatacttatctttctatttgaatcagtgtcatatttatttttgaaagaatacaaacaaatgagagaataaaaaagaatacaaacaagtaagagaataaaaaagaacagggaaaaaaaatgacttttctagcgatcggtgagattcgaacgtaggaccatgtgtacacaaggcaagcaaccaaaccatggcaccactaccttggtacacagaacaaatcaaattgttaattagcaagtatatggggtcagcgccgaggtatttgacgctaaccccgtgccacgtgaaaattcaatgccagctcaacaaaaatctcggcgccaatgtttttggcgctgagacgttagacctcagcgccaacctcaatggcgctgaaccgacggcctagttttggttgaagtttttggcagggactattttcaaaataagtttttataaagggccaatttgtcgaaaaaacggtgttgttggcgtgtatcgatcaggtcaggtggatgggaagagaacggacaccggaagagcgttcccgttaattgctgctcctgattacttatttgctcgctgttaaccgcgacagaattgtgtacgtgcgagaggccgtttttaaagttgtgcaagagattctctgttaactcgatggcgagatgccgatcgatggcaatgcaagacgcgtccatcgtctccaaaaccgtgcgagcgcgacgcgtcggaaatactgtgcactctgtgcctactccgcgtcctctaaacttacggcccgaattcttagtccctccgtttcacaatataagtcattttaatattttttatatttaaattaatgttaatgaattcagacatatatatatctatttatattcattaatattaatatgaatgtgtaaaatattagaatgatgaaacggaggaagtatacagtacaataccgcctcggacgggcacctcagggcgcaacattactgcatcgtattagcccacccgaatctagtaaatctagatggaataagatcactttgactccctcaactgaccactaaatctaaatcgtattcctcaaccacaataccagaaatcttaacccccgaacttacaaaaccggtgtaatttgactcccttggtggttttggagggtgatttcgctgacgtggtgcacacgtggcagcgttgatccggtctttgtcccacgtggcattgacgtggcgcttatgtggcattaaaataaaaaaatatatgcagggcccagtcattcacccaaaaataattgtgggacccacaaacatgtaggtcccacatgtcatcctccctcctctatatttccctctttcgcttttacagcggcgttcggatcggcggcggcgacggcgggcgatggacgaatcaacagcggcgggcgggcggccattggagttgcggatccggaggccggatctgcccctcgcttcattcctcctcccgatagactgcgccatggccgtcgccgctgcgctgccgaccgtcgccggggagctagccatggacgagactaaacattcacaaatctcaccagggctggccgcctgggcccaaggtagagctggccggctactaggaggacgcgggagctcaggtccctcggcggcggtgcgggcgctccagctatggcggagagggtggcttgctttggagggggatagggaagaggacaaatattgcccgctgggcagtagccaaaagcaaaggagtactggggcacatctatacacgagctagacaaacgacagatcctacaatgctcaaaaccaaaaccactacatcagttcaacatctcgaaacaagaaattgtaaattgaaaaaacaaaacaaaataagccacggcaaattgtccaaatttcacgcgtcgacgaggatgcacaaggaaggaactaagagtactagaggtttacttgttcaaatcgttaaacgattggttggaattagtgggaggtcatcgggaagcgtcgacggtgaaggcctaaaccgtcggcttgtacccctggccgcgccgaggctgaccagcacggacttgaggaaactcctttcccagcgacatggctccggcgccctcaaaggacaccgcttctgacgtcgacaaggacggtcgctgctccatgcatggctccggcgacgacgggagggtgtcattaatggcgctgctagagtaggcggagcggtggcgacggcggccggggacgccagcctgaggcgcatgatgaacgccgtcttggtgacgcccacgccgatcgtcgccgcgagcaccgagttgcggctagctatgccggctgccttgaagatgctcgggccatacaacaccacggcctcgatgccggtgaggtgctggaagaagtggatccccagggcagcgatgacgatgcgctgcaccggcggcgt

SEQ ID NO: 12796 - DNA, 2294 bp, Oryza sativa
gtcccataattttttttttggtgaatgacaaatgggccctgcatatatttttttattttgatgccacataagcgctacgtaaatgccacgtgggacaaagatctggtcaacactgctacgtgtgcgccacgtcagcgaaaccgctcttcaaaaccaccaaaggagtcaaattacaccagttttataagttcgggggtcaagatttctagtattacgttgaggagtaccatttagattcggtggtcagttaagggaatcaaagtgatcttattccaatctagatcgcgaccatccgatttgggccatctagtcttatgcccgagaagagatgcaccgcaccagaaggcccattaaaacttcagtcgcgcatgcatccagttgaggcccacaatatatctagtgccccggtccggccagccgtgagcccacgtgaaccgccaaccgtctccctcgccgatctcggcgtcgcgagtcgtgcgtgacccaacgccgcccgcgttggcggcacggcgcgccgggcacctccacggctccacccttcgccgcgcgtgcctcaacgatgccacgccgtggcgtgcattcccacgtcatccgacgagggcgtgcggcgtgcctaatctacgggcccagcgagcgagcggcggccgtcgccgccgcgccgcgccgcgctcgctcgcgtggccaagatcaacgggagcaaagacgttgtggttggtcctcgtgggccgcgtcaaaggggacacgcacgcgacggtcgaaactgtactggtcagtctcagtctcagtccggagtcattgctatttacaactcaatagcgaacaaaagcgatttatttacatacgtacaatcgtatgtacaatctatactaatttttcaggagatatgcaagctacactgacaaattacatgtttaaacctaacgattattctctgaatcattagttcgtgtacacttgctagcagctacttctttctatactgcaatctagcctgtccatgcaaggagataggactgaaaactaacgaaatcttgggacatttgctcaaagaccatgagcacagagaacacccccatccctactaaaactggctttgcactagtcaagtccacattgccactgccaccggcgacagatgattccgcttcgacagatccagctctcgaatctgacatcctggaggcgatagcccacgccatcaatggaggaagaacgccatacaagatggtcatgcagtaaccgccctgaacgttaggaaatcaacccaccaagtaattaatcttctgtaagtgtcggaaccatgctagctaggatggcaagaactgaaggatttcacatgtattggtgtacactcactgcaatgtcagtagcaatggagaatgaattcggaacggtagctgcaattagcacggttggggcaaccacagcccctgcagcgatgtagctgagcctgttgttgtccacagccgttttcgctccacgatgccttaatgcttcttcttcctgcactcatcgattgtttgttcataaaactgaacagattgttcttagatataaattaatgcaagtcctctggctgatgaagcatacatgtccttgggctgaagaagagacaagattggtcatctgctcaatgaagaactgtgaagctcccagcagtgttccgatcagcgacgtcccgacagcaaggagtgagaacgtctccacaacagtataactccatctacaaaagaaagaaaattttgtcctgttaggattcaacgcctccagcttcatacagagaagcagattgcaggtgaagctgtacacaacgtgttcttgctagtgcagtagtgctacagcggagacgctcactctgtattaagcatatccaggatgtcaaacccatcaagatccgtggagatgctgagcgcgatgtcgtcccacacgagcaaggacagcaatggcacgatgctcccgacgagtatcgagagccgaatcctcacgaggtcccctccaaggtacgcgcatatcactgcgacaattgcacactgaatcttcagtacttgtacctcttgcaagttgcaaatttcatccgtgggatgattacataagttgcattgcatgtacctggtgcgatatcatggaagaccagcgtgaagatgatcaccggaagcgttgcagggacctgctcccagttggtgttagctggcagggtcaggccggcaccgaatgctactgcagacacctcgatcgtcagcagtaatcctgcatcagtagacagatcacgatggtagttagtacttagtactagt

SEQ ID NO: 12797 - DNA, 6787 bp, Oryza sativa
gcagcccccactacatgccatctttgaattccagttgggcgaaccagtgtttgttcatctctgttttcacaatttcagaaacgagttactgttccatatgctgctaccatctttaaagtcacattttctttttcttgcttaattagcttggagatgttcagacagcagaatttcttctgaaagaagacggctgcagatgccaaaatttgtcatttaagcgtattaatgcagatctaaacaatgtggtatttagtaccgttggctgttccaagtgttgatcacaacgatagcttaccaacctatcatgacgaaagtgagcagctggttcactttgtcggtgacgcccgtgccaccggcggcgatgaggagcgcaagggcggcggtgaaggcgcagccggagacgggctcgggaacgccggcgaccacgctggagagcacctcgccagacttggacgtgtaggcgaccatggaggtgtaggacaggaacaggtaggccgcggcggccaggttccctccccactcgcccagggtctcctgcgccatgctcttcagcgatatgacctccagctgcccgccgccgccgccatcgccgtcgccgccggcgtacttccccttcttccgccgcagggggacgttgatctcgaccaggaggagcgcctcgatcaccaggaacgcccagcaggtgaccatgcacgccgcgctgggaacgaacccctgccaatgcacgaccatcagcaatgccagggaccctagtaagagtcacatcggcggaccttaataagttaaagccaaaagtttattttcttaaaacttaatttttaagatgattttaagatattttcaatgcatttttttcaagtattaacttttaaatctctaaaaacatgtatataaaaattttacctataaactaatttttattttataataaactgttttgatttattggagaatatgagtaatcgacaagaacttaaacatccaccatacaaaggaaaagttcaagttcagatttttcttcttgttccatttctgttcgggagatttttttttttttttacgaatttgccagatcaagaatgcttgaggttggtgggtcgacaattaaccaagtgaaccttgaatgctcgtaactactcctcacaacaaagacagagaaattcagctgtttgtggggggtacatgtggacggctacttcagatctgtctcatgatagtactactagaactgctgctactactttcatttttggcgatcagatatcctgtcagttccgtgccaaattcatggtcctgaatcctgatagatgggccatcactaattacttcaccgtacgttgtagactagtattagtagtataatctttcggtgtcatgtggaaaggtcaaggcaagagagggacctgtcaccggtccgagatatgaatatacttcctccgtttcacaatgtaagtcattctagcattatctatatttatatggatgttaatgaatctagataaatatatatgtttagattcattaatctagattcattaacatcaatataaatgcgagaaatgttagaatgacttacattgtgaaatggagggagtactacgatgagagggtgattgattccatcgattttttcgcgttgtcttcctctaaaatcatgcaccgtgttgatcacatgtcgaaatcggcgcaggcgatcgttcgttttagggattctgattgtgatgatgctagcaataggctcgtcaggtgtagggtagtacggcgactcaccgcgggcgccgtgcgctgtggcacggcgaggatgccggagccgatgctggtcccgaccacgagcgcggcggcgccaaccacgctcccccgcttcgcgccaccgcccgaagacggcgcctctgccacgcccgccgccacatctccctccccctgaggcggcggccgcgcgtcgccgccgcgcgctcccgccgctctcacctcggagacggcccgggccctctcgccggtggctgcactactgccgcaccactggacgccgccgccgcgatggactctcctttccggcaagcatgtcgtggtcgtcactgggatgcaccggtacggggcgcggtggaatctagctgggcggtgctgcaagcgggcgcgcgtgatggcgccttgcatcggggaggtttcttgggtgtttgtgagctagagctgcggactggagggaatccccatggcggtatattcatcgtaggagtgacggagtgcgttgtcgagtgtcgaccacacgatcatgtggaatcttgagctccggtggtgggcggtggaagcggaatcttttgcagttgtggagcaggagcgcgcgcggacggacacggttgccgtgagactctggaccatgaaggctgattttgtttggagctatacatctccatcagtggtttgtggctgacaatatgtgaaaaataaacttcgaaaatagagtaaactagcatggtggtccagtccgcgcagattgcgcggctagcatcattatattttctctcatataataacatatatgtttttttattatattattcaaatatattaaaatgacaacataattttaaattttgtaacaactttacaaaactactaatgtgtaatattcatattatattttatatacttgttagttattaattatttttaaaatcaaaatttagttatttgcaaattatatatattcttatatggactctagactcgtcttttaatatttcttttttaaaattccgaattttctgtaaattgtatttatgtatagactctatgctcttcttccaatattattttttttatttctgaatttttatattatattttatatacgtgttagttattaattatttttaatatcaaattttagttatttgtaaattatatatattcctatatggactctagactcgtcttttaattccgaattttctgtaaattgtatttctatatagactctatgcacttcttccaatattatttatttttatttctgaaattttattatttctaattgtatttccatgtggactctaaactcatttttcaatattctttaatttttaatttttaatttcagttactctaaattgtattcctatatttgtattcctatattgaccttaaactcttcttcccgtgtttttcttaatattgaattttagttatttgtaaattgtatttttatacggactctaaactctacttttaattttattatgtttattccaaaatatagttagttttaaattcctatatgcactctataatctacttctaatatttcttatttttaattccgaatttctatttttttcttaattgtatttctatatggactctatactttacttctgatatttcttatttttaattccaaatgtctattatttcctaattgtatttctatattgcctctatactctacttctaatattctttatttttaattccgaatttcagttatttcctaactgtatttctatatggactgtatactctacttctaatattccttatttttaattccgaatttcagttatttcctaattatatttctatatggactctagtctcctcttctaatattccttatttttaaatatttcttatttttttttaattccaaatttcagctatttctaaattgtatttctatatggactctgctttttctttttctccgattaatgtgagaatttctaggccatgagagcgaatgcggagggtcctttttctattcctttaataatataatagattactgttcgtgctgtatattcttgccaaatatttttaggagtgttaatttaatagggggtaaaagagaaggttgagaaataggtaaacgggatgattcattagcgcatgattaattaagtattaattattataaatttgaaaaatatatcactatgattttcttaaagtaactttacatataatttttttccataaaacacatcatttagtacttgggaagtgtacgcatgaaaaagtcaaatctactcacaatcttgtgcaaatgaaaacacccttaggccatcaccgatgcgtctctgggtcgttccctcgccgacggacatccgcttttccgtccgcgtcagctccctacgatggagcgcatcccccggcccaaggacgcgtctctcgccacttttcagccgagcgatgcagccgagggatgcattgggagggggatgggctcctgtggacatcggttccccaacgagttttcctatttcaccccttggtagagctggagtatccgccgaccgaggcggacccacaagagagatagagagcggcggcaacgacaaatccgcggcggagtaggcacctcatccacctcgtgctcgccatccgccgcctcgactgccgcgatcagcacggcgctcgccaccgtccgccgccttgtccaccatgcgctcgccatccgccactgtccgccgccgcgacccgcgcggcgccggatctgccacctccggggtcgccgccaccaccttccacgggagagagagagagggggggagagagcggcggcggcttgggcttctctcggtgctctcgcgtggatgatggagaaagagagagagagagagaagagaggggtagaataggaaagagaggaagaggagagagagagagagagtcttttttgggttgggatactcattgggctacccagatgtgacctgcattatagaggtgagtacccctaaaatccctcagatagtgaggacaccctagaagtggctcatattgttgatgcccttagactaccccttgaagcattttttttcactttgaaaagtgatcgctgccaaatgttaagcattggatcagttgtctcacgtgtaagtgagacatggacagcaaaaatggttccttattgcctgaaaaatagtccctgttacttaaaaatctatccgggacttaaaaaatatttttagtcccgatttaaaagcacaataggactaggtgatctttagtcccggttggcaccaaagatcatctttagtccagactgattccatgtcaggctgtgttaggacgcccaagatttttactaaatatactaactttaattccgattggtattaccaaccggaaataaaaatcaaaacactatatataatttttatgacttatcctcttctcccatcctcaaaaactcctcgtctcctctatattttttcctccatctccttatctctctttcctgtacctgtttttcctttctttccttatctcagcgcggggagcggctgggagcgagccgagcgcacgacgaggagattgggcggcggccgggcgcacgaggagacggggcagcaaccgggcgtggtcggcggcggccgggctggggaggctgggaggaagaatttgtttgtttacgatttgtggtgaatttcttcttgagaatttgtgatgtatttaaccgtgacgtgaatatgtgatgttatttttagaatttgtgatgtaaccatctttgagaatttgtgatgtatgctctgtggtttggagatgatttggggatttcacgatttggtgatgatttgggaatggagttaaatcaatatgcaaggagttaaaaacaataaaaaaactaaaaaaaactaccaatcgagacctggtctcttcatctttaatcccggttggtaacgatctttaatcccgattatttcacgctatagtctcggatacaaccaggactacatagggttacgaactattgggttgtgatccaaatttatttgcacacgtataaaggctaacttcggacggagtgaagcggaggcccgtcgtcggaggcttgggctggagcgaagtgtccagattcgttatactaggagatgccacatcccctcataggttgtcttttttttagacgaagagagtacggggctgtttggttcttaactaacattgacataactcactttagacaatgttaggcagccacactttttgtggcctacaaattataagccacacttatggcaaagttaggtaaaagattgagtctacgacgtgtggggtaagatgataagaaagtatggattgccataagacaatgaaacaaacacaaggctaaaacggtataacagtctaaaatgtattgtggtaagttgaagcattgaaccaaacagcctacgcctcaactgcagtctatcttctccgagatggatccattggtgagcgccttgaatgtggcaggtgcaggttgcctcggcaacgtgggctctccacctatgctgtcgtcctctccaaccccgttccggcgattcgcaggctttcctctcagcccacaggccgagcgagtgatgaggcgtccaactaattctgctctcgccttcattgcgccatttaacactcggcgctctcggctctcctcctcactaccccaactacccactcccccctccacttaaacgcgcgcgcccccccgcccgcctctccgtcctcggaagcgccgcccactcttccgtccacgcctatcgctcctctccgtgggttccccccgcgcaagttgtgcgcgccatggagatgcagctcgccgccgtcctcgcctcgctcgccctcggcggcgcgctgctcgtgctcgtcttcggcaagtggtggcagccgctggccgacgccgacaggcgcgtcaaggagctcgccgacgccgtggaggcgctgctgcagctgcggtccgagctgctcaaggtggagcccgcgccgccggagtcggaccacctggcgcgcgcgtggctgccgcgcgtgc

SEQ ID NO: 12798 - DNA, 3590 bp, Oryza sativa
cacccgtcggcgggtcggtcgagaagcagctcaaggccgtccgcgcgctccgtgagcagggcgaggcgctgctcgaggccgcgctgtccacgccgcaggcgccgccgccgctgctccgccagccggaggagctggagctcccgccggggaccagtctcacgaggccctacctcaacgaggcgctccgcttcctcggcgactgcgacgccgcgctcggcgtctggggcgcggggggcgtgggcaagaccacggtgctcacgcacgtccgcgacgcgtgcggcctcgtcgcgccgttcgaccacgtcctgctcgtggcgacctccagggactgcacggtggcgaagctgcagagggaggtcgtgggcgtgctcggcctccgcgacgcgccgacggagcaggcgcaggccgccggcatcctgagcttcctcagggacaagagcttcctgctgctcctcgacggcgtgtgggagcgacttgacctggagagggtcggcatcccgcagccgctcggcatggtggccggccgggtgaggaaggtggtggtggcgtcgaggagcgaggcggtgtgcgccgacatgggatgccgcaagaagatcaagatggagtgcttgagcgaggaggatgcgtggaacctgttcgaggccaacgctcgcgaggagacgatccatcgccaccctcggattcctgcactttcaagacaggtaatcacttgatctgtctttgtttgaaatcagattggttcaaaacaagcgctacgtttagcattttcagttttccttcaaaaaatagatatcttccatccgttagatcatacaatggtacatgcttaagtttcagtctaggtttgatgctaactgtaaggatttatttcgattgagaaatgagatggtcaaattctcatgtctccgctaactgaatttccttgtatattttttataaatggattttccgataaacattagctacctttttaaatcaggatcatctctgtgatttcctgttctttccagctactaccaaattgcaaatcacaaattgaatgctatcagattattatcacccaatggttatggtacaatactaccctttgcagaatggtcttgcagaagattttaaaatgtgttccgttttacacaaaggcaatcgaacaattctgtttctctattttccatgataatctttctgtttcttcaatccttttgcactggcttgttgcacgacttatcaacgtgttatgtacttatgtgccatcaagtttagttgatgtatttcatttacatttgatctgttccatcattgacaactgctaataaattcgttctacaactaaacaggttgcttcagagtgcaagggcttgcctttgtccctcgtcaccgtcggccgcgccatgtcgagcaagcgcacaccgaaggagtggggcgacgcgctcgacgccctgaagaagacgaagctctcgagcgcgcccggcccggacaagatcgctcaccctctagtgaaattctgctacgacaatctggagaacgacatggcgagggagtgcttcctggcctgcgcgctctggccggaggatcacaacatctccaaggacgagctcgtccagtgctggacagggctcggcctgctcccggagctcgccgacgtcgacgaggcgcaccggctcgcgcactcggtgatctccgtgctggaggcgtcgcggctggtggagcgcggggacaaccaccggtacaacatgttcccgtccgacacgcacgtcaggctccacgacgtcgtccgcgacgcggcgctccggttcgcgcctggcaagtggctggtccgcgccggcgccgggctgagggagccgccgcgggaggaggcgctgtggcgcgacgcgcggcgggtgtccctgatgcacaacggcatcgaggacgtgccggcgaagacggggggcgccctcgcggacgcgcagccggagacgctgatgctccagtgcaaccgtgccctgccgaagaggatgatccaggcgatccagcacttcacaaggctgacctaccttgacatggaggagaccggcatcgtcgacgcgttcccgatggagatctgctgcttggtcaacctggagtacctcaacctctccaagaacaggatcctgtcgctgccgatggagctgagcaacctgagccagctcaagtacctctacctgcgcgacaactactacatccagatcaccataccggccgggctgatctcacggctcgggaagctgcaggtgctcgaactgttcaccgcgagcatcgtctccatcgcggacgactacatcgcgccggtaattgatgatcttgagagcagcggcgcgcagctgacggcgctgggcctgtggctggacagcaccagggacgtggcgaggctcgcgaggctggcgcctggcgtgcgcgcccggtcgctccacctccgcaagctgcaggacggcacgcggtccctgccgctgctgtccgcgcagcacgcggcggagttcggcggcgtgcaggagagcatcagggagatgaccatctactcctccgacgtcgaggagatcgtcgccgacgcacgcgcgccgaggctggaggtgatcaagttcgggttcctgacgaagctccgcaccgtggcgtggtcccacggggcggcgtccaacctccgggaggtggccatcggcgcgtgccacgccgtggcgcacctgacgtgggtgcagcacctcccgcacctggagtcgctcaacctcagcgggtgcaacggcatgacgacgctgctgggcggcgccgcggacggtggcagcgcggcgggtgagctggtgacgttcccgcggctgcgtctgctggcgctgctgggtctgcccaagctggaggccatccgcggcgacggcggggagtgcgcgttcccggagctccggcgcgtgcagacgaggggttgcccgcggctgaggcgcatcccgatgcggccggcggcgagcgggcagtgcaaggtgagggtggagtgcgacaagcactggtggggcgcgctgcagtgggcgagcgacgacgtcaagtcctacttcgcgcccgtgctgatctgaacaaaacaacgtcgtcgtcgctgcaatctcgccgcgccgtgccgcgcgtgcgtgcatccgattttccgatgcagaggttgaagttttggagacgtgctgatctgttagggaaggaacgtcgggggaaatttggtgactgttaatttggattatttttcattttcctttaaatttgggacggtttcttttgaacatcttgtgtttcgttgccaaaaggaaaactcaaccgctgaacattgcacttctttctttgttttgctcaaactatatcctatgctacaaacaagcaaacttgaatatctgatatgttcatactagttttgtgctcgaattcccgacgtgattataaggctgaattcctgacgtgattataaggctgagtttagttccaaactttttcttcaaacttttaacttttccatcacatcaaaacttttctatatataggcctggtttagtttccaactttttcatcgaactttcaacttttttatcacatcaaaacttttctacacataagcctgg

SEQ ID NO: 12799 - DNA, 2107 bp, Oryza sativa
ttttgtatcacatcaaaactttcctgcacacataaactactaacttttctgacacatcattttaattttaatcaaattttcaattttgacgtgaactaaacacgcccatacaaatttccaacttttccgtcacatcggtccaatttcaatcaaacttttaattttggtgtgaactaaacacaccctatacgtaggacatgctgatgatcactggggggcccttccggcctggggagtagcaggctgggttggctatgggccatggtttgggctgcacctggacattgcagctaaatggatcggttaattacctaagcagtcactaaaaagggctgattagagttttctttttttttatctcgttatatcttttttttcttgtgagaataaagctaaactcagtccgttcctttctcaaagtatgagatctgttatgtatgaaatctacgacctgtttggatgtttccagcttttgtcacgtggaaagcttttaaaagatctattgcacaccatgatgaattcattaccagctttgactggacaaacaaagatgtataaaagaaggagcgtatcctatgcacacaggctctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgttagattttttgtttttttgttacggctaaaatataatgaatttgatgttaagattttaaccctatgtgtaatacaattgaaagtatgtgtatgattttttctagattttttggtgacattttttagttggtgtgcacgtgtgtacacgtgagggcctgtatgtatagaatatgttgccataaaaggaaggggtgtgatgtagatattgtctgtactcaactaaggagaggagaggaagaagaacagagatgttgagatgtggatctaaataaacatttactggtgcaaggagaaagcatccaaaacgccgcttgctaaatcataggatactttagtacgagtgtattatataagtaatcaggtaaatatgttgacatgaacataattgtagaaatacatgatcattttcatttgaagccaaaatatggcatatcaaattcttaatagtactttggctagtgtttggtttgctattaaaatgtgccattggactcaatcaaaatttacctatattttgacattgccaatatcttaacatggtagcgaagcaaacaaacctataatgccaatttttattgaatatatgtgataattgttttcactcgattcaattcagattcaagagacgatgagtggttaaaaacaaaccacaaatgaaacaaggagtaaagcaagggcttgtttggattgaagctaaattttgtccaaccaaaatcatggcaaatttaaccgtgtcacgtacgcctcactagttcaaattatatactagcacaaaaatttaccaggttttggcaaaacaagcctttaggttggttcagatccgtttgttctagcatggaaaacaagataatttattagcgtatgattaattaatcattactccctccattccataatacaaggcacaagtactttttagatttgttctataatataaggcatacatgcatacatgctattaactaacacatcttcttcactaaaatattactatttaaattttccactatcaaaatctctaattttattgggtgcatgcattgtatttattagattaatccaaactatgaggtgataataattatttattggtctttgggttgtgtcttgtattttggaatggagggagtaactaaaaactttaaaaatagatgatattttttaaaagtaacatatatatatatatatatatatatatatatatatagaactactatacggcaccttagggtgctagtattaaacaatacctgatacagcctccagccccaccaggtccataataagcagttaaaatttaactcatcgacgaccaatctccaatccacccgggctgcaggaa

SEQ ID NO: 12800 - DNA, 2357 bp, Oryza sativa
  unsure (1)..(2357): unsure at all n locations
gctctcccctctcttctccttccccccttcccctccatgcaagtaaaacaagtgagagactccccccctcaatggcgtcccggatcgcgaggctgctacagcaccagaaccgccgcctcctctccaccgccgcggaggcctcctcccgccgtccgccgcgcgctcccctcagcggcgccatccccaaggtaaccccgcggcaaccggggaggttgtaaccctaaacccgcttaaacccctgcgcgcctccgaggtgttcggcggaatgccgacaccggctcgcatgcctctgtcgctgtttcattgatagcttcgtgtttaagtgagctttccggtaatgtgatgccctagttaggtccctgagccggacctaacgcatgccaggcgcaggtttcactgaagtattaattgttgcttagggcaatgggttatgcggtgagctcatctggagtcttatcgccattgtagcatgtggttcctgttgaatctatatacttagagcctaaagcaatgcttgatttgttactctaatagtggtaatgaatagtgcctttttatttttctatatagacacaccattatctccgacctttttattttctatatagatacaccattatcctgaccttgtttcaacttttaactgttcctaatccgagactgaatagatccttaagaagattgttgaatctgttcattgtgtgataaactaatagttttttttgtgtgttttctgctctaggtgacatatatgtctttttttacctttcgtcttttttttttcagcatgaagttgcaaaggctgaaggtctaagctcatcttcaatcctgaagctctctactttgttcatcaagtgtctatttatgcaagtttcaaattttcttatatggttgcatccatgtttctaaagatgttctgggtattattgcatctaagaaatgaccgctgtttcttgtgctgagtggcacaacatctcctacactacatgttataaatgttgttacttactttgctttaatttaactgcaaataagcatagaagctaaattgatagtgcaaataagaataacatgttagatgtatctgaatgctcactaaactcacagtgtggtggcaaatgtactcgcatccctataaatttcatctgctacctcaattttggttccttcctgatcatacttttagggacaatctacatataattattttatctgcctacctgctgcttgtcacaattttttattcaaattcttgcaatattttttcagctacatcaaaagaattgctagttgctgacatataatatgctttctttatgaaacatatattatctgctgatcaaagattttattttttgtttttttaatgttttaagcatagtatgacagagagttgcatattctaatttcaaatattgtacgtactctttcatatactggtttagagagcattactgaatgcactgcccttgtaatactaagtcaagcatactcttcatacatcaaacctactagactgaaatgatttaagttgttgcaaaatgatagtatgctatttactcaaaattgaaagacattagtgaatcttgtgttgttggcttctctaacgaaattgtgctgaatactcaataggcattaaacctcagatcaatactcaatagacattcaatgaagttcatatttacagaaaattgtttctcatctgtatggtctcatcaagtcatcataactttattaatttcagacatttaatagtctcacgttcatgttcttttttgttggatcttgaccaacaatgctttgcaagttgcaacatcttatctatatttatttagtgctgagtgaattttcttttgggaaactttgcagcctcatctttaaaaaaatcaaggtgggacatgatcaagtcaaacccttcaagtcctttcacaacacagcgtgaaaagccacaaagtatttaatcatttagttaggccttttgcatcctactccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12801 - DNA, 543 bp, Oryza sativa
  unsure (1)..(543): unsure at all n locations
tgtgcgcgcgcgcgctccggagagacgtggcggcgcggctagacgctttcggttggcgcagccgcgtcgaacggtcgggaagaaagaagattctccgcgaattgcggtggggccgacaagatcacttctcatgtggctcccgtgcacaaccgcaggtgagccactctctcactctactctagtctagtggccacaattgaatcactctggaaatccatgaattttctaacaacaaaacttcacaattcagcaacacaagatggctatgtactgtacaacttattggtaaattcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12802 - DNA, 620 bp, Oryza sativa
aatttcttttaacattttaaaattttaaaaattaatagtaaaccttttagtcacgccagtctcattggtgtggtagtgtggggatataaaatacattgacaatataattgtgttgtttcgtcacgctagacgaagtggcatagccaaaagaaaatatttttttactataataaaaaattaaaattgttcaaagaaaaaaaatcaccgattataaggggctccaaatacacgagcaagcgtgagtaaaccaaattgcacgcgagcccctccaccttatactttttgtccatagttcaagacaatcttcacgtgtaagttgcagctgagattataagatgactggcgattgcgatggtgctgacataaaaaacattccccgctcctagtttcccacctctcctccctctaccctcaccctccagtgcttggcatcttctcttcttcaacagtgaaaagttggcaaactcaattcccgcaaatgcaatgctaacaaatctcatgacgacctctcctccggctagccagtcatggcaactaggtgagctatttgtctcatcttccctcctcctctaccacctcccaccttctatggccaatagcgccaccgtcttctcaccaca

SEQ ID NO: 12803 - DNA, 12077 bp, Oryza sativa
  unsure (1)..(12077): unsure at all n locations
nnnnnnnnnnnnnnnnnnnnnnnnnnnnnnnnnnnnnnnnnnnnnnnnnnnnnnntgggtaggctgtcgctagttctctgctctttaaaccggcccaagcccaactaagccaaagcccatagagttctgctcgaaaatctctctaaaaaagggctaagaagtactcacaaaccccaaaaattgcagagcttcatttattgcatcttactccaatggttactcttaaaaaaaatctaatcccggagagaatttgaataagagattgttcaatttgtctttaggattaattcagatttgaccatctatggttgtattgagctaatacttcatttaccgtgaacgtgtttttaaaacagttaaatggtttattttgtgcgaaaattttttaaataaaattttctataacaaaaaaatgtaaatatattttcaaaattataatagttaatgtttactacctccgtcctaaaataaagcagaatctgaacatatatagttgtctagattcatagctaaaaatgtttttattttaggacgcatgtagtaattatttatacgctaacaatgtgtcttgctttacgtgccactaactagctaagcccaacagctatatcaaacttacccgaagccttcttttaaagaaggatcatgtgcccaaatttggggttggagtaacggataaccagcgttcccagtatttgacaaaaaaaaaggcgctcggttttgtgaaaatttggtgcttcgagctggatcaacttgacaaaccatttcgtaaactggtctaatgatgaaaagatattaaatcaaagtgagtttcaattttttgacagaactgatcaaatttcacatgttttcaacagttttcacaaaaaaaaaaacttatgagcgatttacaatcaccgaacggtttacgcaaacactgctgctaactgtaaattgttctgcccgtcccaacactgacaaataaattcccggcaaacaattctctaacaaaaaagcttattaggcatttccatgttgatttaacctctggttatatatatgcacttcatgcaacagtaaaataaattatgcatgcatgcaccagtagaacgattaatacaactgaccaccagcactagcttaataaattcaacagagttaaaaagtgaaaaacaatcaataaacttatataacttccaaaaaagaccatctattgtgccaaacgaaggactggaatgtaattacgtaaaatcaggggggtcacggaaggatatatccttcctctcttcgtcccgcgcgcgcgggcaccaaacccccctcaaaacccctcctcctcctcgtcgccgtgtgcttcttcctcgccttccccctaacctcttccacgcgcatttcccatcgccgaattcgcgatcgatctcctcctccgccgccgaggaatcgatcggaagagctccccggaggcgagccgtacgtcctcctcctcctccgtctccggcggccacgcgcgcgatctcccccgacttccgcgcgccgcgaggtaagaggtatggttcccccagcctccattcctcgccgctccgcacgcacgcacatgacaagccctaaccctatcccgcgccgcatcaggctgtctccccgcgccgcgccgcgccgccatcgtcgtcgaggtcgatcgacaccgccgctcacccaggtgtggtctctctcttcgcctcgatcgatcgcgatctctctctctctaccttgtttgcgccgtgatcgatctctcctcccttgcgcttgcaggacagatgcatcatggccgccgcagccggagaggtgccaggccctcccgaggccgaccccctcgaggtgaagtgaaatcgttcgacgacatagctaattgctactagtagctttgcaactggatcggagtactaggttcgcactgttgcgttgcgatgtgttgattgctggtattaagagactgattttgtgccgagtcatgagatcgatgttagtttagttgcaacctgccccaaattaatgttgtttctgaatttctcgattatatgctaatttgttctaggcatctgcgcagttagttcacatatgctggctaagaatttatagaacacattggtgcaaaccaattatggcatgcatacatacatgttgcatgtacggatgaacaaggataggcattaattggagaatctagagtctacactagggggatccaggaggattaggggtgtgttatgtagtactcccaatgtccatggaagattacaatcgggaagaaatggagacatgagcagctagagcctagaggatgatctaaactaagatcaagttcttttatagttttatgaactagattggacatttaattctcactaactgtcattatccttgaaatatgttattcttgtgtggaacataatcaaattatttgtaaatcatctttgtcttacatgcatgtaattcgtttgtgctctgatctcttattacagggtatcataacgtttactctcaaccttgcggacgtggacaaagaacaacttacactgattttgtatccgagttgcgccaatactctgttgagagggcaccatttacttgtagaaattgccccaccacacccgtcgatggttatttatcatccgtttttgccccaccatgcccgacaatggttactttatcatccgtttggtggaaggagatcattctatccggctacttatccaggaaaggaatggatatatgatatcattctagagaggggatcattcctggttccattttaagggtgaaaccctgctagattttattgttcagtcttcagaggaaacaaaaatcgaagcaagttatcataaattgattcccagtggaaggtatgaagttacattattcgctcattaatactctctatactctactcatggctatccattttatacagtatatatgatgtttcattgtactaacttttgtttcgtcgtaaacatgttcaagtcactgttttcatacaggccctaagccattgcgacattacttccgctgcattttgagctataataatgatgcggctttgggtactacaatgatgaacaattagatattgctttggccccaatgagtggtactttggctttgggtactacggtgatgaacaattagatattgctttggccccaatgagtggtactttctgtaaagaagacggcttagaccagtaaagaggtttgcaactcaatatgtattactttttgtgtgcctaagaatatatacataaaaactgctattataatcaggatataagcatacaaggaacatgacttcaaagtttttgacaaaataaactagcaagactatacagtattactagcagtaacttctgttatcactggagtaaagtagccgtttcctactaagccagaagaatataaatccgcgcctgtctatgaaaaaactaatgatatcaatatatagtttgactaacacatctatttctattgtgtaggttcattcctaattgtttcaggaatcatgtattattgtgtaggttcatttcttagtgtttcaggaatcaggtttccgaaagactcacggaaggtttgtgaaaatatatccactcttacacaatatcagcattcatcttgacctatcacgatgaggatggcaatccgctgccgattgttcctgaagatccaacttatcattgaagctgtttttactctggatgaagtgctagaacttcaggaacaaggatggttcaggaatgaatgtttaggatggttcaggaatgaatgttttgaggagggttagagtaagggagagtaagttacttcaaacataaggcagaatcagagagaaggcaagcaaccagtcaatgaggattgtgacatggatgcagtaagtctgagataagagtaatatatctcaagacaggtggttggctataagattgcaaaaggcagaaacatgatggagcagctaggaagctttgaataagcagaaaataactgaaaatatacatatctatatgcaagataaaatggaaacacaggggcagatgcatgttgagcaaggaatcagtcacaggacatgatgagggttttaagctcagaaaaggttctgaagatgcaggagacacacaatgtcacaggacatggtgagggttttaagctcagaaaaggttctgaagatgcaggagacacacaatataaatattgaggttgctgactctgttgcgaataaggaagacagagagaaggtagattttgggggagagtaatgagtttctagagaaggtagattttgggggagagtaatgagtttcttattcaaaagtgtctgaagatgattttgtaaacgagtgtagtgatagtagataattttgtaaataagtgaagtggatgtagtaatagcagaggaaaacactggagtcaagaagaaaagaaaagaagcagcaagaggctaaggaaaaagaagacataaatctagaggaggtggctattaagaggaagctaagcccaatatgcttttattaataaatgtcagaatcatattccatcctttgttcattattccaatggtaaaagatcttgcatgtgctagaattaatttcttcttaaaagagtaggaagtttacagagatatagatgtgaaaacaaatcagaggatgattttcatctgaacattgcctttctgaagataatgactcagatttagatgatattgatgttttgatgaaaactctgaacatttctggcaatagaaagaaaaaaaaagaggaaaccttgaaattgtaaggttacttctaaagttgttaagaagtgggggaataggaaaaaaaaagagatgaaaggtaatattagagaaatgagtgctatagaaaaggttagaatgttacaagatcttgttagagaaaataatgtagaattaatgtagattttgtatcaaaacagtaaaacaagacttttcctctagaatgctgaggggattagtggtcataaatctttgtgctggaactggatgcctccttctggaaaatctagggatactctaattagcattaatactgaaaaatttgatatcttggaagttactaaaaacaaattctgtgtccaagtgaacctgatgatcaatgggacttgatggtaatttatggagcaacctagaaagaggaaaatagtagtttcttaactcatgcaaatcttttacatcaacaaaaaatatcctttggtgatgggaggtgattttaatatcttaagaaaataaagtgaaaaaaaagctggtggttataacaaatagagtttcattttcaatgcgattattgaacaagctagtctaagagaactttgtttgagagggagtttcattttcaatgcgattattgaacaaactagtctaagagaactttgtttgagaggaaggcaatttaattggagtaataaccaggacagcccaaccctaaaaaattgaacagagtttttataagcaatgaatgggaggttcaattcccactcactgttgttagatctttgccagtgggcttgtctgatcataaccctctgatagttaccactggagaaaacacaatcagtcattccatttttaaatttgaacagtgctggttccttagggaagacttgaataaagtagtggaggaggtctggaacaagagttattcttggaccagtatagaaaaatggcaattgaggcttaaagcccttaggaaaaaaactaaatgggtggaacaatgtcacgcccagaaattcccgaatagaattgcaagcagaatgtgcataaaaattcctgtccaggaccggccggggtacacaaacgacaatgttgacattcagatccacgtcttacaaccatcataaaagtcttacataaatgcagcggaaaaacgaaagacaacaggagctaagccttgactagatctgcagcgggaacagcactccacaggcatcatcgacggcacggacgaagcctactcctcggagaaacctccatctgacacatactcgtactctggggttggaaaaaaatagagcaagactgagtactacccactgtactcagcaagtcataccggaataggggtatgatgtagggaattatcaaaggagagctagagtggttcatttgcataaagcgagtatttataaacagaagtttaaagaagaaaacggtcgtaataattaatcaatattaatcatccactgtccaacgctataccacgttgcgacaggcccaaccagattgtgccgtgttcatcttcatggaaatcccgggcttttccgactctcatgttctttttcagctctgctatttcaggatcatttacttgagctgctctgacttgatccacgagcgtaggccgtgcctccagaacggctacgaacccgtgttcaacaattgccacgttgagatgctcaaactcctgccgcaattcctcacacatgccctcgatgcatagggcagtgtagtaactcttcctgcttaatgcgtctgccaccacattggctttcccctggtggtagtgaatgctcatatcatagtctttgattaattccaaccatttttgttgtcggagatttaggtccggttgggtgaagatgtatttcagactcttgtgatccgtatatacttcacagcggttgccaatcagatagtgcctccagatcttcaaagcatgaaccactgctgccaattctaggtcatgagttggataattcccttcgtgtggacacaactgccgcgaggcatacgcaaccactcttccctcttgcattaggacacatccaagtccgtggcgggatgcatcgcagtagacttggaagtctttcatctggtcgggcagaatcaaaactggtgcggatactaatttctttttgagctcctcaaaactcttatcgcactcagctgtccatttaaacttctcatctttcttaagcaactgagtcatgggtcgagcgatcctggagaagttttcgatgaatcggcgttaataacctgcaagttcaagaaaacttcgaatctgcgacaggtcttaggtggggtccatttggtaactgactccacgttcgatggatcaactgccacgccctgagctgtaatgacgtgacccagaaatttgacttcagacaaccaaaagtcacacttgctgaacttggcgtataactggtgctccttcaactcctcgagtaccagacggagatgttgctcatgttcttcttcagactttgaatagataagtatgtcgtcgatgaaaacgacaacaaacttgtccagaaattccatgaacactttgtttatcagattcatgaagaatgcgggtgcgttggtaagtccgaaagacatgaccgtgcactcatacagcccgtaccgagtggtgaaggccgtctttggaatatcctcttcccgaattctcaactggtggtagcctgatcgcaggtctatcttagaaaacactttagctcctttcagttgatcaaacaaatcatcaattcgcggcaaaggatatttgttcttgattgtgacctcgttgagtgcgcgataatcaacgcctcctcttcgtcttatccttcttctccacaaaaatgaccggagcaccctaaggtaaagtacttggtcgaatgtaccctttctgcagctgctcatcaacctgcttcttgacctctgctagttcgttggccgccatcctgtacggtctcttgtaaattggcgcggttcccggtgccaaatcaattcggaattcaatctctcgcttgggtggcatggtagtgaggtcttcgggaaagacttctgggtactcgcaaactatgggaatctcttccaatttcctcggattcttctcctcggtgaccactgggatttccgcctcaatctgattcaaggagacccgttgctttggtgagactagtgatttgtacactacggtttctcccttcttgttggtcaaggtgactgtgcgattcgcacaatcaatgactcccttgaacttggtcagccaatccatcccaagaatgacatctaggtctttggattcaagaagaatgaggttggctagaaatggtgatctttggatttctattagcactgaagggctaaaactgaccgaggttgaactatttcccagggtatgaaccctcattggtgtattaagctcttctttccttaacccatgcatccccacaaatttctttgaaatgaaagaatgcgttgcaccggaatcaaaaagtactgttgcagggattgagctaacaagaaatgtacccagtacgacctctggtgctgcttgtgcctcctccgcagatgcgtggttgacacgagcctggacaatccttggcccggcacgcctaggcttcgggcatttgtcagcgaagtggccaagctcgccacagttgaagcaggaccctggttttgttccagtctccttcttggcttgcgcggacgggcctgactgtgccggtgccactggtgggcgtggagctgcaccgcggttgggctgacctccatggtggttttgactgccactggcgccctggtggaagttgctagagttgaacgggcggtactggcagatgatcatggtggtaggtccaccctgctgcccgggagcgaagcgcagtcgctgatggtttccttggttggaccggaactgtgccgcctttctcttcccgtccatcttgttttgctgatcctcctgacggattgccttgtccaccagcctttcaaaatccgcgtagtccccagatatcagttggttggtcagctcgtcatccagacctgccatgaacttttcctgcttctcggcgtcagtgcggacatcctccggtgcatatcgcgcgaggcgatggaactcatggaggtactcggtcactgtcctgttgccctgatggagtgcctggaattccctcttcttttgtgccacgaccccgtctggcacctacgccttcctgaagctacgacagaactccgcccaagtgacttcagtgcctggcgggcgggtggccatgtgattgtcccaccaagctgacgcaggaccttgaagctggtgtgtggcgaaagcgaccttctcctgatcattgcactgcaggagatttagcttcttctctatggcatggagccagtcattcgcctccatggggttggtggtgctggagaaagtgggtggtctaacgcgtagaaactctggcaacttggactgagagggagggggaccaaactgctggtgctgctgttcggcgtgctgcagcatcctttggtgcatctgctggtgctggtgctgcatctgctgcatcatggctgccatcatctgcgtctgatgtgccatcacttgggctagcgtcggattctcaggaagtggtggcggaccattgccagaatcactgttgggatgcacaccatcagcgcgctcttcgccgttgctgccctcgccggttgtgcggctaccattcctggtgtagaccatctggaggaaaagcagacggggggggggggaagaagaaaaacagatgctcaagaactaagctttattatataggaatttaaactgcaattgttctgatctgaattaaaacacttaaacagcaagcaaaatccttattaagacagccatatcataggcacatgatatcgaccgtcgactgaccccaagcaagcaacttaaacacacaaactaacaagcagaagctagacagtcgataagctaatggaaaacgagcctaatgctcggaacggctcctacggtcggtggagtcgaaggcgtcctcctgctcgtcaccaggtccctctgagcgactcctagagcctggcagataagtctcgccgctgcccggctctgagccactggagctgctgctgctgaggtcgcgactgccactgggagtagctggcaaccaacctccattgccactggcggggaccctgacggctaatgcaggcgcgaaggagagagcggatgcaggagctgacacgggaacgagagctggagctggtgctggagctgcaggaactgctggagctgtgggcggaactggaggtgctgcgggagctgctgatggaggtgggttcctgggcgcaagctggatgcacacgggtgtcgttgtcgacttgcggggcgtagtgcggatccggactcctcctggcgcgggaagaccctttaactgagcattctccctcttcaggcgcgctatcttgtccttcagagtgacgatcctcatgagcttcccatcattcaaggccttggacgccttgtgcagatccgagtgcatcctatccaatcccctcatcacagcacacatgtgaccaaaggtggtgtcgttatcgccggctgtcggacggaaagtactgacatcatcaccgctggctcgacgagggtgaaatcggtacgccgtgtcgtggaagatgtagttgtggcgctcccgtagtttggccatcatcaggtatgctgcctcctgacaagcgtgatctgctgtgtctccggacgcctcaaccaccatgttagcgaggcaggtgcccacatagccatggacctctaggcggacacggtgaggaagctcgccactgagtggtggaacagttgtgtactctggcgcgttggggtagcccaccaccagcgtcatacgtgctaactctgccacaaagtcaatcatgccttctccgtggtggttgggtgggtggccggctatctagagaagacaaaggagtaggatcaatgcatgctcaaatccaaatttaaataaagcaataaaggactcaaataagagaatcgaataagagcaagattttatgcatagatcattttgcatgagggcgaataaataagacagacttacataacgatacaataatggggaaattagatacatactaataataacaataaaagcagaagtaccttgcaacacatattcctgagctaggacctaatgcatttcacccatcaaatcccaactgattgacgaataaaactcaagtaattttactaaaaccctagactgacttgttttgacaaatctcacttaaacgagcgaccaagatttttcccttgaaccacaagaacagatcccaattttcccggaacaaatccaattgtaaagaacatatgcaatgaaaaggattcagagggctcttaggtttttccatttggcttgtcctacggtcaaggtcggctctgataccaacttgtcacgcccagaaatttccgaatagaattccaagcagaatgtgcgttaaaattcccgtccaggaccggccggggtacacaaacgacaatgttgacattcagatccacgtcttacaaacatcataaaagtcttacataaatgcagcgaaaaaacgaaagacaacaggagctaagccttgactagatctgcagcgggaacagcactccacaggcatcctcgacggcacggacgaagcctactcctcggagaaacctacatctgacacatactcgtactctggggttgggaaaaaatagagcaagactgagtactacccactgtactcagcaagtcataccggaataggggtatgatgcagggaattatcaaaggagagctagagtggttcatttgcataaagcgagcatttataaacagaagtttaaagaagaaaacggtcataataattaatcaatattaatcatctactgtccaacgctataccacgttgcgacaggcccaaccatccacctatactatccaatttcaaaagactaaactaggtgagactaattacggtgaatctggttgaccgcccataaccgcgggcatggctattcgaatagttttactctgatcagagatgtacaactgtacccacaagacatagccccacgacacgtttccgtgcgccgacatgccaccacgacataccggaaagaggccgtgacaggactcttcgcataaccccctctagccaagcacaccacacctcaggtttcacccccgtccccagtgggcgacgggcagtcccctctcgtgcctaggtgaatccggaagccgcataggccgtcgcagggcccatccaaactccatcacgcccacccttgcctggatgcgtcagctagagaaaagctacactgggtgcaggaa

SEQ ID NO: 12804 - DNA, 712 bp, Oryza sativa
gttgaaagaaaaaaatcgtgttttggttgagatggctagaatgatgttggatgaatacaacactcctagaaaattttgggctgaggcgattaacactacatgttatatttcaaatcaagttttcttgagatcaaaacttggaaaaacttcttatgaacttttaattggtcatgaacccaaagtttcacatttgcgtgtttttggttgcaagtgctttgtcttgaaatctggaaatttggacaagtttgaggcacgttctaccgatggattgtttcttggctaccccgcacatactcgtggctatcgtgtacttattttggagactaacaaaatcgttgagacttgcgaagtttcttttgatgaggctagtccaggtactagacccgaatttgtaggtacactgtcacaggttcagggggaggatggtcgtatttttgaagatgagagcgactacgacgacgatgacgaggtcggctcggccggtcagaccgggcgccaggccggtcagaccgggcgccagcacacctccggtcagaccggctcaggaggagcggtcagaccggccaggttcgtcgggttcaggtactgatgatgctgatcgagatggacctccagagaattcaacttcgaccagtactgaaacagaacgtggatcaacttcagaagttgctgctcctttacacattcaatgacgacatccgccggaacaaat

SEQ ID NO: 12805 - DNA, 4334 bp, Oryza sativa
catcttctatatgcttaagtggatattccgatgctgattttggaggttgtagaattgataggaaaagtactagtggaacatgtcattttcttggtacatcattgattgcatggtcttctagaaaacaatctagtgttgctcaatcaattgctgaatctgaatatgttgttgctgctagttgttgttcacagattctttggcttttatctactttgaaagattatggtcttacttttgagaaagtacatctcttttgtgataatacaagtgctattaacattgctaagaatcatgttcaacactcacgcacaaagcacattgacattcgctttcactttctgagggatcatgttgagaagggagatgttgaattgcagtttttggacacaaagttgcaaattgctgatattttcactaaacctttggattctaattgctttgcttttcttcgtggtgaattgggaataattcatccttttggcatggtttgagggggagtttgtacctcatggttttatcaagcaaaaatatgacaatgagaaaaattgataaaaaaaaagagctttgtttatgcatattgtattttcttgtgcatgctagcaatactttgaaggtttatttgtctctagcatagtttgtatgtattctagtcttttcatgagacttagattttgcttttaagggagatgatgcatgacacttaaattctatacttgaattaagaaaatatgcaatgttggtgctagcatatggtttgatttataaatgctccatatatatgctttattgacttgttattcctcaaatagctttaattgctcattgtgaaaaagagaataaaaatatgaaaaaaaaaatgaataccgaatccttggaaacagtcttgacgacaaggacgtattcgatgtgagcaaaataatgggtgccgaatccctggaaacagtcttgacgacagggacgtacccggaataaaaaaagagaaaaatatgagcaaaaaggctcaagaaaagaaaaggtaaaaaaattctctttgttgttttgtgctaaaaagttatttgagaaagagtgataaatgcaataggtatatgtgtttagtgtttattcttcaacctatgtgcttgttaagatgttgcattataaatcgtatgaaaatcatgaattttgattgttgattcaagcttaattgtaaaatctttggttcatggttatactttaatgcatgcttgttatattatagatgggttcatcttctttttattgcaacacatgacttgatatgctatatgtatgctaagctcttgaacattaatgaacataattcctatgcttgatgaaatcattttcaaaagagggagaagtaatgtgaaaattttttggagcaaggtgaatttttggagagttgttgagaagagcatgttttttggttcaattgggaatttctttcttttaaaaagggggagaagttttcttttggatttttgagcacgatgtgtacgtttttacgaagtgtgctttttaccacttttgtttttatttttccaaacacaaaaacatttttaatgggtttgccaatgtgttcatcaagggggagattgtaaaatcaaaggtgtttattattattattttgtgatgaacaattggcatcggagattattggttttgttatttggaatttatttacgaagtggttttggagatgattggatttgcaggtgctgtgattttatgtggaccggttagaccgggcatgtgctgccagtcagaccggcgtgtatcgcgcggtcagaccggcgcagcccgcggtctgaccggccgactctgtgtcggtttcggttttgggttgtttatttggatatccgtgattatttcatgattatggcttctagatggatactatacgaatgtaatactgttgtttgctactaatgagtcaagttggagatagcttggtctcggaatatggtttctttgtttgttccatgtgtaggtgactcgatgcctcgggagagtatttgcggtgatagaccgggagtcggcttggggataagacgacgtccgtggtggtcagagatcatgcaggatacttaggctagagttgatgcacgtggttgatggagattccatatggcatacgatggagttattgtgtgcgtatgggatgcggagtcgaatttggaaggagtccaaatttggtacgattggttatgtaaagtttctttcttgtactagagggtttcctaaggtgtttaggactcctagtatgagtttggttcgtggctctaggctgcctacctcgggtataaatagagggggagcgtgaggcttcctggtatcgcttttaagagaaattgagttgagttttaagttagggtttcgagtttagtcaaaatttttgtaaggagtgctgtaggtgcactttgtaaacatagagagaagtaataaagtcgtcatccactttaagagttcttcgatttgtgtttcaccgggtttcggcggtctaaccggcgacacaccggcggtcagaccggcggcatcgcggcggtcagaccggcggcggcgacaggcgcagcagggatttcagggcggtccaaccgggagatctacaccggtcagactggcggctatgcttcggtcagaccggctaatctactccggtcagaccgatctcatcgaattcgagagtaacttttatttccgctaaaagtttttggtttttgggtatatcaaccattcaaccccccctggttggcttagttcttgctattcgatcctacacccgctggttcggttgtagagtgtgtgttcgtctcactgctgaaagcccttgtcaggccgaaatctgaaatctttgccttgaaatttgcagtaagaaggatgttgtgggccttcacatctctatggatcaatggtggactgcaggacctgtgcaggtattccagtcctacatgcatgaatagttaaaaaataaaacatcagatatggataaatgatcataatgctgaaaatttgaagtattattaagaggggcattcaggtcaatatacagatatcagcccgtattatcgaaagagagaaagaaaaacttcgaagcttgttggttaccattggcagagtccaacgcaatgttaaggcgttgcaaccaagtgaggggttcagtgtgaagatcttcttgacctgtgaaaaagaaatcatggaatctgcaatatgaggcttatctttacaataatgaaaaatcggcttctgaggtaaagttctgcaaacctctcaagtggtctgctaggcttcccccatccatgtactcatacacaagggctagatgtttcttatcgttgcaatagcctattaatgacaccaggtttctgtgatggaccctggctaagtgctgagcctgtaatacaacaaatgagaattccaagaaatttatgataattgataaattactatacttttaattcatcagttctaactacacacaattgtataatccaatgatcaataacttcttgtagtccattgtattggcagagtaatgtatgtgtacctcagccaaaaactctgttttcccttgattagatgtttgtgatctcatcttcacagcaacgggagttccattctctagatagccaaggtatacaggaccaaacccaccccttccaattatggttttgaaactatctgcgatgagcttgagttccttgtacttgaatctccggttctcaaatggattagttgcaccagtaacatctgctggtcacatgagtataatatcaactggaagagaagcatacgctacattctcatagtgaagctaaaattctcttctttatgtacattcatttagttacctggtctcttctttctgcagtaccaaaatatagcaagtataagtagaactacaaacacaagtacgactgggggaacaacctcaagcacaagttttgtctttctcttgctttgattcagaatcagatcgcatttgtcagttccacaaagattcggattattctcggtcctaaaagaacaaaatatattggtcagattgcaatatattggaagtaaggaattaggtcttgtcagatcccttcatactttcattgagttagaaataaggtacatctcagtggtatagcgcaaggcagttcatatgtcactgctcgaggcgataccatgatagtggcataacagggccttaggattctcatggttgacaaaagtgatttgaacattagtatctagcttatgaatgaaagacaagaatccattcaaacacaactgaagttctgagagacttgagtgatattttccatgaaagtggggtttcctttcaatattga

SEQ ID NO: 12806 - DNA, 28618 bp, Oryza sativa
  unsure (1)..(28618): unsure at all n locations
nnnnnnnnnnnnnnnnnnnnnnnnnnnnnnnnnnnnnnnnnnnnnnnnnnnnnnnnnnnnnnnnnnnnnnnnccatagactaaaattcgacactatgttttcccaacttctactaccttatttttcgtgcgctcacccctgaaatactcgacgatgtatattttgcaaaaaaaaaaaactatacaaaaattgctttaaaaaaatcatatttgtccatttttaagtttttaagctatcactcccttcatctcaaaatataagcgattatagatagataggatacatcctagtactaagaaactaggtagacttttgtgtacattcttagaactataatgtatatcattcatccaaaatctcttatattttagaacggaggtaattaatcatgcgcggatgacttaccttgttttccgtgccagagaccacaaccttgtctatatctctactattttcctcaaaaggtttctgtcccgctaatccaaaaggcaaaggcaaattcaaacaaaatcagtttcaaaccataattttgatgggatcagctgtatggactcaatatgtcgcattttctactagggagcacatgaaacatgataaggcatatgtgaaaaatcaaattaactactgccaataaaaccaagtgattcatcaagcaacagcataattatacagtatctgcactacattattcctacactggttatacaagatgatccaaaagggttatgaggtgaaatcactatgcttctccattgacttcagccctcgaatccaaatgcgacttcccgtcgtcgctgccctgcaatgattcgtccattaaacggaataaagaagagttcaacaaagaagttgagatgattctggtaagaaagtagatggctaacctttatacagacataaatatagtgaacatcaggttttgggccaagaagactaacaattgatgtgctatcaccatctaaaggcagtggcttcgtcagttcccatgaaggctcccgactcctttcccatctatctgggatgtcgagagtgtcaattcaagagtgtaaattaaatgtgttttagcacaactataatgagtggcaggtaaaatgtttactccgcacactaatggcgataccaattgccctttatagcttgacaattttgaagtaccaatgaatggacaaatggtttagctgatctcacggaaaaaaacttactaacctatgacatgaagctttactgtccaaagctgcaggtctttaaggagacgcaatcgataacttgggtcgccataagtgatctgcaacattgtgggatccaaagttaagttctagacactataaaagaacagcatgcttgtgtaaacaaataatatagttcctttaccagaatataaactcccttgtccttgagaattctgtagatagaagaaagaaatagaagctatagtaagttaaacggagatttcacaaacaaataaagtgcgtgatttacctattgacctcctctagcatctgagacgcattctcttgtgaattttggccacactgcaatacaagaaatgcaaatctgagtaccatgaaggaagaaaatttgagtatgttgtacactggcaaaaatgggctcaccattatagaatctagcgttcctgcaaacaacagatggggttagaacccaatgacatgttgcatatgcacatagcaaatgctcctggtaagactgtaaccactatatttactatggtacctttgtcaataacagcatcgaatgaacctgactcgaattcagccatgttccttacatccatcttcatgtctgtgtaaggtaggaaataaatagtaccacatgacaagataaactattacactcactaagggattcagcaaaaaaaggctggggacgaagagtatacatttaaggtgaggcttgtcacgatatttcttcttcatttgatcaatcaccactgatgatatatctatgttgacgatgtcttgataaccatcatcaaccatgttttcaccaaaaactgttcagtgtttaaaggcagattatttaaacaagaaatgccaacttaaaatagaaaaatccactaggcaggaatgcagagtaatatacagaactttggagttctatacataattgttttttgagattaatgactgaaattgagaaatatctcagtccccaactatcagcaatacaattaataacttaaaatagagaatttagatggtcatgtagttcaagatgttgaagatcatcgatggcattcctcgattttcatctgttatttaaactccacctcaaaccattgtcatatgttatttaagtcagataatagtataaatcaaacagggggtcttttctgtataaaagaccaatattatgatcaaaatactatcacagttttgcttatgaaggaatgtagtacatgaatttccctattgccactcaaaaaagttttccatattgacagtaatgaaggtttgttgattcaaattgctagctttctttgtcactttatagtacaaggtggacctgtcttgctgcaagtgcattttcatatgctgtggcactaaccagagcctatacacagtgctgtccatcattttgtgctatgtgcatttttagctggacaatgcaatgttgacaaaggacaggggaccataatgcaccgcattccgcacatggttctagacagaccgatcaaattcagcaggtatttcgacaaattgacaggccatgccactctaaacccatcgatcgcacccatgttgtcacgatgtgccaaaatggcaagttcttcgattgtaatgcatttcttcaagcatatgaaccctaatgtcgaacggatgcagtttaatcatagccttaatttctaggagcagcattgaacaaaccaagaaattccaaggatccatagaaaatgtctagctgcattacactccgcgctgatccaaacaagaaaacggcggcctgcgttgcactatggcgctgattcaaacaacaattttcgcccgggcctgatccaaacagtaatcctttcaggaatcccaacccatgtcgaaatcacacgaaacctgagtctgatttcatcccaccagcaatcccgcgcggaaatcccaggaaatggacgagacaccaatcaaagagccctcgatctagtagcggcggaggggagggggatgtatgatataatcagaggggctcaggggagtagtgtggcagtgcactaaccggagttgccgcagccggcgaggaggaggcggtggtggcggcggacgtagacggcgagcagcggcgcgagggcggggtacttctggtaccagtcgaacgggccggcctccttcctgtaccgctcgtcccagtaccacgcctccccgtacgcctgcgccgccgtgcctcctccaccccctccccctcccgtcatcctcggcgccgccgcggatctggccgccgggaatgccccgcctccgccggatcggtggccgcggggtcgcgtcgcgtgtccccttcttcgctggtgccgacgcgacgcgaaacggtggtggataaggatcgcctcgccggggggcggcgagaggctgagatgggccggaggacgccgggggtttgggcccagctccggagtggttcgaggtgggccgccatggactttcggcttcccaaattttgacgatcatctcttttttgaaaaaaaaaaaaacttgttcccaacttattttgaaataaaacgtaaacttgcacgctgaagttttggccgcgttgaagggagtagaagcggcagctcacaggcgtatggtgcacatctagctggagtccgactcactgatgctggttcaagctctgaaggaaggtaatctacaatttgcagcgatgggggtcttgtcctgggagcgaagaagattatagcttcgacttttatttcttttcgagttagctatttgtccccgtgaatataataaattggcagatgctatagcatcgtttggctgtaacagtccccaaaactctgttctcagttgggacggttcacctccgggtgtggaggtcttggttatcggcgattctgttgaaactatgggttaatggaaacaactagttttcctctataaaaaaaaggtaaatttcactacttttaccaaactatcagaaaactacatatttaagaatgtgtatcataaaactacatatttagtgcaaaatttattacgaaactatagatttaaaatattgtatcacaaattatagatttacagtaagacaaattttgctgcagggtattgtgactttgcgttttagttataggacactgtactaagtgacttttaagggaatacactctcaaagttggatatttactgctggacacctcacccattaaaataacaatttctggttgaagaagagataaaccacgtgaaatgtcagaaatgcccttagacccatatgttaactctcttatctattttctctctctatccccttctttcagcgcggcatcggatccccgcgagctaatgctgtaagtttggttattgtttgaggtgtttggtgagttttcctcgtgaagaagctaggtgttctcattttttctcataactatcttggtttttactttttcttattgacatatataatttgtactttttctacctgattagtttaaaaaagcctgcatatagcgtcacggcggtggtaggtcggcgccaaaacacccggcgttgagatattggatattagcactatcaggggtgaggctgtgggtagtttttcattttaagtttaggcattggcctattatttaaataagtttttttttgaagggccaaactctcaaatttggtgctttgcttcttctccttggcgtcctcgcatcatcccaggtgagtggtgagcaaccgttgcttccaacggaggcgacgtgccgtgcattgcaaaactggaggatatgtttcgcttccgtcgccggcgacaattaacgccggcaattacgcagcagctagctttagctctagcagtgacaggacaaaagacgcgccttttgcaggggatctgtacaacacgtacacgctgacgctgaaaagagagagcacgcaaatttggcaatgcgattgagctgaaccatgaacaacactctccaaatcaaattacacttatagcggtatattttaaagcaaagcgaacggctcaaaattacattgtagtaataatatataaattacactgcagttgcatatgagtcataatataattacattgtcattgtactgtattttatatctgttcaattttagaagaaaatttattgataaatatctagcaaaaatagttggacaatggaatatattaaatccagcctaaaatcaaatggacacttttttgtgatcagcgtcgtgtggctcgtgccgaatgagtccaagagcgtgtacttaattcaacgaataataaaagcatatggtgtaaggtagtagtatgcttaatttaatccaacttgggctgatctcttgtggcgtagcacaaaatttaggtgtctatctaatctaagctttagattagcaaggacagtcaaaaagggatgggcaatatcaaagagacgcgatcttgtggaattttgtcgatccctggcattgatctcagagggagactttgagtgattgaaaaattatatgctctacacatgctactagatagatacatgcattaattacatgagagaaagaaagaggaaaagaaaatcacagacaataagagcaggtacaatagtatactataagccagctataaacatattttaaagagataaaggaagagagagaagagcagcggactacagatctgtagccagctgcagcgcggactccaagacgcaatgtgtgtatgacaggtgggatcgtatagtaagtaactattatatgaattagctataaatgaattggagctagtagtgggctatactattaaacttgctctaatcttatagctaattctactattttcatgacacacatgagaagaaaaaagtgcaacatgcaatcaactcaaattttaatctcttctcgatacaccaccacagtcggcagctctacgacaaactcttcaaccttttaatacaaccaaatcaaattgttccaaaattatttaaccatacatttttgctcctggggtagggtgttgcggttccggatgacgtccgttgtgcctgtgcccctccccaatagttctacacgaccagctttgttgatgcagccatagcgccgcccacaaactcgtagacgtcgcgtctgtgttggagacaggcctataattttgctggaatttttttggtggtggggaggagacgagcgagctaggctggacaaaggcaggggcaggcagcgctgtggattgaaaaacagtgattaatttctatgtcttgggctctgctcgatgaagagggcggtaacgaccagggacagggagtgatctctgcctccacatctcggtgacgcatcgacataaacctctacagccgccttgaaccgtttgggctaggctgctagggttattgcccccggaatgaataaattgtggattacaccctctgttaactgtaaaattacaatagtatcatgaattccttttttttttcagagttgcccctctactacacctagtacactcgttacccccttagtagaaatcaatctcctccttattatcctatcttatgaacggctaacattcacatgtgtactttaaaaaattcctagttaggagttagctccactattaagggctcattcagattgaggggttttgaaaggattctcatgagagactgttgacagaaaacttttcctttcctcccatttggtggctcaaaacggtcataagataaatgaaggaagttttgggcattatctaaaaaaaatgaaggaatatttcatttgtcactgactcactgtccctggaggacaaccaagggaaaaaaaatctgcccaaatctcatgtgaaaaattctatgcaccacaccaccgacgagatcaatcttctttctttgctcactgaccatgtgacagtgctagggcccagttgtcagctggttttaaatttgtttgtcggttatttatgttgcattccttcaaaaaccattcttatgttttttcaaccatccaaacgcccatcccacaattttttttcgaatgcgcaaaagaattgcacgtcaatatattaaaagaaaagagttatagttacaccacgtaatcaacaagaccggcctatgccaggggaaaggaggaaaagcaaaaaaaaagaaaaaaaaactgaagcttagaaaaaactatggcggctaaaacaaaactctaaacatcgggaagggactgagccacgctatactcccaacaagtccccaaaagcggcaacgccagctaacgatcatagacagacctccgagtggatcaactccagaaccactgagatagaagagagctcagagtcgaaaaccctagcgtttcgctcctcccgcaactgccaagaccgtcccacaaaattcctatatcatcagatcctctgttttatctacgcgttcctatcaaattcctttgtttttctcattccttcatttttccaatcacgtattccggacaaaggcctaaacctgctctgatcgagatagaggacgaaagattatagccctcctgaatcctatgcacgcggtggtggtgtgtgtacaggcgctcacgcgcggcggcgcgcggcgcacacgaaacgcgcggggcgtgtgggcaattggcaaagcagcccgcagcagcaagatccactaggcgtgacgcgggcatgggcgtcggcgtggcagggaaagcgggcgtacgcgcgtataaaaatgaggcaccaccccgagacggaaggaaaggaaaggagcggaggcgagcgacgacacgcgcgcgacaaaatatagcagtttagcaatcagccaaaattaattaaggaagggggaggaggaggattacgttgccctcctcgccgctaaaccaaccagattagctgccgggaattatttcatcccggcgagacccttccgcccgctagctcccgcgcgcgctgttccggccgccgccgagctggtcggagtcggaggcgaccgccgatagccctgccggcgagagatcgatcgatcggcgtcgccgatccgacatatccaatggtacgtgtgttcatccaaatgcgcatatatatatatatatatatatgctctatctatctttcggcgatgaattcgccgccgtccggccacgcgccgccgtggtcgcgcggcggcggccttcgatgagattccgatcgatggttctttcgacgacggcgacgccgatcgacatgcatatgcctgccacgccacttggcactagctagctccatctatcgattctttcttttctttctccctgctttttgcaatttgcatgccctctctcttccgtctccctttccgttctcgcttttggccttcgttactttcaaatctcttgacatgcaaatgcattgaaaaaaaacatattctcaaacttcataactcatcaggtccatatgtcagcgacccacgttaaaaaattgcattcgaatcgaccgacctctcttactgcaagctctccatttttctcaccgtcaaccacacaagatagcacatgacggctacagatcgaaagcttacacgaatatatccattctgaaagaagaagaagaaaaaagaggcatcggttaatttgcttttcgttgcagaaaagaaaccaggcgtacgcaactacgcatacatacatgtcggcctcgatccacactccaaaacggaatatatttctttttcccctccttgtttttcttggcccgattggccggccattgcatcgctgacctcttctccacccttgttgataatttgatttataatcgagtcgtcgttctcgccaattggccggcgacaccttcagctacctcttagattcctttcctctcatcgttttctaaaatcacacgtctacatatatagtaccgaaagaaaaaaaacaattaaaaagttcagataaacatattctgtcacctactgctaataataatgggaatattatactacgtcgtgttgtacagaaaaattcgatcttggtcagttggtcagacgtttcgcgtccttttctcccctcccactacctcccgttcgttgtaatttagctcatttcttcgcgttgccgatttggaaattggaagtttcacacgcagcatcgcttgttcttgttcttaattggttatctgactgcgacactacgtacaataataattaaggtagtagtagcagcatatttttttttcacttgtgtgatttaattcgtctccttgcatttttctggttctctgttgctgttgttctcttgtgccagcctttcgttttcctctgtttgcttcgatcgatctgaaactctcccatagttttactcgtctctgtctgacaaaattactactgtagattaattactcttttgtattaatatcatattttgcatcgaagcatgcaactggggttgcttggtcattttctgagcccgtgactgacgacgagacgaacaaaaacctcaccgtccagctctcgccaatcgatgctgatgcaggttgagtcggggagcgaggcggcggcggcgacggcggcggcggtgctgacggcgccgctgtccctggagggcggcctcgcggcggagctccggccggcgaacctcgtgcagcgcgtgctcagcctcttccgcaacgtccgacccggctccgatctctctcactttcaggtaccaaatcatcaaactgaaactgatccccagctcagctgctagccattcttgatcctagctaggcatagcattgtgtgattaattgtgtgcatgcatttgaaactccaatctcgagagtgtttaaatttggatttactactagttaatctaatcacttcaggtcaggagcattatatcaccctgaaatcagcaatgattttggggagggagtgactagctagtggagtagtgtactctactccactaattaatcatgaggattagtttttgcttgtgggatatgaggagtagtagtaggtgttgagtaaaccaagagaacaagcttcaatacttttaagagaaaacaaaacaagcttcaatagttgaacaacacttccttgctcacttttataaggagtattttgatttcgagaaagtcaaatgaactttgaatattttggctaacgacggttagtaataatacaactatatttggtgcataaaagttgtgcctatatatttgtatttcaaatcaggagctttcacataatactgctctactaattaatcatgtggattagtctttgtttgtgggaaatgaggagtagtaggtgttgagcgaacaaaaaaacaagctgacttttcaaaaaataaaatcaacacaagcttcaagagttgaatagtattgctacttgcgtagttgcatatgtaagcatgatgaacggcatagtccatgggggcacgcctgtttttcaacaaaaggaactcaaatttcggatgtggattcgtgattgcttagtttgacagctttcggtttctcagtaggggataaatgttaactaatgtggtcaacactttcagtttcctggcacctagcctaatcaattactatcatctaatcagtcactgtctagcagtaatttcgcagtcaaaatgacgttaatttgactgaattttttcatctgaatttgtctgaatttttgtcatcatcagctgcctgctacgttcaacctgccgaagtcgcagctccagttatacggcgagggagtgtactgcgtcggaaaagactacctgcggcggtgcgcgaaggggagcgacgccgtcgagcggttcgcggcggtcgtcggctggagcatctcgacgacgaggcctcccatcttcggcttcgcgccgtacaaccccgttcttggagagacccaccatgtctccagcggatcactccatgttcttctcgagcaggtgattcatcacaatgtcatgcgttaaatttgtagtttcgcgataaatttggtgttaaaatatgtagccatgtatctgtagttttgtgaaatttacagatgatttgtttctgaatctctgacagaaaattgtggtctttttcaggtgtctcatcgtcctccggtctctgcactgcatgccactgacgatgacggtgagatcgagctcgtctggtgccaaaacccaatcccgaaattccacggtacgtaggccagattcagaatgaaattctactccatttcctgcccatcaatttccaagtttcagagtctgaaattctactccatttcctgctcatttctgaaggcacaagcgtggaagcgacagtgaaaggcatgaggcacgtcaagcttctgaaattcagcgagaattacgagatcgactgcccaaacctgctcatcaggttgctgcctgctccatcagcggagtggtctgggacagtcaggatcgtctgcaaggagtccgagctcgaagcagagttgatctactacaggagcaacgctttcctgggactaggtggcgatccaagatgtgttaagggtaagatattcagctcaagatcaggagagatcatctgcgagattgatggacattgggatcggatcgtgtcggcgaaggatgcgaagaccgggaaggtgtcggttctgtacgatgctgaatccgccattgctgacctcaagacacctgtggtcagaaaccaagaggtaacttctttctgacaatttgtgctcacaagaaatctgaactttgtgcattttttcatgctgcaagttcagatggcagtatcccagagataaaattcagactaagtccacatatgattcaattcaacaactgcaacgtacaaactaagcaggaaaaaagaaaaaaatatcactgaattaggaaccaaagatgtactaacttatgaaaacctcactgaccattgttaccctaccaattatgttcacaagaactctgaactttggccatgtagataaaattcagtctaactgatttcattttcagtcgttcaacaaaactttaacctacaaactaagcagaaaatcagtgaccaatactgaatttgtcatgattgtgtttcagggcgtgtcaccttcagaatctgtggtggtttggggcgaggtgagcgatgccatcctgaagaaagactgggagagatctagtcaggcgaagcgacgagtggaggacacggcgaggaggctagacagagagaggaacgacaagggagaggtctggattcccaagcatttctcgctgtctcaggacaagaacggcagctgggaatgctcgccgctggagaaatctgtgcctccagctccgatcattgtcccctcatgactgtagattacatgtaacagatgatcctatatatactatataaatctataacatagctgatgatttgattttttttaacttgtcaagtgaagtatggccgattctttgcgtttttatagttttcttcaataacagaattatctcaaacagtagctactcataagatcgggccgcatgacatagcctaagattggttgagctacaaccggtaagcggtagaaatatgaaaaaaacgatcatagtaatttatagggaaaacttttatatttatattatgaacggtctaaaatacaatggtagattacactaaattcggaaaatagactatgatgaaaaatcacaagatcagctttaaaaacaagtttaaaaaataaaaaaaattagctgcgacgatgagagcatacacagtggcaaatcatcgatctccgctgaaacagttagggagcaatttttttttcacaaatatgtgctatatttttcatttcttgtaatctatctacataatttcttccccacttgttaattaagttagcagtgggagaaacatctaggagtaatttgtaagcaagttttacaactgctatacatacacgaggagttctgaacttctgattactattgtcagtgtcagaaaatcctacaataactcttgcttgaaatggaacaagagcaatgcaggtagcagcagcagcagagaccacagctggttgtgccgcgtgctcgccgccgacgatgacggcatcatccgcttgctcgccgacgacggcatcgtcatccacgccggctgatcggcgctcccggcaccattgatgtcctccgtcggaggcggctggtagctgattatcccggcgccattgttgccagccggaggaggtgtgctgcctccggcgccgttctggccattggccggcgacggcgagctaatcagcggagtgacaccggaggtgttcgacctgtgcagaccatgggcaaaagatcgtcggaatgtgagtgttgagatgcgagctactcccttcgttttatattataagactttttcgaattgtccatattcatataaatgttaataaatctagatacatatatatgtctagattcattaacatatatatgaatcatgaatgtgggcaatcatataaagtctcataatatgaaacggaggaagtagttgaaaagagagaaataaatggttgatgaattggggttggttacccggtgggagggaggcagaaggcgatggtgtaggcggcggcgctgcaggtgaaggtgctcgtgccgtcgtcgtaggcgtagctgtaggcgcgcgggcacgccgtcttgaagatggccgagtacgccgtcggccggcacgtcgccggcgtcgcgtacgcgccgctgcagcagtactcctcctccccgaacgcctcgcacgcgctccggcacgccaccgtcccgctgccgccgccgccgtcgacgccgtccacctgcaactccttcggacacgctgcagatatatgctcacgtcagcgcaaacacgtacgacacgcgtgcatggatgcgcgacacgtacagcggttgaggtcggccgtgcagccggtggtggcgcagccgccgccgccgccggtggcgccgccggcctgcgggacggcgacgacggggaggttgtagccgtcgacgaggctcacgtcgtagtagtccaggtcaccggcgccggcgccgccgccgaccttccccagcgtgacctcgaacagcgtcgccggcggcgtggcgcccgtgccgccgcactccaagcggccgccgcagtcgccggtctggcacgcggcggcgccagcggcagcggcggcggcggcgccgccggcgccggagaagtcgcacccggtgcgcgcccatatccggccggaccaccccgccggcgccgggacctgcacgctctgccccgggtcgagcctgaaccccgtcgtggccagctgcggcgtgccggcgccggccagcgtcgccggccatatcgtctgggcgcagtggttggatatcgtgaagctacagctcgccgccattgacgagctccaccactgcgccactagtgcgagcacaaagatcacacacgctggagctctccaacttcttggtgcttccatggcgtgtagcctagctagctaagctaaagtctctagatgagagagacttgccactgttcttggttttggagggaaatgatttgagagatttgagacatggatggagactttaaactgattggagtttgtttgagatgtgaaagaaagggtttcttggtgagattgatttagcattttgcattttgcatgtatgaggtggcctcattgagaagatataccttatgtaacaatggaagggataaaggtgaaaatgaaattaggagatgactaacagttttattgtacttggtgagtgtgtataccttcagctgttgactacatatgctttgtttcatcagccttaaccaattctcattgtccatataaataccatttatacagcctaaaatactatgttttatgtgaagtatacataaatgataaatgatacaatgcagtgtgaaataagttagggcattcaaattagatcaactagtgcaatttaatatttatgtaccagtctcacactcctatttgtgagaatatcctatgattatccctgaacagtgcttccaaggggacaattttggctatgcattagtaagaagcaagaactacaagaaaggtatcaatttctcacatctaattatactgcatacaaatctaaaaaaattcatcagtataaaactacagactaggtatccaaaaaatatgcctaattctaccgctgtagatccagaaaataaacataccatctttcctaacagattggataaaggatagcttccagttgggtatcacaaataaagaataaccatccagggacaatgaactttatgcttcagagaaaatacgtgcaactactctgctactataggatctatcacacacaaaatgatctcctaagatattagcacatacccagcacaacccttgctaacttcttcctgtgccttactctacccttgtcccttgaagaagccaacaagtgaataaagaccgagagaaatataatgcatgcaagtttgtaaaattcattggaacacaacatacaaattttatcaaaaagaacaactcatgtttccaggttcgtgttcctgagaatagatgacaggagcatagatcaataaagccggtcagcaagaaaggtcacaacatactagtcacaggctcaaacacccatcagaaaggccacaaacagtactttttaatcttgcaaaaccacacaatatgctaaaacagatatatcatcatgcctcatctatgctgtctcctcgttaggtgctccatcaccactcttgggagtatgagaatcatcaacaactgtgacaccctcaaggtctaaggggcgcccagtcatgggatcaataggacgtctgtcgcgaggcccacccttgtgggccatagctagcattggaggtggaggtagaattccagcacggtagaggatgcgctccacaggatccgatggctgtgctccaactgatagccaatacctgatccagggcaatagtggcagatgatgaactttggacagtgtcaatgaagaatgctgaaggatgcactcgaatggtaatgcgtcaattaagcaattagacaacacaaaagatcgaattcaggccctatggctatcagacatcaataggataaaaatgataataaaaacttcacactcattgctatgactaatgccaagttgcttaatttgcaaatataaggaattgcatcatacaaaagtaacaaaacagcttctttctgcataaatctatgagaaaatctaaatagagaatgaaacccccattttttagaatcaacaagacatgcataaaaaaaaactgtctgttatttaccagaaactactggaattttttttagactggtagaaactactgtaattacattatgtcaaaataattattgctagtaatactctagatattgaagattatgcgttcatcctaaagggctaaggcaatatttaggtagatcttgatttgagatttttagtagcaacaaaggatgagtaaattagttgcactttgatctttctatgcttcaagctgtcaacaaaattacaggcattaacaccgatgactagctggatagttgcttcattgaaaaccaacaaaaaagaaaattacgagctgacaataacccaatttcagattgttctgacatgactatgaaccatggtgttcgtttatgatcggttactgtaacaaggataaacactgaaagtatactcacttcacccggtcgaattttaaccccattctcttgccaccatccttccctgcaaaacagccaaatagaatcaccacacttatcatcaaattaacattacacccttcaaactccctattcatcccaagacaccatcaattattgaactacaaacatcccaacatttccaaggcaggtggctctcccccccaagaagacacgacgctggatgaggattccggaagagaagatcacggcaagaggagaatcaaggccaaaggaggagagggtgccgtaccggggagcgggtcgtagtagccgaggacctcgaggtgcttgccgtcgcgcggggagcggctgtcggcggccatgagccggtagaagggcctgttccggcagccgaaccgcgccagcctgatccggacaaccatctccccgccctctccacaccaactcctccgccggcgaccggccggcgctcgccgccgctctgagtctcagaaaaaggcgagggttttaggagaggagagagagagagaggaactggaggtagacgaaagggcaggtatatgggccttttttgggctttttttagcaagttggtccatgattttagagaggtgggcctcttagcaagatagggcttgttgggctttttagcgagatggtcggtaatgggcttgttacttttgttgtgtgggccgtaatgggcttttttagagagatgggcctcgttggtctcactccagctattctcgccgcgttcctcccgcctcatcgccgtatttggacttggaaggagctcactgacctccgcctgccgcgcgtgtggctccagctccgccgccgcggtcgcccgccgctcctcctcgtcggcgagcacagagaggaggttgccttgcttccccgtcaccggcttcctccccacccatcggccggcggcgccgtcctgcccggagccccagagagaagaagagtgagagagaagaggatggaagaaattctctatgctggctgaagcagttcaattgctacaacagcaatccctgccgatcaagtcctatttttccttctagtacctctttatactctggtttttattcagttctcttttcattgttggacttgttcatctactttgttcttcattttctttttattttccttttttttttacagttgcagttcctgctttatttttttccccatgtcttgttttatgtatggatgtctttggtatggtaggtgttgtgtttgctgccaaacttgtcactagaatacgagagaaatgcatgcgtacaagttttggtattggtttacacggggtatttggattaacctcttactaaaatattggccctactaaattttgatagaaaagcgaacaaaattaactggctctaatataaatattaggggatcccaaatattggagtgcttctaatatcctagcaatttccttaagctagggctggtataagcagtaaatggcttatgagcgacttaaaagtaatttgtgggtaatttttttattgatatgttcttaatgatttagaagctaataccaaaaaataaattacaacaaaagaccctaaaatcagcttcaaattaaatttcaaaatttaaatttcgacgatggctaataagctgatacgcatattctcatgctggcttcctttctggcttttgcggtttggcctgacttcaccatggaccatcctgggagctgcttctggaagttcaatcactcatcgtcagagatcgatcagagatttgatgatctgtctcatctccctccctgtttgcatactgttgctcacgcctgacgccacacaccaccgaccatgcactgaacagttaacgcgggagctttatgtcacagcgacagtgtcactgaataatttgcagctaattttacatttactattttagagattatcgatgccaagaaacaactcaacagaatctctgctcaaattaactgattattttactactagggctgtgtttagttggatccaaagtttaaattttggttgaaattggagatgatgtgactgaaaagttgtatgtatatgacaggtggatgtgatggaaaagaactgaagtttggatccaaactttggatataaagacagcctagcatagttagcatggagtgccagcagatggatgattcttgtatagtttcctggttcactctaatttcagtctgtcagaatttgatttctacgatttacatgagagagagatcacattgtttcctctgaaaattttgcttctatcagctgctcactagaccaagatacaaaaaaacaagatgcagctagtagtattattgagtagcaattcatttttttttttggaatgagtagcaggtcgcaattaaggaataactaaatagataatccaccaattggtgtctgctgttcagctgcacgatgctaggtacatgcccccacatggcagggaataattcgagatttatatctgctactgcaacttagagacaaataatatgagccatacaaaaatgcagtagagttgtaccaattaatggagcaatatattcaagcctgcctaaatagataggggcttttaactatttgccacttttagatttagcaaataactatttgccacccctatctttataacatgtgagtccatatgtgtctataatatgtgggtccagtggcaaaaagttaattgacacatctaaatgtgccaaatggttaaatatctcaaatagatatgttcgaatattagttagttggacctaggagtagtagatcactagttctcctacaccacatccatttaatctggcactttaatcttgtcttttattagttttttaaaggaaaagagaaaaaaaaatcttgtcgtttggaataattatgatatgccatcaaaatacaataatgtatactactactacatacattaagactgatgttcatgcatgtgacacgtttccctccctttgcattgtgtacacaaattaattaaactcctttttctgttgcataattctttacacgtatttatgtgatgacgtccaagctgatttgtcgctaattacatctttaattgctaactagttttactagtagtacaatgagattaattgttgtctccttctcttgatgacgatgtccatttcaaaatgcaagctgtaagaaggcgattttatggttgtaaatttatgtcagtttgtgaggtttcagctgataaagaagtgattagtctgatatgaatgttgaggtacgtaagcatctgcatggttgcttcttgcttgctgtggatggatgcttcttgcttatcctttcaattttttgcaattctgcctgcagagaattttattcttgttgctttcatgcactcccgccacacctttttatatcttccaaattcagattatgtgaatgtaagaaaaatcttcagtcacccttgatgcttcaaagttactagtgattagttactgcaattttctgttctgaatgatgaggctccattccatgaggttacttcattttggctttgtttaatttaaggcccggttttgatttagattattaaacatattattgccattgatttaaaataagtggtctaagcaatataataagaaaatataaggaaaatggtttttcgaagcgtggagcaaatatctagccatttttgtgaaattgttaggctggagctctatagtgaattgaacgagaaaattgacattgtgccatcgtcaaaagtggttttcgcccaaatgccactatcaacacatggttacacgctaaaatactatctaggaccaaattaccctcctctcctcttcttcctccctccaacatcattagctctcgccggcggcaacaatgccaccatcggcagcggcgtgggcaggatggcaacggccacatctgcctctgcctcctccgccgcggcgttcggcgccaaaaccccacgcctgggcccgagcccgagccccatatccacattcgcgaggcctcctctcgcgcctcggccgccggcaggctccacgccagcctccacctcgacggcgcgagcgggagtgcgagcgccacgggcagtagcagccggagacgatgtcgtagccgcgccgcggccgctccgcctcgcgctcctcctcgggatcctcctctcgctcgcagtcccgcttcgtctcctcgggctccggctcgtcccgattgcgctcccactcctactccttctcgtcgtcgtcgtccccttcacggagccgctccccacccgctgccaaggccaggtgacatcccccgcctctcccccacccccacgataccatctgcttgtcctgcgcaatcgattgtgccgtcaacggtgcaatgtggccgccggcgagagctgatagtgatggagggaggaagaagaggagaagagggcgatttggtccgaggtaatattttagcgtgtaaccgtgtattgacagtggtattttatcgaatccattttgtagggtggtatttgggcaaaacccacttttaatgatggcataatgttaattttctcgaattgaacggacagtgcaatggtccactcaatttgttccacatttggcttaattttgttttatcgtttaacgaaaatgaaatatggccataacttggtgacattgggacaatttcttctactttggtcggcttctttacattttctccctgctcataatgtaacacctactactcataatgcccatatatacaactgaagcaagcaaacctgaaatcatgcctgtctctgcatcaccaaatcttctgaaatctaagctgcaaattaacttgccgtggcaagaagttctgatagttacatcactcaatataactttgctttgcctttttgtagctgtgttaccagcagatcagaaaacccaaaattaaccacaaattaattcatcatggttttcatttagccacaacacagcattgcttagtcggtagcagaaagcgaccagtgacaaaactggagaccatgaaactgtgcctgtatttggagctaagctgctaataattattggcaccatcactcgctgattaaaaagtcctaagtgccggtgtgatgtgaggctgccattggcttgaaacacaagcaaaaatggactctgaccaaacctgtctgcttgcttggccgcctagcttgtcgtcagggcataaaccaccaccgaccgctaggtaatcaagcataaaatatattaaattttatacttcatcagttagggaatacgcaaaagatttatacatatttcattataaaatatattatggatgtatctctagtaccttccaatcgccgaaaaaaatgtctcttctgtagcaatcattggagatggattaatcagtaaccaaacttgtcgagtgaaataatgtagtcggccgtatagttaatttaaccccgccaaacgggaaaaaaatactttatttagtcgctacatagaaatagcgatgatgtatctctagtacctccaaattgccgaaaaatgtctcttttgtaccagtgaatgggagatggattgatttgtaacagattgtgcaacttcgaattttttttgtaaaatagatatatggtggttttttgggtttaaagaaacaatttggagagagttgcacatgcatatatggttaaggatatgccacttagtttggagtatatgcacctggcacaaattctttttctgattgagaggatcacgaggaaataattcaacaagacgagaattatatattggagtgttggatctaactatgcaaacacaataagataaacaaataattgcactagaaatagtagtgcagtgcacatgactagtagtagtactacttgctgtgaaacgagtgctaaagagtactcctactgtctgaaaaaacattccatgcctattgactgtttgacagatgtacttacaccacaatttggtcagatcgatttatctaaggaccattgatccacaagccatcaaccatagtaccatacataaattaagttgcaaaagatattaactaatattttggaaaatgtttctaatcatgcttcttaacactgaaattcacaagagttggtgtcagtatatgaaaaaggagttgcactttttatgtgacatatttttcagtcgatcaataattggagcttagaaaactacgtactgcgtctgtatctgtccttgctgaaactgaatgccactggcattttcggagaaagctcaacatggagccaaatgttcagcccagcatgtacacgtttgcaaacagtcactgccaagctggaccttgctgaattatcataagcagacatggaagaaaatgtgagtgatccgaaatgaaatgttcagatgtgcagccagtaggatacttcgttgaaacacccaaggttactacttaggaaaatacatgacgcatgttttgttaggataagactttaaataaataattactatattatgatataatgttgttagattcgtatttaaaagtacttattcatgattatacttttgtgtcatataatatattacgtaggataattatttgtcaaaatcttatcctaaaaaaataaaatacatctcataataaaaaaaaacaggggtggcactgtcaattcagagacatacaacttcctcactcgaattctaattaagtttccctatcttgatagccaaccgagctaataatactactagccagtagcaccccaatagtgttagtattcatattcaattagaataaattcgcaatttggtggctataacacacaatcgtttaccgaatctaaactaattaaacagggtccatgtcgtcaggctcgaccggatcgataaacacgcgctagtttaccaattttttttttaaaaccaaatacatacatatatacgatccattccttgcagctgatgcatcatccattcttataatcttaattagttaaaaagatttatccaaatgcttaaccaagaaattaattaagcagtgccatgtcatcatcttatcacatggtaaatcacaatcatcatcttgtaaatcagtacatcttgtggaaggagagaagtaaaacgattgcttcctgctactacatcttacgtatgtgataaaatccttaattatccgtgcatttacttgcacgagaggaacagaaagctattactaatcatggtgattactgcgtgtcgcgatcagtaatgagctggagaacggaaacgtaccgggacttgctgctgtcactgtcgctaataccgaagagaatacgtattttgtctcgtggttttagctaactacagtgcaagaacattcttaggcagagatcgtgtggctctcagacttggtgatgagattagcaggtaatctagaccgttgatttgatcctaattaagctactagttctggggaaatttaagcatatgccaaggtgctagtcaatggatgcttagcttgttgggtatatggtggtatacaatatacatcatgaatttaataaacatgagaagttatcctggttattgttgaaccatttgccaaaaaaaaactttaaaaatatgagctattttgttatggacttatgatgccattagaagcaagctgaaattaactctacagattgctgtagcatgcaagaaatcttcagttcgttttcgacgtcaactgcagagacagtaatgtataaactaccagagccaatgctgctaagtaacttgctactgtacgtgctagagaaattgtcagaagaattatgacgccatgtcgccacatatatatttgttcttataacttaattaatttcctttggaaattgagcacactattccttctgaaagcatctcagaatcagatggaaatatttaagctcatttgttaacattaaactgtattgcattgatcgcacatcacatatactgagagactttgtggtgttcttataattatatgttaggaagaaaatttctaactaatttgtggacaccatttaatatttccaagaaatgaatttaaagtggatatgattaaataagaacaaccagtcaagcaaaagtaaatgatgtttattactagggttctatttcacataaattgtctcatatatgctccattaaacacctagcagaatgatcaaaaaaatgcgcatgtttcccaaacttctaaatagtgtgatttttatttgtacataacttttttatattttttggataataatttaaattcatttttaattttataatattttattcgtctataccctcaaataattatcataaattattcaacaatcaaccaataaaaaaacaaccccttaattaatcaatcggaaaatagtgatctttgccactggtgttttatttcacatgcattatatatgtgaaaaaatgtacaatatgcgacataatggtattcctactatgaagaacttaatgtttttgacatgtaaaactttcatagttcgtttttgtccatatatttttaccacagaccatgaaatatcacacatatatatacacgtctatacccacacgttgattaatgcgaggaatttcttttgtttacaactagtcgaatacaagtcttaaaaattcatagaccaaagggtatggactcaacattcaatgcttcatctccacaaaaatagtccacaaagcaacaacatcaccaccacatcatccctctaccctacctccccacatctcatccatgcattatgttcccttcacaacctaacacaaaacaaaaccattcaatttctatagaaaccacacaaacatgtttacaataataatcaaacaatactaataaacaaataaataagatttacataggaacaaaaaatgaagccaataagctagcccaccaagccaatcactcactcaccaaggtctcccactcctagtcatcatcatcatcatctccctaactaaaaccacacctcccctcaccactatagaacaaaatccccagcctctctctctagattctctctcctaataaaagagagaaaaaaaacccaagaaaaataagagagagaaactctctctctctcatcacccacccaaccaagccaccccctctctctcttccttgcaagcatccatctcatcaaaggccaaaccctcctcctctccccaacaagaacaacaaggaggcgcgattcacgcgaacaatcacaggagggggagagaaggggagaaatcatccgctcatctcccaaaatcctccaaaaaaatccatctttatcccgaaaagatcctccttttcttggggtttctgacaggcgtgcacggctatctttaggcgttctcggcctcatctctcgtggaaaggttcttcttcttcggggttgtttgctgctgcttaatttgaggaggaaaagcccaattcttgtggggagtgaagggagggaggaggggggcatggcggaggagggggaggagaggcggcggttctcgaatcttcgcggcgtccggtggcgggtcgatctcggcatcctgccggcttcgccgggggcgtcggtggacgagcaccgccgcgccgccgccgattcgcggaggaggtgaggctcatgctgcttgtgatgccccgtgttttgcgattctgtgccatgtgcggtttgttcttgggttcgttgatctctgcttagtcgatgttgttatcgattcccctatttttggtttggttcttgtgtttgtgtggtataaaaggtttttgttttcacttcccagatggttttgattggcatgaatttctggcttggtttgaggagaaaccatgcaatcgtgatttgtttagtgtcataacttagcatgaaataatttgtatgttggtaatcttttgtttgtgatggtgttgtgtgcacatggtgatatctccatacttgattcatgagatggaattggtggagaaatttctgctgaccttgtcaattagacaaatttgtcatttttatatgattggagcattggtccttcttattcctttcatctatatatatttatttaacatctgatttgtttgcagatatgttagtttgagacgacgtcttctggtagaccctcatgttccgaaggaggagggcagatcatcaaacctcattgtcgacaacccgctatctcagaaccctggtattgatacaagcatgaatttatgatgatgagatgctaagcttaagatttggtcgatgatatgttagaatttagaacatttatgcacttgtttcctaccttcttatttggtggtgaaagtcttcaaatccttgcatgatctataaagagtaaattcccatagatagtgtggagttatcgtcatagatcgggataatgatgtattagaacatggatgcacttgtttcacacctgcttatttagctgcgtgagaatctttaaacatctgcatgatcattattcattaatgctgatgaacaaccataagttgatgcccgcttatcagcatagatgtttattgcttaagttaatgctctatatgtgttagtaattattcaacatccctctgtagatagtagctggggtcggtttttcagaggcgcggagttggaaaaaaccgtagatcaagatttgtctcgtttatatcctgaagatggaagttactttcaaacgcctacttgtcaggccatgctgcgtcgaatactattgatgtggtgccttcagcacccagaacatggataccgccaaggtaaggaactccttttgcatataaaatttacaatagttactaatttctcaattagagttgatcgaagtaatctgattggctctgccctccctgtcgcaaatttgaatggagctgacatcctttaatgtcatttagcttagcttgttgttagaagttcccacttatgggcatgaaaattgtaattctagaatacattgttagggcatattgataagctctgagatccttttacaagttaataggtcctgagatcctttcacaaggaaatacataaaaaaaacgttcattttgttataaggtttaaactcttgaagtgctatccacctataccatgtagtgttttcggtattgatttttttcttttaaagatgtggcattgaaattctgattacttagcatgacccaattgattatcatcatctctccaaatttgttatgattttatttgattggcatatgtggaaagacttatcgactatttttgtcacaggaatgcatgagctattggcccctctagtgtatgttcttcaagttgacattgacaaactatctcaagtacgaaaattgcatgaagattgcttcaatgatgattttgatggagttcctttcccagataccgatatggttttcagctataaacctagaaaggacccaaaatggagttttggagctgacaatcagaatgattctgaacgatcttccaaaagtaacactcttgatgagcttgatccggacacaaaagaaataattttacttagtgatgcatatggcgcggaaggcgaactaggcattgttttgtcagaaaggtttatggaacatgatgcctattctatgtttgatggtttgatggatggaggtagcggagtggtacgcatggcagagtttttctccccatcctctgttggatctagctcaaatctaccacctgttattgaagcctcatcagcattatttcatttgctctcaattgttgagccaaccctccataatcatttcattgagttgaaagtggaaccacagtggttcgcacttcgttggttgcgagtcttgtttggacgagaattctgcctcaatgatcttttggtagtatgggacaaagtttttgcttgttcaaacaatatgctgctaagtagtgatgaggaatataactttcgtatcttgtgttcagatagaggagcatttattgcagccatggcagtttctatgcttcttc

SEQ ID NO: 12807 - DNA, 9507 bp, Oryza sativa
  unsure (1)..(9507): unsure at all n locations
agttcacagcaatctctcttcttcaactcctccgagaactccattgcatcctgtttctgacagtaactgggaagagaagtggaggaatgtgcacaaggacggaacaacccccaaggaggttgagaggggcaattcttttagtaaacaattaaagaaatctttgacccagaagcttggtttatctaggacagagtcagatccttctccagtgaaggtcctcagtgtgagtagtaatgatactcggaattcagtaagacgttgccttctgaatactttatcagatgatttggattgttctaatgaacttgccgggaaaactcaggaagacgaattccctatcatctcagttcacagggagcatcctctgagctctgcagagccttccaagttaaaggcagctggtgaaaatgtaactgtgagcgcatcatgtgtggcaaaactcagccctctaaaaaaatctgtggttgagccagctaatgagaacgcaacacaggggacaaagtgtgtaccagaagcttgttccagcggtgagaactctccagtgttctatgcagccagagccagtgctggtaatgaacctttgaatggccaggacacggattctgagagtagcagtgttacctcaaattcctttgctggtgaccatgatagggatgaaattctgaaagatgagccatccagctctaatgatgataacaaaaccatccaagattcagaagcagcatcttctgataaaagtccagaccgaaatggaacctctgagagggctgtcgtttctaatgaaagaaagccattcattagtaaattccagtggctcttgaagttgggaagaccttcggttgaaggcaacatggagaagagtagtggagagacatcagctgataaacaagacggggacacatcctgttctccttctgatgggaattcaaataactcccgtggtagcgtaaagttggcttctggtgataaaaaggtcatgggcagcctaaagaatcttggacaaaacatgcttgaaaatatccaggtactgtattcaatattatttttcatgtacttaaagtaagcctgaataaccttgtctttacaaaatgattaggtgattgagtcggcatttcagcaagaccgtggtcagcctggccctgtggagaacttctcaaacaacattcttggaggcaaaggacaggtcactgcaatggctgctctgacggagcttcgcaagatcagcaatctgctgagcgagatgtaacagtgtaagatgtatcgcccattctttcccagctttctagctcagctaaggcctggtagtaataagtcaggtacctaggtctttttcattcagcagtgcttggcactgcttgaatatgtatatatagattcgattcgattccattccattgagtaaatcatgtaagcattgtacaaggatcacccgtggatttacctggcgcgtgatgagggagtagttctctccggcattaggaagctatctaatgatggatgaaattttgtaagataaactttttaaggaagaataagcagaatatgttgcaatatgtgcgagctacaatgcagctggatgatttgttcgtcaggctgttctatgttcagttcatgtgcagtaccattcagaagcattgtatttggcaacaataagaaaaatcactgctgctctttctggcttccagtgcgatatccaggtttgcaatgttttagccattgtattattatgcagctggcatatctctgaaccagaaatgttcagcccaatgtatctgatgatgaatgaacattgatagtactatctagcaactactttctcggttcataatcttttcagggcattgcaccaaattgttcagagattttgttggcagctgtattatttattagctgggctcatgctgtccatgcatcctggcacaacccagagacagaaatgcagcaaatgctgatgtttctttcacgcatactttccatatggctatggtaggaagccaagaaagcgacgtacactgcttctgtagctgtagtgcacgactcaagcaaaatcttgcatgtttaatggcatataatggtgtctgctttctgcacgcattttccatccactttcttgatcatttctgtgtctcttcctgaacgatgttgtgaccgggacaggcagtttcgagtctcatttgtatacgcaatcatttagcactaccacttgacacagattaattagagaataactacatagcagcaattggttgtaatgtcaaagacgacaacaattctctgctgctcttattataaccgaggccctgttctttctcttcaagattacaaagattatatattatcacgaatacattttttaagttcctaaacgatacatctttttttaaaaaaaacactttcaatatataaattgttcaaaatattttttaaaaaaacttttcacctttttaatagttattaattcattcatctgtaccctacaacatcaccataaaattagataatctatcatctatttagaacagttaaacatgacgtgaaaggggtaaattcagaagaagcaggaaaacttgttaacaaacaaaacacacggtgtttcggtccacgggggatgcgatgagcgggtacggatggtgtgcggactggactgcaaaaacggctggatgctggcgaattccaccgtgtcggtgtcatcccacaacagcagcaggagcagcgtcagctggtccaactgtccaagaggaaactacccacagggtccaactgcccattccatgtggcagtgagcagagctgacccagccatcctgctcaccattcttatccactcaaacagctcctggccatgagttttttttttaagaagggtgcaacttagcacgcacactcacacaccataacacacgcacacacacgctaaaaataagattgaagaccactaggtgtctcagtgcacgcgcatacgtgtgtaccctatttctagtcgaaaataccccgaaggacagtccttaggaaagacggaaaaaaaacccgtcgaggtgaggtcccacgagtcgaactcgcgaccgccgttcgctccactgcgaatgtgccaaccgagccatgagtttgtgtctgatgaatgatgatgattcagtgctctgacagcgagcaaatcttgtctgaagaagagagagaaatgatgggcctttgcttcggtttgatggcctgaaaattcaagctaaaattttggcccatcatgaattcataatcctcatccatccctctgtatgggctggggagtttgaactaattctggcccatttatgagataggatgggaagttgggtcacttaacaaatcatacataagttgttctttttttccttccataaaggaaaatttgatgatgtggttatattgtggttgcacaaatgatcacattattactgctactgccaaggatctcttgaccatttaccacatgaagcatgatggggctagaaaaggttacaggacttccaggtttatcaacctctgaacatgtagaacttatggatgaaaattgggccaaaaatgatcaatggcaagatcaacaatcttctctgtggacaaaatcattaacagagatatacacacctaaagttaagagagggagaaaaactccagacaaagttggggcaacctattggtgtgcagcaaaacgagttgcttagccagcaaaaaagtaagttgatgagaaagaaaaatataacatatcaggctaatcatctggagtacagggtgtgttgttttttgttgaagctacctctgtcttgaatttctcccagacttctaaacccatggggtgccttactacataacgttttacgaaatgtttgtctgcagtggctaggagagtgctaagagctagtccagtagcaatcactcctttctccaacaaccaattgtacatcaaaaacctaagcttggttctctccacggtaaacgagaggaatgaagggaaaattaccagggtactcagaggatatcccatatcatttacaaggaaggatatcttggattcaaggacatggatcttctgattcagaacatgtggagccatagtgatcatctgcaccacatgttccgggtccaaaccggtcttgaccaagaagtcgtagcgatcttttagctcgtcacctttaccacgaaatgctttgagtcccctcgtcattcgttcggatccttccataaatcctaagttctgtaaaaatttcaccttctccttgaaggatgcttcatggagatcaactttcggtatgcggctgacctttgcccctaatgagaatttcatcaacagttgtggatcctccattaccatcctgcaaaggcgcttcttccctacactgagatgtgtcataatgctgtttggtttcttcaattggacggaaccaagtattgaaccgttagacaccacaaatttcttaatgtcctcttcactaacaccaatctcagctaagaagaatatgccccttcgcaggttcctcgtgaaattgtcgactgacaaatttgggaaattcagaaaaagatcaaccaattccttttttccaaacccagcttttagcatgacgaggactgccgagaacagcatctttcctgaaccactaaacaagaaatcgggattctgtctgaccaatttgccaataccttcattagtgaatcctaaatcactgaagaactgagggacttggaccatctttccccagttataagacttctttacagataagaatcggccaagccagtctctctgaattccaacatcatctagccagcgcagaatcttcaattccacatttggatcacggaccagtatgacagggctcgacatcactagcttgatcacactggtcttactcaacccttgatcctcaagggccttcagcttcgacgcaagaactccatggccaaaactaaacacttcggtagcatccctgtatatcctccctatcttggtgcgcgcgatgccatagttgcaaagcacccggaaattgtcgagcatcgtctcatcatcattgagaaacatgagatcacgaggcaacaatggctcatactcgcccggcgcgatgccgatactctcgaagaacggctcgaactcgttgatagggtggaagttgaacagccgcaccaacgccttgctgaccctctcatccctcatctccctcttcttcaccttcgacctgaagggcacctcctccccctcctccgtgggctccttcgccgcatccttcaccttctccagcagcttgctgatgaagatcggcgagcgcttgctcatgtgctcggcatcactgaagcaaatcccacgcgtgacatggaggtactccatgaatgccttctgcgcgatgcgggcgtcgcgcctcctccgcatctgcttgaccctccgatcatccacatcctcaatcccatccccgacgatcgccggagcggccgagaatggccgcagctgaatcctgtcaccaacctgactggcccagctccagctcgacgcacatggtgatgatgaatcatggacatgccaagaactgacagcagcagcagcagcatgacaatgtggggttctggatgagcccctggcaaggccattccatggaagccacctgtggcgagcggctggcactgaccggagcatggagattcagctgaatcccccaaaactttttggagaacaaactgtatgtatcactgtatcagtatcactgacgcaagaaaagaaatccacggcgaactgggcactccctccctcctagaaagaaagatttggattggatgaagagaactggatgaacaaacacactcactctcagaataatccgagcatggttgggcttgccgccaatctccactcggctacagtccagtagagcggagagcgaggtggaggtcgtgcttcggtggtggaaggagggctcgcggaagggaggcgcgctcgggggagccactcgccggcgccgccgccgcgagggggggaggaggaggaggagcagggaggggatgcgcgggtggacggcggcggcggctgtgttttgggggcgcggcgatgagagagccgtggccgttggatccaagcccagacggaggcgacggctctgagcggccgcgggaatttgggccgaaatttacttgggccccacgtgggcctttgaggccgaaagcacgtgtgctcaagtggttaggttaatctcgtaggtcttgttcggttaattcatgagagagcgattgaaggtgtggaattatttttcatcaatcccctccaattcttttcaatcctctctaaactaaggatgcgttcgttcattggagataggggagattgtcattcatttttcgtgcgcacgcttttcaaactactaaacggtgtgttttttgcaaaaaaaaattctatagaaaagttgcttaaaaaatcatattaatccatttttgaagtttaaaatagttaatactcaattaatcatatgctaatgacttacctcgttttacgtatctttctaatcttcccaattatctcttcctcaaacacagcctaaataaggcttactgcggcagatgcaccgcccagcttgggcgagcaattgcttgggctgcgcacgactgcaaacgagactgaatccatagacttcccagcggtcttatatgaggggaataagctcatctgagacgctcatctgagatcccctctccggtggggatcgaccagatgttggcgcgtcggcgcctgctctccaccgcgcgtcggctcaaaggtctggagcttcgggagttcgtgtggagcttgtcgatccggagggagctcttgttggggtgtgggttttggttggagtcaactgaattacgcgccaaatatgccctaaaatctactactcccaaatatgcagcaaatgtacttgtgccttgtttggctcaataatgtaatgtgatgagaaagaacaaaaacaatacggggacttggcgcaagataatcatgaattaacagtagtgtttcatatggctgtatacacccccgttggtgtatagaacccgggttttataaatttctattatctaaaaaacagtagtgtttccaccaactcagattacaagacttccacgcgagaaattggaaaacaaccttaaggtgcacccatgcacatactaattcttaatcgatcgcacacaatgcgatcgctcattattatcatggcctaatacggacgatcgattccacacagggcagcatgtagtgggcaacagggagctcaccaatgcggaattttatcccattccggtgatcatacgtcaagtcacgcgccatgtcgatcacttcttcgagcgacccatcacgcaggtcgcacttgtaaacgtaccagccatcaatggataggaaaacctgttctcgatcggccagagaaacgcagacggatacattgagctgtgttatgaaaatagatgcacaacggagacacgaattttacatggaaaacccttgcgggaaaaaaccacgggcgccgaccggcaatgatcactatagaggagatgattacaaacgtaggggaatcacaatgggaacgtcaccccttcccgtacggcttataagagtatatgtaggggaaatagaaagacacctaataggaattcctactaggaaactaatccgaatatattgtgggcccaaaattcggatcacatatttaacaatctccaccttgagacgaatttcctcttgtagcataaaaacatcaatcaccaaaaatacctcatgtaggtaaaatcaccgcgcgccaaatagtctctaggactatattgtaacaccaaccaagcttgagcaaagctcaaatttagtagcagaaactggctttgtcatcatatcagctgggttatcatgagtacttatcttgcataccttgacatcaccttcagcaatcacacatcgaataaagtgatatctcacatcaatgtgctttgttctctcatggaacatttgatcctttgtaagacatattgcactttgactatcacaaaatatattaatgcaagacgtaactccacaaagcttagtgtacaaacctctaagccaaatagcttctttacaagcttcagaaatagccatatactctgcttcagtagtaaataaggcaacagttgcttgcaaacttgccttccaactaacagcacatcctccaatagtgaaaacataacctgtgaacgatcttctcctatccaaatctccagcaaaatctgaatccacataaccaacaagtccatctatagatctcccaaacagcaaacaagcactagatgtaccacgtaggtatctgaaaatccattgaacagctttccaatgctctttgccaggattagccatgtatctactgacaacactcaatgcatgtgataagtcaggacgagaacataccatggcatacataagtgaaccaactgcctttgaataaggaactctagacatgtattcaacatcataatatgactgtggacataaatcaaagataatctgaaatgtgcagctaacggagtactcactggttttgcatcatgcatattgaaacgacgaagaactttttcactataacatttctgactaagatataacttgccagaatgtctttctctagtaatttccataccgagaattttcttcgctgcacccaaatccttcatctcaaattcactactcaattgtgccttcaactnttctatctctgatttatcttttgcagcaatcaacatatcatcgacataaagaagcaaatatatagctgaaccatcaacaactntaagataaacacagctatcataattggatcttctaaacttctgagaaagcatganagagtcaaatctcttataccactgtctaggtgactgcttcaacccttaaagagatttcttcaatctacagactaggttctcttttccaggaccaacaaaacctccgggtgctccatataaatgtcctcttctaactccccatgtgaaaatgcagtcttaccatccatttgctctagttcataatcatgcattgcaacaatactgagtaaagtacgaattgaactatgcttcacaacaggggaaaagatatcattgaaatcaatacctggaatctggctataacctttagcaactaaccttgctttgtaccttgcctcatcacttggagacataccttcctttcttttgaagatccacttgcaacggataggtttcttctcctttggcaacttcaccaattcccaagtatgattcttttcaagtgactccatctcatcatgcatagcagttatccatctattgcaaacatcagaaacaatagcctcagaatatgtagaaggttcggcattaccttcaatttcttctgctacactcaaagcataagcaactatgttcgcttcttcaatatatcttcgagaaggtttaatatttcttttgggcttatcttttgccataagacggtttggaggactgctgaacaatagaagaatctgaatcttcaata

SEQ ID NO: 12808 - DNA, 14001 bp, Oryza sativa
cactctttaaacacatcaaaagctcgatatttgtgcttaacaaaataatgccaaactttctgcgaataatcatcaacgatagtcatcatgttacgagcaccttcaaaagatgtcttacaagcaggcccccataaatcagaatgcacataatcaagaataccttcagtagtatgtgtagatgtgttgaacttcaccctcttatgcttgccaaagatgcaatgctcacaaaatttgagcttcccgatgctttgtccatctagcaatcctcgcttgctcaattctgccaaaccaatttcactcatatgcccaagacgcatatgccaaagattagtagcatcggaattagataatgaatcagaaactactgcaacattacctaatatagttgtacctcgcagatggtatagattggcagatttaatatcagctttcatcacaacaagagagcctttagttaccttcaaaattccgtctccatcggaatatttgtaccctttgcgatcaagagtacataaagagatgagacttctcttcaaatttggaatatgccgcacatctgacaatgttctaatacagccatcaaacatctcgttctgaactgttccaatacctgcaacctcgcatggtgtatcatcacccatcaaaacagtaccaccttgaacaacttcataagtggcaaaccaatccctattcgggcacatgtgataggtgtatgcagtatcaagtatccactggtcactagtttgtgcacaaccaacataagcaacaagcaattctgcatcagacttctcatcagtaacaactgcggctttaccttcctcttctttcttaccttttggtatgtattttccggttctcttgtctttatcctgtagcttccaacactcagagatatcatgtccatctctcttacagtatttgcatgacttatacctgcctctggactttgatctcccacggtagctacttgagcttttatctcttgatttgttgtttgtgttcttctcctgttgcctgcctcgaacaaccaagccttctgcttgtgaatttgaaccttcagagggtaccatcttcttcatcttttctttggcatgcaaagcatcataaacttctttcaaagttagagtatcacggctataaagtatagtatccctgaagtttgcatatgagctaggcaatgaacacaatagaataaggcctaaatcctcttcatcatactttacctccatagactcaaggtcagcaacaatttccttgaaagcggagagatggtccatcacggactcatcatcttacaacttgtgcaaaaataacttttggcttcaggtgcatcttactggtaagatccttagtcatgcatatctgttccagcttcaaccacagcccagcggctgtctcctccttaagcacctcatgcaaaatattgttagatagatgaagatgaatatatgacatagccttacgatcccttttcttctcatcaacagaccaatcctgtgtcctcttatcaaatctagaaagcgcatcattgaggtcttgttgtgcaagaacggctcgcatcttcacttgctaaagtaagaatcttgtgtcttggtccaggagaggtagattatacttcaaactcgccatgggaattaatcctgaatttgctagtaagaaattagggtaatcctagcaaaaacgcgaaacctggtacacttctcgtgtgtctgtagcgtagatcagtaaacttcctggtacaagctttggtgcgcgtagcaattttgcctctgaaaaaacaacctaacagaagctctcggtggattggtttttcgcctcgggaaccgtgcgctgcagatggattggcttcggctgattttcttctcccgcactgctgtactgctgcttttctgacacgcgcggcaggaaggacggcgtcgactcggagttgacggcgactatgctttggattggatttcgccgaacagaatttggacggaatgacgaacacgacgacgcgtactgccgattagatcgatttcttcgatccgaaaaatcacgccggtggtcgggactgcagtagatcttcaatgttctgatactacttgttatgaaaatagatgcacaacggagacacgaattttacgtggaaaacccttgcgggaaaaaaccacgggcgccgaccggcaatgatccctatggaggagatgattacaaacgtaggggaatcataatgggaacgtcacacctttccgtatggcttacaagagtatatataggggaaatagaaagacacttaataggaatttctactaggaaactaatccgaatatattgtggacccaaaattcggatcacatatttaacaagctgtttaggaatcggcaagcggatgcggcagcgcagcgaccaagcaaggcttggtccatctgctgccaaccaaatggctaactcacatggcgaggcggagtggacatagcacaacttgccaccaagctggcatagcatgtcgttgttgctcagaaagcccctgcatggagggttgggatggacagtgaatgtttcatcgcgcaagctaaatcgaaggataacatgtgagctcaccttgctaaggccatggccggtcgtggagtggagagcgctccagtagaagaaccctgggagacagatcggagtcctagcattgataggatatggcggatctatggtcgccttccatttccaacaatcttctccatcaccaagagtcaagatctcatgtccagcccgggattctcctccgctgtgtgatgagcggaggaagtgcctagccaccttgtacttgccactccaagggtcgaacccgaaggcgaccctgtgctccagtgcaacactgtggcttcctctcggcagctcaacgaactcgctggtcgtcaggttgcacacgaagatctctcccgagacgcaagggatcaggatgaggccgtcgcagtgcagaggcatgctgaacattgggatcccacggggaaatctcttctctaggatgagctcggcaaccttgctctgccctggctggaacctgtagaaagtgacaccctgaagtttaaacttcttggggttactcagaaacatccgtggcatgacgaccatggatggcctgggcctggaatgctccaggtggcggcgcgcgaagctggtgctgattatggtggcgcgccacagcttgcacacggattggaatcgcacaaggcacttcgcgggaagtcggacgaggatttcggagaaaagtatatcatcagggataaagccaccgccggcggcggcggcggcggaagctgaccgcggcggcggcgccatcagacggcgtcgttttgggaatgggtggttctccatatggatctctcgtttgtttgtgccgattgccggcttcaatctgtgtgatcagatgattacataatcagaaaatagcacccaataattcgactcggattcagggatccactttatctaatttgactcggattcagttgatgaaccacattttcttttcgggggaaagaactaagtgttattatttacttatagtaatattaatcttatcttaatcttaactacttcgcgattttgggccgtcgtccaagttcgcacgcgacgtccacacgccccgactgcgttcgttcatgttcttcttcggttcacgcctaggcgcctagcaggcaggcaggggaagagcgggcgcacgacgtcggtgtccggtggcacaacggcggcggcagcggtgcctcgacgcgttcttggacacagcacaatggaggaaggcggcagccggcgtggggagcgagggaagagttgggaacgccggcggcgagaactcagtccagtcggaaaaaccaaactgatgtgaggtgtgagagaaggggggaaatagggaaaatggactcgccggagtgaggagatgctggtggcgagatgagacggcgagataagctctaggggaggagatcgctccgtcggggcagcggcggcggcggcggcggcgcgcacgcgtgccatgcgcgccctccggaaggaaggaggcggctggctcggctgggttgggccatgtgcgggagagaaggtcggaagggcccagaaagcaaggtgatgtcagcccaggagtgacatgactggttggaggatttcggcccaaaagaaatagaagagttttctgaatttttggagggatgattttaatggaatctaaaagaaattcaaaagaatttgtttggagataaattttaacaggtagttcatggactctatacatgtggggggaggggttggtttatttttggcaatggaagtttagaggggcttttattttgggggtattggtttaaaggaggagtatttgaataaaggaatagatatttgaatttggaggagagtctttggcaggaaaactttagaatatcattggaggcaaaaattatggaatttagataaaatgaaaaagacaaatggctaaaagagtaggttttagctaataaaaaataataaatcgggatgtttataaaattgaggaggaacttgaacaatagtatatagatgtttgtctttagaatatttttgagaatgggacttaaccaatggtgagtttggaagaaagaaacaagagcaaaggatggctaaaggaatgaatggtatatcgagaaattttttatatggggaatttggagcttattcaaaagtaaaacaaaagatttgaatagatggatttactaagagtcggccaaaaacttggttggctagtttcaaggatacaggaatttgaaatttatgcggaggtcgattggatctagatgaatttgggtaatgggaatttaataggaaataaatgtgctaataaaatagggtttcggtaaaaataaattgaaaggtttatgctactgttgcatgcctgatgacgcgaagacgacgacgaacaggccgtgccgcagcccggagattgactccttcggggaggcacgcggtgaagactcgacaagcgaaaaaaaaagcgaaacaggtgaccgtccccaggagcgagatcgctcctcccgggggcaacggaagcggaagcggtgagcggaggccttaggtcgtctgctctgataccatgttgaatagtacagggagagagaaatacagcgtaacgtggatacattgtattgagcttcaaggggccaatatacatggattacatggattcttaagtaaactcagaaatagagatggatactaatcctatcctaccataacaaatcggatacaatatgatcctatccatatactctaatagcctgcttgggaagtctctccagcagatggtccacacactcacaatggagaactacacaaacgggatcagtgaccaaaatgctgtaactgacaacttcgcaaagccaacatcaagtatagcacctgatgttctagcactctgagcggtgaactcggcatcatcttctccagcaacatcaaccccatctgagttgcctctccaagctcttgcattgagcttgagcactccatctttgtcgacgacaaccacccgccgtgagatctgaacgacgccgtcgccatcgacgggcaccggccggtcaccgtagtcgatcagcaccacttcatcagcgataccgcccatgcgtgcagcaaaccgtgcaccgaaatcgcttgagccttcggtgatcttgatttctatggttgcctccactgcttttatcgaatgtccatgtcttagagacatcctttgtatgcaagaaggcacgaataggatcgtatgcccaaaaatcgatgcttagaattctgtcctctgatggtgtttcgcctttgactttgagttgaaattcgacttcggctgtgtttagttcacaccaaaattaaaaatttggttaaaattaaaacgatgtgatggaaaagttagaagtttgtgtgtgtaagaaagttttgatgtgatggaaaagttgaaagtttgaagaattattttggaactaaacacggccttcagcacattgacgaagctgaactgcacgaacagggcctgtcagcaccaaacaagaatcctgcgtataagagcagaacagtaaataattatattgtccgttaaagaaaaaggaaattaggtatcttattatgaccatattcataaaatatttcatcaaccctgttgatttcaactagtttggtataatggcccataagagcacccataatattcagttaaggaacaagaaaagtgtagcatattgtatttctgctgttctttacatctttgggcataaggtaaatagttcctctttccctggttttcatgaacaaaaatataacacatacagcaatcactgtgaagaatatacaaaagatcgcgtaaaaaaagaatatacaaaagaaagctgtacttttcaaaaagggcatgaaatagctcaatataaataacaaatcaataaatcatatactgctgactgaatgctgtttccctcgttctaggaaatggcgctttactgtcctggttttagaactttgcagtcgattttcatcctctatcaagagagcaatgttagaaaacgataggcaaacaaacgataaaaaataatagatcaatcacaaaagacacgagatttaacgtggaaaaccctcccaaaacaggagagaaaaaaccacggacgccagccagcaaaatatcttcactatatctggcggcttacatcgccgcacgctccggcccaagcctcccagcgacgggcctccgctccactacggcagaagaaatgattttggatcacaattcaacaagcaaaatattggtcactctgtagtttgtacaacggccaataggtgaatgagataaacgctcggtggaagatagtgctttagactttgagtcctactccggtactttctacttgtagtagaaagtaatctgaaccactaatctcatttgatcaaagggtttagatcaatttctactaccacctcacttaatggtagtagaatcgtggatgggtattattgtccaagaacaaatattagtggaggggtataatcatcatctatatacaatcactggccctagccatactctctcaatctttcctcacgtcggccaaagagaatcgcgtgactcccccaaatcgcatccggagacgacgccgagtatctcctccctgccgccgcctccgccacccgatagaagtacaccaacgccgggcctcacgtgttcgtgacgatgctcctggccgtggtgctcacggcagctgtggcgctggcgctcgtcaacgccgtcaactcgcatgacttcgcagcgcacctcgccggcgtggactgccgcatggggctagctggtccagcacgatgcccagcctcgggcttcatggagctcctcatgccggcgctacatgtgattggatgcgtgctcgccgtcttagatcgcctgcatgcctgcctagtgtcgccctctcgctacacctttcgattgcatctccatgtacacgtgccagtggcagcacggcgaagtgaccaatatacatgaagtatatgtgctaagtaggattgaatttgttccgtatatggtgaacactaaaagaaaacctttctccttgttcgttcagcagataaaaatgtcaaacagaatcattttcttattgcttcaagtcacattaaggccgtgtttagttacaaaatttttcttcaaactttcaactttttcatcacatcaaaactttcctacacacacaaacttctaactttttcgtcacatcgttccaatttcaaccaaacttttaattttggtgtgaactaaacacagcctatgcatactattgctactgctactgctcgagttcatacttcagacttcaaaaaggccccaccaattcatgacctcataaaatctgatttggaccagcatattgatttaacaaccagaaaaaaaaattggacatgggcacacctgttgcctcgaacaatatttttgcagtattagaactagttcatataagttgtacagtctaggatgcactgaatgaatacagatagaaaaggattacaggcaaggctctgactagaagctgcaaaaacatctaaaacaggcaagcaccggcgaacaaagaagtactggcgagacggccgtcggcgccgccgccaccggaatgtatcggatggtgcccctacacgcggcaaaatggggcgacaaatggaggagaatgagtggggaaagaatggccgccggagtagactgccggcggtgcgaggatttgccgagcagtggagatggctgtcatcaagaggagatcgacggtggtgggaggatttgccgcagcgaatggatgcgtcgtccagtcgccgatcgagtgcctagcgagatgaatagataaaatcccaaataccaccattacccctaatcactaagtagtaatgtactaatatgcccttgtgaaccgacgattcagatcaattctacttgtagcataatactacaagtagaaagcaccggagcgtcgctattagactttaggtgtgtgtgccgcactgacaaacttctacagcacataaacatatcaccatttatcaaactagtactccctcctccgtttcaggttataagactttctaacattacccacgttcatatagatgttaatgaatctaggcacacatatatgtctagattcattaacatattgatggcttcatgcgggtggccttggacttccacagcttttcgttggcctttcttctattccggcatgcttgtggctgtgtgaggaaatggatgttgacaagctagggtgttagctttaggttttggtgtttggttgggtaattttgcaggtgttgctcgtcaattgttatcttctgtgaggtttttctctttatctgttttctcctctttgtattccccatatattctattctcctatcctccagggcccctgcgcttgcgtaggtgaagcctgccctgtgtaagatcatttggctcaatatattcaggtggggactctctcccccccggtgatttagtcaaaaaaaacatatatatgaatgtgggtaatgctagaaagtcttataatatgaaacggaggaagtacatgttatttgctaagttactgaagttttctttcagaaattagttatgaaacaatagaaatgcagctgctggaaatctgaaccgtattttggtatggcatgagattggtatggtccctcaataaaatggtgccatcaagcccttgaagtgaagaatttcgctcgttccgccattagaaggcaagaattctgcgtgtgaacctttttttttaaaggaaggcaaaagctttgtctcgtaaatattaatagagatggagaaaaaatagatcaaaaatatgtatagggtaagcctcgaaagctaaacccacaggaacccaccaaaagagattaagtgatatctcccaaaatatcgaactcttgaagcttcgaggctctagccttgacccaagctcgagcttcctccttgatcttggcaacgatggacaccggcgttgaggcggtgcttcggaagattcttgcgtttcattcgcaccaattttcccaggaaaccaagatcaccagggttcgtaaaggaatgcgggggttatcaggggagtctaccacaaggctccaccattgttccaccgagtcatagtcgctccatttgctcatttggaggtgagtttgggtccacctttgtatttctgtccagaccctctttgtaactctgcagtgtgccagaaggtggaccgctgattatacagcacagcgggtaggtcttctgattttgccaacctcttttcttgaacctgtcagctgtccagagtctattttgggtgactagctaggagaagaatttgcattttagtggggcccagcgtgtgcactttcaagtagtaactaaacagtattatctattcatcgacagcacaagagagttcagagcccattcgacttgaagtgaacatatataggttttccaagaacttgcctatgcagtgccggtgagtctctgcgcgtcgtccctgtcgcggttgaagatgaaattgctcttgtgatcaagcaaatcgcggacagcgatgaagccgaacacatggagcggccactccaatccccctctcaattcggttaccttccatgagtagatctccatgcatcgaaaggtttgtcgttgtaggtgtggctcattggccctctagtagctgcaaaattaaaaaatatatataaaaaatagataaatcgccatcagttaatcgttcctccaactccagtgcgtggaacaagaagggttgaattgaatcaatagatcaactacactggatcaaatcgcaagaagaagaaaatgtactgatatcctcgaaaccgcacacgtcggcccaaaaaagcgagaatatgaaacggtagtcgtcagggttgggctcctcgtaatctccggtccgcggcttcttcttcttcttcttctcctccgagtcgctgctgcggttgatggcggcatggttgctttccgagtctcactgttttgctgtgctgccgaccaactgcactgcaatatgccgtttgcagtcttcattttcaagagggttcttttagtttgtatgagcctttcaattacgtttctgtgcgattgtatgtgtaatgttctagcagcagtcatcgattataggttccattgtttaaatcctgctcacatagtcacatattttgatgcagaaattcagttaaaatgaatcaatgctgttatagctggctgtcttttttttatctataaagatatactaccaaattgttctttgttaattcttatttctttgccaggtttcataagcatcgactgtggatatactgcaaccccgagttacaccgatactgtggatatactgcaaccccgagttacaccgataccaacacaagtataacatatgtgggcgatgaaggttttatagaagcaggcataaaccacaatgtagaccttaacaacttgcagcagacagatcttgcacggcgatactcaaccatccgtttctttcccaatggaacgcgcaattgttacacgttcaagtccctaacaccaggtagcaagtgtaaaatcaaaggtgtttttgattattattttgtgatgaacaattggcatcggagattattggttttgttatttggaatttattcacgaagtggttttggagatgattggatttataggtgaattacaggtgctgtcattttatgtgaccggtcagacagggctctggtagctggtcagaccggcgtgtattgcgcggttagactggcgcagcccgcggtctgaccggtcgacgctgtgtcggtttcggtttcgggttgtttatttggatatccgtgattatttcatgattatgacttctagatggatactatacgtatgtaatactgttgtttgctactaatgagttaagttggagatagcttggtctcggaatatggtttctttgtttatttcatgtgtaggtgactcgatgtctcgggagagtatttgcggtgatggactgggagtcggcttggggataagacgacgtccgtggtggtcagagatcatgcgggatacttaggctagagttgatgcacgtggttgatggagattccatatggcatacgatggagttattgtgtgcgtatgggatgcggagtcgaatttggaaggagtccaaatttggtacgattggttatgtaaagtttctttcttgtactagagggtttcctaaggtgtttaggactcctagtatgagtttggtttgtggctttaggctgcctacctcgggtataaatagagggggagcttgaggcttcccggtatcgtttttgagagcaattgagttgagtttttagttagggtttcgagtttagtcgaaatttttgtaaggagtgctattggtgcactttgtaaacacagaaagaatcaataaagtcgtcatctactttaagagttattcgatttgtatttaccgggtttcggcggtctaaccgacgatataccagcggtcaaaccggtggtggcgaggcagtcagaccggcggcggcgacagcaagcggcagctgatcttggcggtcagaacggagatctaaactcggtcagaccgacggcaaccaggcggtcagaccggcagggcaacttcggtcagaccgcgatccgtcgaatttgagggtaacttttatttccgctaaaagttttcggtttttgggtataccaatcattcacccccctctggttggcttagttattgtgattcgatcctacagcaagtacttgctgagggctgcctttggctatgggaactatgataggataaacaggctccctacctttgatctctacctaggggtgaactactggacaacagtaaggattgtcaatgccagtacagcatatgtgtttgagattatcgcggtgtccccagccgactatttgcaagtttgtttggtgaactcctttcatttcagggcttgacttgaggccattccaggaaaaaatttatccaggttccaatatgacgcatgctctagtcttgctcagcttcttccgtaacacggtcaaattcgggcccaatcgctaccactttggaactgatgatcatcaaatcaggtaactattcatgcaatgctttgctatgcaatttttctttgacttatgcgtttacctgctcgatgttcttcttaatctataaggttcccagatgatccccgcgataggatatggcagaagtatgaagatgtctcagaatggacggatgtgccagataccgtcaatgggatagtccagaactctcccaacgatacatacaacgtgccatctgcagtgatgcgcagtgtatccactccgttgaatgattcaagaatggacctgtcatggagttcagattcttccatgaacgttgacattgccaccaagttctttgttgttctgtattttgctgaggtggaggccatccaagggaatgcattgcgtcaatttgatattattctggataataacacattagttagtgcattcagtccaatctccatgatgactagtgttttctcgggcattgttcaaggttctggcagtcatggcatctcccttgtggcgacatcaatctccaatcttccgcctttgattagcgcaatggagatattcgtggtgcgcccactgaatgaatcttccacttattctgaagacggtatataatatgaccttgagaactttcatatttgtttcgtctgtccacatgttactgtgagtgtcatattcgctatcaagataagattcaaactaactaatgtctatttgccatcaaaatacaaacagctatcttgttttcggtatgcagttgtttggggctggagcaccttgtgatcagaactgtatatagacattatttatcagtgctctgaaactgatgtatataacttacttacattattatggaactcaaatagttgatcttatgttaatgtatctaccattggggccaattttgaactgaattagattcagcatgcacggaatcttcattattgagtggttgattttctttctatttatctttgctatcttcagcacattctatgatgatcatccagacaaagttttctgtgaagagaaactgggcaggtgatccatgctccccggcaaccttttcatgggatgacttgaactgcagttacactccccatggtccaccaagaataactggcttgtgagttctgaatgaacaagataactcaattacatgctgtgataaaatgcatggataaaacattgagttgtagtgttcaatttatgtgatgatggtttaagtttcctgcagatatatgtcatctagtggattgactggtgaacttgatgcttcgtttggtcagctgacttagctccaacacctgtatgttttgtatagtacgatttcagactttccatgttataataatacctcttgcattactgtttagccactagtgcttgttgacttgctttttttttgaagtaatttactgcaggggaagccccca

SEQ ID NO: 12809 - DNA, 715 bp, Oryza sativa
cctgcagccccgcggcagtgccgcctcctcgccgacgcctgcgcgcgcgcgctcgccgccgtcacggggcaggttcgcgccgagctccgcttcgacgagcgcggcgccaagtggcgcgccatcgaggcgccgctccgcgagctccaccgcgccttccgcgacgccgaggcgtacgtcaggcagtgcctggacccccgcggcagctggtgggcgcgcgcccggccatggcgcacggcaccgagtgcgtggagcagcacctccacaatgtcctgtggtgcgtcgccgtcgcgctcgaggccatcgacgccgccggcgagatcgccggctccgacccggacgagctcgccagggggcggctggtgctcgccaggaagtacgacagggacatgctcgatcccaagctgttcgagcacgcgttcggcaagctatatctggtctcccaagagctcgttgcaaggatggacatggcgtggaaggaggacagatgggtgatatcgcaaatgttcgacgaaatgaaaggccctgcggcgtcgaaacctctgagcaaaaacgagcaccgcctcgccgagctcctcgccgcggcgatggggaagctgcacccggcatctgtccttcttggcagcgactacagcgtccggaggcggttcggcggcggctcaaggaggtgcattggatgggggagagctttgcgatgaacatttcatcggggacaccg

SEQ ID NO: 12810 - DNA, 770 bp, Oryza sativa
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 12811 - DNA, 34774 bp, Oryza sativa
  unsure (1)..(34774): unsure at all n locations
cggcgccgacatgcggggcccaccggtcagcggctcgggagagagggaaaaggggcgccgcacgcgggccccactcggcagcggctcaagagggggggcggtccaccgtggaccgggaccacgcgggtggtacaccgccggtccacgggaccgacggcccagatcgcccccggggctgatcggacgggcggcggcgacccggctcagcttggctcaaggccggccgaccggccacggcgatggcgacggcgcgcacgcgcgcacgcgttgccggcaacagcaaccggcggcggaggcggcggcgcgaaggcggtggcgctaagcggcggctaggaaggagagggaggggaatagaggggagagggatgcctcaccgagagtggccggcgcggaggaagacgacggcgaacggcgacggtgaccacgggcaaacggcggcgacgggcggacgaggtccggaatgccctaagggaggaaaagagagaggttagagggagagagatgaaccacggcgatcggaaaccatggccgaaggcggcggacatggcggctctcaccgtcgcacggtgggaacggcgctccagcggcgaacctcgacggaggaggggtggacggggtggcccttgaccttgcgaacccaacggcggcgacggcgcggtgcggcggcgagcctagcggcggccggagcggcgggaaaggcggcggcgggtgggtgcacagcgcgagagcgatggggagcacgagggagttcggcgaaatggggaaaaagagagagggggcgacggcggagcttaaataggggaggggagtctcggacgtggccggtaggggcgagattccgccggccaacgtgggggagtgggagaggagagagagaggcgggattcgaaaatcgaatcccggccatctcgggcgcgggcgcgggcgggagagagaggggagtgggcgcgggaggtgcggtgcatgcgcgggcgtgaccgacgtggcccggaggaggcggaggcgtgggcgcggcggcgcgggtggggcccacctgtcggcatcccgggtgggaggagggaggcggccggcctagctgggccttggccttcggccggcccagcggaggggagaggaggaaagagaatgggccggcggcccactcgaaaagaaaagggggaaaaagaaaaaaaaagaaaaaaagggagaaaaggattttccctggaattaaaatattgcttgctcaattttaattggttaaaattatttctagggctctgaaaattccactaaaaatcctgttagtgaatttcgacatgtagaactcaaggaaaattccacatgccagattcgattattatttgtattactttcttagggttttctcttgatttgcaccggcattttcttagggttatttataaattaaattttaggcttgggaggaaaactttagggtgtgacaaacaaaaactgggaaggcttatataggagagaaaagcatgtcattctggaaagaattgatgccattgacattagagtagtagaaagcatgggtatgagtggttctgatagagaggagagaagggagcttgaaaagagactcaaatttgttattagggaagagaaactgaggtggattcaaagaagtaaagagaaggaagtattagaagggaattgtaatactaagttcttccatgctaaggcaaatgggaggaagaggaagagtcagattcatagtttggtgcatgaaggagaggtgattgaaggacaagataagttattgctttatattacaaatttttacaaagatctctttggacattcaaaggaaaataggttttcaattgatatggcaaatgtatctaaggtggcagaggaagatatgaagaagttaaccactcctgtcactttagaggaactcaaaacaatgatttttgaactaaaaaagaacaaagccctatgtccagatggattaacaggagaattttacatgtgtttttgggacttggtcaaacaggacatgattgacttgataaatgattttctcaagggtttgataaatatttatagattgaactttgtagtgattactttgattcctaaaacaaaagatgcctatcaaatacaaaaatttcgtcccatatgtctgttgaatgtaagctttaagataataactaaagtcctcatgaatagactcaacacaatcatggcatacattatctctaaatagcagacaacttttctgaaaaatcgtttcatcatggaaggagtggagatattacatgaagtgctgaattcagtacatcaaaaaaagcagagtgggatcttgtttaaagctgatttcgaaaaagcatatgataaggtggactgggtctttatctatcgaatgccgaaagcaaagggattcccagatcaatggtgtgattggagcatgaaagtgattatgggagggaatgtggccgtcaaagtgaatgagcaaattgatccttatttcaaaactcacaaagggttaaggcagggagaccccctctcccccctgctgttcaatttggcagcagaagctttgactttgttaatttagagagctgaggagaatagtctgattgaaggtttggggactagtggagataacaaaattgctgtcttgcaatatgcagatgacacaattttccttattgatgataatctggagcatgcaaaaaaatttgaagtacatcttgtgtctgtttgagcaccttaatggacttaaaattttaccaaagtgagtttttttgctttggggaagctaaggaaaaacacgtatatagcaatattntcacctgcaatgtgggtgatttacctctgaaatatttgggtattcccattgaccaaaaaagaatactaaacaaggattggaaggtggttgagaacaaaatggagcataaattgggttgttggcaaggtaagctgcaatctattggaggaaggctggtgctccttaattcaagtttaagcggtgttcttatgtacatgctctctttttatgaactaccaaaaggggtggaagataggatggattacttcaggaaaagatttctatggcaagaagatcaaagtattagaaagtaccatctagttaattggcccctaatttgttcactcagagaccaaggaggtcttggggtgattgatttagaagcaatgaacaaagctttgctgggaaagtggatatggaaattagagaatgaagagggttggtggcaagagatcattattgataaatattacaaaaacaaaccactatcaattctgaaactcaaacctggtaattcacatttttggcaagggattatggaggtgaaagatgttttctttagttcgtgcatataaaaaagtgggaaatggagaaaatactcttttttgggaagatagttggataggtggtagaccttttggccttgcaattccctgagatttataacatagccttgacaaaaaagatcaccattgcatacttgaacaaaaagggcattggttctataaaattcagaagggatttgtatggagccaaactaagagattggagaaaaattacacacagctaggaagagttggatttgaaagaaaattgtaaagacaaactttggtggaccttgtccaaagatgggaaattcactgtgaagtctttctataatgcacttaaaatgaagcaggtgaattatcctcatagaaaaaatctggaagttcaaaatacctttgaaaatcaaagtgtttctttggctctttaccaataataaaattttgacaaaagacaatcttttcaagaggggctggaggaaaggtgataataaatgtcagttttgtgataaggaagaaacaattcaacaccttttctttgtttgtcccatggctagattgatttggaatataattgcttgtgctctaaatttgaatccttttttgaacatgcaggaactgtttggttcctggattaagaatgctgacaaattcacaaaaaatctcattctggttgggatagctgctgtgatatggtctatatggaaatgtagaaataaagcttgctttgagaaaaaaaacttccaaatgatcccactgttttaattcacatggcctgcaattgggtggatgcatggtcaattttgcagaagctggaagcaagccgaagaagtttgcagctgggagccaggttgttaaaacaagtagcacatgaagtctacaactcaagacatggctggtgaggagtacacaggatcgcaggatgatgaagacagaagatggcctatgcaaattgttgcctgatgtccgttttgtgttgttttctgctcaggaagtgatatgtcccagactactcaagtaatatcagtcggtgatttgcatatttttataaagtctggagaaggccaaagaatatttcaagctccatgcagtgtaccagtgccaacagatggatcactgtatgcgatgactctggtgggtgtgttgattgtcccttctttggccttctatctagatctattgttaatcttctatgttgatcttctatctagatctattgttccgtagactctggtgggtgtgttgattgtccctcctctcctcctagggggtcttgtatttatactcataaatgtcccattgtccaagtagaactagggaaaccaatatggatacaatccgagtagtccttgtcgtttccatatagaactctggttgtctttccttatccagaactcctcctatatccgcaggttgtttccgtataggacatggtacgtggtgggtcctgccgagatttagtcaattactattaggtatgtggtatccatagccttgacacaaataagaaggctttgcgtcagtccagatactctaaaattgtgctccttacaaattgacactccaaattttttgttttgttgtactacaccaaaatattctggcaaaccgccactggacactgcatcttcattgaaatataatatgtacttaactgcggaaacgtaatgaccgggacatgtctatttttccacatatctcgcgcttaaaagaatatagtctgaaaaaaaattcaatactttcacaccctgaaattgaggcttcaattatttgacattgtggcccaatatcattaactcagcttgtcctatatcccatcatcacgagtgtcaacattatcaaagtggcaacaaatacaatgtcaaattagcaattctctcattaaaaaagaacatatgaaggccaacttcatttttggaacatattactttcttagagatttaagacaacacaatttcaagaattttagtttagaattatgtgctttggatcatacttaccagcttaaaaaaataaaacgtctaaaacagaaccaaagaacatttttaaaaaagccttatacatataagcgttcacacatatatgataataacttaaagcaccatcaataagatgcccgcgcgtgtgcgcgggcttccctcctagttgtccacaaagcacaaaaagagtcagccgatgaagcaacaagagaagtcatcacaaagcccactttgaaccgaaggaaaggccatagaacgatcctacaagtaaagcccaaaaatgtcgagtctttagggccgagttattactgaatggcatgtaccatcaatttgtcttcttgtgcagttatagaatccgattgacccgcaggccgcaggcagtggttgctcaatgcacattttgtttcagtactttatggaagcctcctcatagctacatgcctgcatttttttggtcgaatggcctagaaatctagaatcctaccctttgcgactgaagacgtgatctagctgtcgtccatctcttcgaggttagctatctaacctggtcactggtagccatggcatcaacgacgatcgacgagcttaattaattaacaaatgggatcaatatccatgcattgttgggcgttgataccatggatagtactatcaactaaagttttgctagctggtaccctctgtttcaacagaaagctcaattgttccatcattccatacgtgcacgctctagctcaagcattccactgttttccaagaacagcttgcacctacctaaccttgctacccatctgcaccctgtttcacacaattcccattcatcgctcatggatgtaacatatccacggcacacaaggacagactagcctagctagctacacatcttaattttctgttaattcatgccatcgatcgatccatcgatctggagtatatataaagacgtcacccctgcctccaatcttcacaccaaacgtaaatcccaatcaaccaagctctcaagtacgtgcttagctagctagctagccagtaactgaacatacattattcatagtgattagtgagctaataatggcgctgatccgacgccggctcctcccaattctgtcccttctcctcgccgtcaccttcctcgccggcgttgcgacggcgaagaagaccggccaactcaccgtcttctggggacgcaacaagaacgagggcacccttcgcgagacctgcgacacgggactctacaacatcgtcatcatctccttctacagcgtgttcggccatggccgctactggggcgacctctccggccacgacctccgcccaatcggcgccgacaacaagcactgccaatccaaacacatctccgtcttcctctccatcggcggcgccggcaatgattactccctcccatcctcccaatccgccgccgacgtcgccgacaacatctggaacgcgcacatggacggccgccgccccggcgtgttccgcccattcggcgacgccgccgtcgacggcatcgatttcttcatcgacaacggatcgcccgaccactaagacgagctcgccgtcaagctctacgcatacaacaaattgtaccgtgctcggacgccggtgaggctgacggcgacggtcaggtgtatgttcccggacatgaggatgacgaaggcattggacacgaagcttttcgagcgaatccatgtcaggttctacgacgacgccaagtgctcctacaaccatgggggcctcgccggcgtgatggcgcagtggagcaaatggacggcgaggtacccgaacagcgaggtttatcttggtctcgcggcggtgaacttgccggggaagaatgacaatgtgtttgtcaagcagctctactactatctgcttcccaatgtgcagaaggcgaagaattatggtgggattatgctttgggacaggttctttgacaagcagactggttacggcaaaaccgtcaagtactgggcttaatgatcagttaattacctgcttaatttcggtactaaatactatatgtgttgatttgtgcgtgtgacggtgtgagtgcaagcatgtttcagaataaaaatggttgtgtcggttctttacgtattgtatgaataaaatgggatcactgtgtaacgagatctcaagttgtttgttggtcatcaatggaataattaagtgtttatatatgcaacttgtcaaattaatgttgaccatcaattgtttgatactttttgtttgggacagaatggcactgcaaagagaatttgttttttaagtaaacagtataccctgtttcattgaataaaggaggagataaaagtatttacaggaaagaaattctgcaagacaagagactgatccttaattgaacaagctaagcaagtagatcaggaacaataagttttctatgggaattgaggagaagtcagctacctgtaagttatgttccattcagattggtccgtcagctttaatcgaggagaagtcagctacctgtgagtgcatgcatgtttcagaataaaaatggttgtgtcggttctttatgtattgtatgaataaaatgagatccctgtgtaacgagatctcaagttgtttgtttgttggtcatcaacatcaatggaataagtgtttatatatgcaacttgtcaaattaatgctgaccatcatttgtttgctagattcttgtttgggatagaatggcactgcaaagagaaattattttttttacgtaaacagtataccctgtttcattgagtaaaggagtaaaagtatttacagcaaagagaaattctgctagaatgcggcgagaaaagtggacaagagactgatccttaattgaacaagctaagcaagtagtagatcaggaacaacaagttttctatgggcatcgaggagaaatcggctacctgtaacttatgttccattcagattggtccttcagctttgattgatttgaaattctgattcgttctaaacgcggccaacctacagttttaaggtcctttttgaggtaccttacattactcctggtcaagtacaaaaaagtcttttgacttttcaattttcttaaacacgtagggataggcaagtaacgttgattgattgtttttaggtttagcgtgttgccttctcatttaacggctcaaattacaggatgacgtggttgacaaaatcattctgaaaattattccctttttggcgaaaccgctggggaacaaggctgtttggttccccgccagacttcgccacgccttggatgcggcagccacgcaaaacaggctattgtttggtttccacataagttgaggcagccacacaactttacagtcatttctgtgatagtttatgccataagtgcggtgagcttttccttcgccacaaaactgtggcagcgccacaacctggctggctaccaacggcagcgaaccaaacatcccatattcggtgcccaatcgattttgcgaacactgcatccatggcactggttttatctatcttcacatgatactaggcatactctgcttcctctgttctattttttttttcttcacgacatatgtgacaagtaatagagtattgagcttcgctcggtgctccttactggcagtataaaacaatatgaaccgttagatttataaacttttttcagtagaaatttggagggttcgatcatctaaggagaaaaaaaggccgtggagggtagaattgtaaatttgcatctctatctaagtgatgcccccaccggaatcgtggccaatgcgcctccaccgtcggtaccaacgctgaatcgcaaccgaacgatccaccgttcatttcgatggaatgaagtcgatcggatccggtgccttctattgttttattgtttcatgaagcagatcagtaaatgactaatatgtcctttcaaatgaacgatttatattatttctactggcagtataatattaccagtagggagtaccgaagcgttcctctatagtattaacatgcataccgcttggtggatccttaattgaacaagctaagcaagtagatcaggaacaacaattgatcaggaacaacaatttttctatgggaattgaggagaaatctgctttgaaacgacctgtagggttatgttcttttcagattgcttcttcagttttcattactcggaaagtgtgattcgttctaaaccaggacatcctgcagttttaagatcctttatgacttatgaggcgctttataaaacttattgtcaagtacaaaagggtcttctgagtttttaattttattgaacgcgtagggatgggcaagtaaccttgattagttgttgttagagcaggtacaatagcaggctataagccagctgcaaatatattttaagaagataaatcaggagagagaagagcaacagactatatatttgtagccagctgtagcacggactccaagacgcagtgtgtctatgacaggtgggactaggtattaatagtgtaatatgtaactattgtatgaatgagctattagattggctatagataaattggagctagtagttggctatactattgaacttgctcaagagcacccgcaatggtaaagtaaggtgctctttataaaacatgtacatctcagcaatatattagattaatagtaaatcatctcaatagtatgtctacatgggtatctatagctctctcatgcattatctcgttcatagttagtagatagctttgctctctctcttcatttaatgtcttccaagtaggaaaatatgctgacatggatctcttgtagagagtttatagataaccattgtaggtgctcttaggttgagagtgtggagattaatcatttttagagtactgcgtttttcggtgaaaccgctggggtcggtacccaaccacaaggtccacaatttgcgaacagtgcagaatggcactgatttagttattttatctctttacatgatactaggcgtgctctgtttttcctttcttcgcgggatatgtgacaagcaagcggtaatgtattaacatgcataccgcttggtgtacaaccaaggtttgcaaggattaacatttggtaaccgcacagagtcgttcaatatgctttgcctattattcaattcggtaaaactaattgaagaggcctctccaattagttttaactagagacatccacgtgctagtactttaggagttttggttgctattaatccatttagcaagtagggaaaatattcctatcatctatgcttcaaataaaattttctcttcaattactcatccgttttacaatccgattacaccgttgtgtttgtaataattaaatctttacaacaagatctcacatgattatattttgatgaaaaatcacaaattacttttatgatatgtctaaattacttttagatttcactaagttacttcttagagatataaaagtaaattcagtaaagcttaaaagtaatttatatatatattatatagaagtaacttataataaaaagaaagtaactttaattaatgacttttttcactgaacaaattatatatatatatatatatatatatatatatatatatatatatatatatatatatatatataagttacttttagatttgattaaaatacttcctatatattcataatgctctgagatgattacttttattattttttagttaattttataatttgtgctgattaatttaatttcgatctgcgggtggcgtctgccctcgccctgcccgtgccctgggagggcgatgctcgggatcctcttctcgtggttcttcgagtactcgaccatcggtgtttgtattcagattggcggcagccgctagcctggccgctcgtgctgctgcttctgcgtcggctgttgcctcctgattaaccgcggcagttctccttgccacctcggaattggttggttcaggtggtgtctcattgttagcttctttgaacgcctagtcgaggtttgtggccattgtgcgaatacgctcggcccattgtgctatctccggatttgcggcggcgtcaaagggtgtctcgttgagtatctctcgcatagtcgcgaggtgttgtgcgggtgtcccggaggttgaagccgtgtttttgccgtcattaatggcgtagactcctcttgtgttatcggactcagacgccgagtaaccgtcatcgccatctgacgtgtaggattcctgttcgtcgaaaataatggctccaacaaagcagtcggagctatattcctcttccgtcttctccgtgtcgcgtcgggcccgagtgcttctgggcgcttctcgaggtgcaacgtacttcacagccttcaggaaaaccctgcaatccaggatactatgcgccttactgttgtggattggacaccaattggcgaacatacgtgctccctcttgttgtccgttctcttccacataggccttgacgcgttgtaccgccttgtagtcttccaaagagtgcttggtggtcttatggatggcacaccaagtagtcaccttgatgcgaacttccctagccggtgcctgatatcggaaggtggcctcgggaggttgctcctttgttgtcataatagccagtgccctgtcctccgcctgggcgggaagggtcgtccacttctggttggacttcccctctgcatctgctaggttcacgaccgccggttgaccgggagtgactgtggcagtagtgcagactgggaaggcgatcgatccgacttgagtccacaccaacgttgtcggcatgggtgctgctggggcatggctggcgtagtagtcgatgtaacttggcagcatgtcgtgaggcccttgaacgccaagccccctacttggtgtgccactgtcaacggctggtatccgtagacggggtatgtagaaatcggaggaacattggcgctaatgtagtacgacatcgctggaaagctaaggcaaggattttatattggttcgggccccgagaaggtaataaccctacttccagtttatatgggattgctggtgggaaagatcccgagtacagagtacaatatgtggaaacaggaatccggcgagatcgtagtcggaagaatcgaatacaatctcgacggttttggtggctatggctacggaattatgcttctgacttctgttgtggcttgattgatccgtcctcgacccataggggtggtaatccttttataccgtgagctaccagcagtcctcgtgtaggactcggaccgtgaggcccgcacggcttaggaaagcccctatcttctacgagtaggtctccgtcttagtctcttggtatacggactccttccgtattctcctatgacttccttgtatatcttggtcttctttctgtattcgtgcaggtatacctttgcttgtactctgtatttcatttccgggtaacgaggatatcccttatccataatcctgacaaatacatatgaggcaaaacttttgccctcccttcaaaaaaaaaagaatcaaccactccagtccggtttagtagaaacaccgttcatgcaaatgaagtgcttggaaccgactgaaccggttttgccataaaccggggttaatccaaagatggttggactggcggcgtgcgaagggatgggctccatgtttagtaatgggctaaagaaggccctgtaaagtttctgaggttcggaagcgttcaacccattagaggccgcatctttgttaatatatagttggtgaaaacagccatcaccgggtttacaatcctgcgcatgtgatggccggatagatgtaacaaacatactccctccggacactaatacatgacgtttcggatagctaatttacatagaaatcaagcaaaaaaaattgtcgaaaacaacatctatagaaatatggagggagtacaataaactcctatagtgaagctagaagatctaatccatccgggccaagtctcatatgcacacacatatactccctccttccacaaatacttaacgtttttgagctaaccaacgtcaagtaaataaaaccggagggagtacatatataagatcacaaactatattctaacaggcccaacatggcctaaaatagtcccacaaaggcacttttaaggcaaaaatctcccgaaatgcaacaacctatatagtttcattgaagtaaaaatatgcatatgttttgtatggtgtggttcaacatttgaactatataggcgacccggcgaaccaaccagagtgaactggttttagtccaacaacccagctgggtcaaccttcggtctagatttttccactatgcatggtaagcgctacaccggctggctccttgggtggtcggatgggcaagcctgaggatcaacatatttcttttatttgaaatttgataaaattcaatccaaatttgaaactttctgactagagattgtatgccccatgcaatatttatgagtggataagggaccggaagttgtatgccccatgcattcgcgcagagaaatgtactataattaaccacacgagggtcgcgcgcgtacgtagaaaaatacatatgtgccggagtgcgtgcgccagatccgcttctcacgcgcacgtagctagagtcgtcgcctgggagtagcaaaacatgcatatataagcataaattataagcaaaagatgattcgctatttaaacgagtgagagtgtagtaagcatgaactaactatatccggaaacattatgcactaccctcgtgacactgacatacataatctaatcaaattatgtactaccctctcgatcgatactatgcaatacataaacttatcaaattatgtaactattctcgcgacacgtacacaccaacacataaacaaatcaaagtaccaaaccatgtagcccatgccactatatatatgcatgcacatcatcgatcagattgcaaaacgaagaataacacactaacttcaccatgcaaggttcagtaggagtccatggcatcctcctcctcgccgccgccgccgtgttgacgcagtgtctcctcgccgccgccgttaatactccggtggtccagtgcgcgtcggggacgacgaaatgcaccgtgaccaacgcgttcggcgcgttcccggacgggtcaacctgccacgtggccgccgcggcgttcccggcgacggaggaggagctcgtccgtgttgtcgccggcgcggcggcgtcggggaccaagatgaaggtggccacgcggctcggccacaacttcatgaagctctcctgccccggcggcgacggcctcgtgatcagcacgaacgcgctgaaccgcgtggtgggtgtgaacgcggcgaggatggagatcacggtggagagcggcgtgacactgtctgagctcatcgacgccgcggcgcacgccggcctcgctctgccgcacgcgccctactggctcgacctcaccgtcggcggcctcctctccaccggcgcccacggcagctcggtctccggaaagggcggcgccgtgcacgagtacgtcaccggcatgagggtcgtcacgccggcgccggcgagcgaggggtacgcgaaagtccgcgtggtcaacgccggcgacccggatcttgacgcggtcaaggtctccctcggcgtcctcggtgtcatctcccaggtgacactcgcgttgcagccgttgttcaataggtcggtctcgttccgccgccgcggcgacggcgacctcgccgaacgcgccgtggcgttcgccggcgagcacgagttcggcgacgtcgtctggtacccagcccgcggcgaggccgtgttccggatcgacgaccgcgtcgccaccaccaaaaccaacacgatctcctccggcgatttccagaacgtcatccagtcgtcacggtcaacggagcagcagcagcacggagacgtgttgccgttccaggccggcatcagcgtgccgctgtcgagggcatcggcgttcatccgcgacgcgcagcggctgctcgacatgaaccccggcgcgctctgcggcggcgagaacggcggcatcctgatccgctacgtcaaggcgtcgacggcctacctcggcaagacggaggacagcgtcgagttcgacacgaccagctgccgccatgacggcgacgcggcgatgccggaggagatggagcagatggcgctgcgcaagtacggcggcgtgccgcactgggggaagaaccggaacgtggcgttcgacggcgccattgccaaattccccaaagccggcgagtttatgaaggtgaaggacgcgtacgatcccgatgggctcttctccagtgagtggagtgaccaggtgctcggcgtctccggcgccggtggtgtgaacgtggcgaggaacgggtgtggaatggaggggctgtgtgtttgttcggaggacgagcattgctcgccggagaagggatacctctgccgtccgggaatggtgtaccgtgacgcccgtgtgtgcacgccgtgtcgccggcgacgcctacgccgatgcatgatcgaactcgatcgtcagaacatgacacgtacgacggcttgtatgtacgtgtagtgtgtgtggccatgctatgcaggccgcgtgaataatgtagtagtactggcagttaaatctgcacgaatgtactgctacatgactgcaatttctagttttcaaataaaacatgtttgctcagatcagatcaatggcgtcgattttctgaacatatgtttcattttcgattcaatggaaaaaaagtagtaaaacatttcaaggctcaactcgatcgatttggttttaaaataattgtggacactgcccaaatcaactcgatatggcccgggccaaaaacaacaccatcatcatagtatgagctgctgaagtaggtatggcaagtcatttcaaaagagtagggatcgatggcaatggttcagatgggacgtagagcaagaacatgtccgagccatgctcgcgagaactagcccggtgttaacagaattgatatattcggttttatctatgccgaacagcttctagatattaggagatagttatcacatgtgctgttatctcctgtaatctagctctatagttgaaaccttgtacgccacggcttggggctattccagccatcgctatttaacacgcaaggcagcgcagcacgcgattgtgcggttgctttcaccgaaactttacatggtatcagagctgtaatccaatctatctctacctctcaatcaatggcgtcctcttcctccaacgccgcaaccagcaaccttttccaaggacacccggtctctgagaagctcgggaaaaccaatcacgcactctggaaggcccaagtcaccgcaggagtgcgtggggcgcgcctctacggtcatctgaccggcgtgactccaaaaccagatgaggagatcaccgtcaccgaaggtggaaaagaggtgaagaagccgaactcggcttatgcagattgggaggctcaagaccagcaagttcttgggtacctcctctcctccgtcacaagagatgtactcgtgcaagttgcaacctacgaaacagcagcagaggtgtggggaatcatcgaacagatgtacacctccgactctagagcgcgctccatcaacactaggatagcgctcgcaacaaccaagagaggaaacatgaccatcacggagtacttcacgaagatgaagaccctaaaggatgagatgcaggccggtggtaaaccactggatgacgaagattttctgcagtacatcatcaccggcgtcggccctgagtttagcgaggtcgtgtcggtggtgtgtgcacgagtggaatcaatctcaattggagagttgtactcacaactcctcaattttgagactcgcaaggtgctgtacaatggagcacaagacactggagggtttgccaatgtcgctaatcgtggcggctttggtggacatggcggatctaacgtttgtcgtggcggcggcgctcaacgtgggcgcgggcgtggcggcaaccaaggaggtcgcggcggcggtccaggaggtcgtggccgtgggcgaggatatgccggccctgatctccgtccgacttgccaagtgtgcttcatgaaaggacacacggctccagagtgctggcacaggttcgatgacaattatgttaatgatcaaaaacatgttgcagcagccacttatgcagggtatggtgtcgacacaaactggtacatcgataccggcgccattgaccatatcaatggcgagcttgataagctcacaatgaaggagaaatatgaagggagcgatcagatccacactgcaagtggagcaagtatggatataaggcacattggttctactattgttcatgcccctaataatcaaaaaatacatcttaaaaatgtcctatatgtaccacaagcaaagaaaaatctagtttctgttcatcgtcttgttgatgataactctgctttccttgaactccatcgtgattatttttctcttaaggatcgggtcaccaggaaaacactccttaaaggaagatcatggcgcaggctctatccccttccaaaatcatccttgaagcaagcctgcagtgttgaaaagctctccttggcccggtggcacagtcattttgctcatccctcatcttccatcgtcaagcaagtagacaataaatttcatcttccttgttcgagtttagcaagtgagtcggtttgtaatgcttgtcatcaagcaaagagtcatcagttaccctttcctatttccactagtgtttctaggcatcctttggaactcatatttcctgatgtttggggtcctgctcctgagtctgtaggaagaaaaaaaatactatgtgagttttattgatgattttagtaagttcacttggatttatctcattcaatataaatcgcaagtgtttgaaaaatttcaagagttccaagttatggtggaaagaatgtttgatagaaaaattctagctatgcaaaccgactggggaggtgaatatcaatcattaaattccttttttcgcaaaattggcattgttcatcatgtttcttgtcctcacacccatcaacagaatgggtcagctgaacggaaacataggcatatagttgaagttggtctttctctcctatcgcatgcctcaatgcctcttaaattttgggatgaagcattccaagctgccacatatctaatcaatagagttcccagcagagttactcaaaacatttctccccttgaaaaattatttcagcaaaaaccggattatgcctctcttcgaacctttggttgtgcatgttggccacatttgcgcccttataacaatcacaaacttcaattccgctccacacgttgtgtgtttcttgggtttagtaatatgcacaaggggttcaagtgtcttgatatatcatccggtcgtgtgtatattctcgggatgttgtgtttgatgaaaccatatacccattttctgagcttcatgcaaatgtgggcgctcgtcttcgtgctgaaatagcacttttacctaatggggatgaactagtattgaatcatgtggctaatccattgcaaaataattttcctgctcataatattgctcaagatggtgcaccagaattttcagccgcagaagatcccgtcagcgatcccggtgatgattctctggagcagtcagccgagcggtatggggacgaggcgttcgagttcagccagcatgtcgagaaggtctacagaaaagggatctagaagatgtgagaaaaggcttaatgcagtcaagattcagtgaggtcgatctacgaacctaagttgtggtgcataagcggagccaagtcgagacctgaaggggagtgactagtcgaatccacgacgcgctcatcatctctatctatggcccctgggtcccgaacaggggaatgcgggctagtcgatgagtcacggtgttcaacaactgaaacatccgtgctaacgtttactctgcaaaagcaccttcaagacatcacaaggaaagacaagacattctcacagagtaccgaatcgagtacttaagagtttaaatattacaaggccttttaagaccactgggttataaaaattacccctgatagaaggggaggatgctgtcggcgatcggggcgacctcttccgcaaattggagatggcccgagttcgcctcgccatggcgaaggatgttctcgaggtccagctccgggtaattggccctgaagcaggcgaggatatgcgccgcgccaatacggactccggtggtcgcagtctccctcatttggctggtatacttcgggacaacgctttccagcactgtcacgagttccgccaaggccgccgtcatggacgtctcgtccccgaaagcaggagcctccacttctcccagactagtggcagtttggtggagggctgtgtagctaacccggagggatttcttcagctcgtccatatggccgtggagctcgtccaatcgtgcctccaggcccttgtaccggtcattggagccggcgtagagctccttcatcttggcgaggtccgcctcagacacctccagtttcttctagaggtcgtccatcctctcattcgcggcatcaataagagtactcgagttcgcaattgaactcgagagctccttggcgccttcctcgagcagacgacgcccctccgcaattttctccacccagttccgaggacgggagatttgcgggaggggaggggtcgtacttggagcatcagggccgattcggacgccgcaacaacagccgcttccgcagcttgatctttccccgaagacaacgtagtcgaggaagctctaaaacaggaggtcgacaaaggacgtcgtcaggagaaatcaaaatatcccgcgcacctagtcgagcgaacaggaaaatttacctcgactgtgtgatggggatcagctttgaaagagggaccagcggggcaaggggctttgcgggaccctacagttatcagaagataaggatacggcataacgacgaagatagtgaaaagcgttccggttgaaaaactcaccttcccgctgctcggtggaaggggcatgatgagccgccaggacgacggagccgttccttttgcagaaggagacaacaaggcccccgatgaactcgggacaacctatagaaaagagatcacagaatcaggacagagaagatgtgtgtttcgcattttccagtaattaattttctcagaaaactttctcgttacctcagacgatgccgctcctcacgttttctcggcggctatggttgttgggacctgggaggccggggctgcaggggttgagaaaggcgtagggatcagatcatcagagaaatgcgggagctttatccccacagaaaccctaaagtaatcctcttcttccaaaatgattctatgaaagaaagtcagaagatgaagatctgaggagaacctggagcgacgacggtgggttcgtcctcgacggttgggccgccgtccgcggttgccgtgtcctctcggcgcggcttcttcgggaccttctccgcaacagtcgaagccttgttcttcgtcatctcgcagtatggataagaggccggcggggaggagaatgaagatcaaaaggcaatggtggaaggaagattagagaatgaaagtgaaagggcgtcgagcgaagtgaacggctcgcccctgtggagatccccttttatagcccgatggcccaacggttcggtttccgagatttttcccacctaagttttcgggagtctgttgaggaaagtggatttagacttcaaatcaaatgaacagatactagaaccctggcattgtcctcgggatcaccttgccttctcgaatttccgagaacggtcataagggctcacatagacaaccgggtacgaaacagacatcggatgacatttgagttgaagtcgggggctactgtcaggattacggataaggggtatcctcgttacccaaaaatacagagtacaaggaaaggtatacctgcacgaatacagaaagaagaccaagatatacaaggaagccataggagaatacggaaggagtccgtataccaagactaagacggagacctactcgtagaagataggggctttcctaagccgtgcgggcctcacggtccgagtcctacacgaggactgctggtagctcacggtataaaaggattaccacccctatgggtcgaggacggatcaatcaagccacaacagaagtcagaagcataattccgtagccatagccaccaaaaccgtcgagattgtattcgattcttccgactacgatttcaccggattcctgtttccacacattgtactctgtactcgggatctttcccaccagcaatcccatataaactggaagttgggttattaccttctcggggcccaaaccagtataaaatccttgccttagctttccagcgatgtcgtactacattagtccttacgccaacgtttctatgattgctacataccccgtctacggataccagccgttgacagtattgatagagaaggagggagaggttgattctgggatttttcaggttaaactgatgggccattttttctatggcgcttgcataaacagtggatgaaaactttgctcagcgcacatctatttttctgtcgatgactgataaatcgaatacggggtcgtttgtacccagaaaattcgttgataccaagactaacaaaaatacatgataaacatagagggagatatatttttatacaggttcaaccccgtcaaggttagtagcttacaaaagcacgtagcgatgtagggtatccaaattgcgcagataataatactcaaaatactagctttcgctagcaagataaaaaagggagagtacagactgatacgtcgatcacacatgcatgtatggcggcacaccgagttgtgcacataaaaaaaaaacactagctttcgctagcaaagattacaaaacaacatgtactaagtaatgattactgtgatagtgattgagctatatgcacgcacggattggactgatgatggaggcacacgtatatatagagagattatcgttggttgatctctgaatcttataattaagcccaggcactgacataccgtccgtagtgagtgatggagtcatagtagctgttccaaagcatcactcctccgtaggtatccgtcttctgcaccgccggcagcagcttccggtagagctcaccgacggcgaccatgtcattcttccccgtcaaattcgccgccgcgagccccaagtaaatcttcccattataagggtaactcgccgaccacctgttccactgcgccatgacgccggcgagcccggcatggttgtatgaacacctcggatcatcgtagaacctgacgtggattcgccggaaaaggtaggtttccagcgccttcttcatcctggggtcagagtcgtcgtacgcacaactcaccgtcgccgtcagcttgaacccgatggggtcacgccagtggcgggtgtcgtagttgatccgctcggcgatctcgtagtagtggtcgggttgaccgcggtcaatgaagaagtcaatgccgacgactgtgacgtcatcgccgaatgggtggtagactcccgggcggctgccgccgaggaaggagttgtagaggttgtcggcgacgtcggcggcggatttggaggaaggtagggagtagtcttttccatcgccgccgccgatggagaggaggacgtagacggccttgaaatggcagtgggtgatgtcggcgccgatgtggcggaggtcgtggccggagaggtcgtcccagtagcggccatggccgaagaggctgtagaaggagatgatgacgatgttgtagagtccactgtcgcagactgaacggaggctgccttcgttcttgttgcctccccagaagacgaccacgttccgtctccttccggctggatcgatggcgccggcgaggttggccgtcgccaagaaggagagaagaaggatggcggcgaggatggtaggtggtgatcgccggcgttgttgttcggacgccattgttgtgtaattgtgtgtggagtgctgttgtgttggggggtggagaaattagttgcaggtaagttcgtatatatagagatgcatatccatgtagatgtatgtagggccttgctcaggaatcattaggcgtgtcgttgtagccagcaacttgcaagcttttttggacccatggatatatactgcgtgctgtgcttgcagctgcattcatcaatcctctgtttctgaaggtaccattctaaagccttgttctatggaatatcgatgggttgcacctgcaaaacaagggatgaaacattacaggtcagtctttgccttaattaatcaaccatttctcatgaagagaaatgctctgtttttatgtcctctgtttcgtaccatctgtccgctctgtttttgcatcctcatgttttcccgcgactagtctgctttaatagtcgactagccaatgagtcgtgcgttacgcgaccatcagaaactgtaataatcgtttaatgtaaaatataacatatatacaattttaccaaaaagtacagtaatagttgataaaaaatatttgaatttataatctatgaatgagtatgctgtcaagaatacccatttacataagaatagatataatagatgatcttataacaatcggcaggcatacatagtttcgaagatcaatgagatattgtaatgggtctgttgtgaaaaaaatgttggtaagataaagcgtaacaatatgacagtctcataatataggaatcaccataaataatgtttgtgtttgaatattgtaaagatttttttacaactcagaatattgtaaagttatatagtgatagagtgctcaacattgtagatagatataaagtggtttgacagtgtttataaaacaaaatatgaggatttttatcttcttctgctacttactatcttctcttatatttttacatgtaagagacaggggaccaagagtctagtagactctagaggcctccagatttaagatttgctaggagtcaaccacatagttcacctatcttttttgaccctactaactgactactgcatgcaccaatccaccattcaaacttaatcgaacggcctacaatccactaaggccttataccattatatggcatcgatcaatgatggtcactttctaggccaacttttgcgatgtctctgcatgcggaaaaacggattgacaagtcttagcttatcgtcttatccaggcatccatgcatgcgccatgaagagagagcaataatgctctgttttttacgtcctctgtttcgaacaaacgaagctgttgaaagcagagtactgctctgtttttccgtgacgaatctgttttcccacactgattttaccataccggcagcgcagcacacaggaagaggctagctaacatgcatgcatctcctgccctgttatcaccaaaaaaaaaaaacaaacatactcatgagaattcgcttttgtgatagacaagtacccaaaaggaagatgagtggcctaattccctgccccttgcgcaaacgacaatgcaatatttgcagaatgctatccagctgttgcccttcaagatgtatgaacaacatcctagtacatacatactccctccgtcttaaaaaaaaaaagacaaaccctagatttccgtgacaacgtttgactgtccgtcttatatgaaatttttttataattagtatttttattattgttagatgataaaacatgattaatactttatgcgtgaattatctttttaatttttttataattttttcaaataaaaaggacgatcaaacgttagacacggaaaccagggtttttttagatggagggagtacagcacgacacgattagttagttttggatcgagatcgaccagcaccgatgacgtggtagccgctggtcgagtcaacggtcaaatctcatcaacatatccaacccacatgcatcaaatccatccattaacctatacgcatccaaatcacgcacaccacaatagaccactacctaggtgcctagcagcagctagaccccaagaaaaaagattgctccctctggttttcaatgtttgacactgtttacgatagaatatttgaccattcattttatttaaaaaatttatctaaatattattctgaagtatttattttgttacgagttgatttattacaaaagatattttaagcatgacttatatttataaatatttaaatattttttttaataagacaagtggtcaaacgtgcactacacaatcaacggtgtcaaacattaaaaaccggagagtacattacataatcacaaatctcttcttctctacatttaagcaattctacggtacttgaggagtgtcaaacattaaaaaccggagagagtacattacataatcacaaatctcttcttctctacatttaagcaattctacggtacttgaggagataccatgaggtaccaaaattttagtgtaaaggtaacataagatatcaaatttataatagaaaaaataatactttatagtacctacttaagaaccgtaaaattgctcctctacacataggagtacatcagaaatcacttcaagcaagctcacagccactgtacactgacactgtcgttgcaaaatggctctccctcccttaccctttgcactagcagcagcattgctgctcacaataatctccggccatctcgccgcgccggcgacggcggacggctacgtcggcggcctagcaatctactggggccgtcacgccgacgccgacgaaggcaccctccgccaggcctgcgacaccggccgctacaccaccgtaatcatcacattctacaacgtcttcggctaccaccccggcaactacaacctcgacatctccggccatgacgtcaccgccgtcggcgccgacatcatccactgccagaaatcaagaaacgtcacgatcctcctcgccatcggcggctacggcggcggatactcgctccccacctcccaatccgccgccgatgtcgccgacaacctctggaacgctttcctcgccggccgccgcgccggcgtgtcgcgtccgtttggccacgaggccgccgttgacggcgttgacttcttcatcgaccagggcggcgccgatcactacgacgaactcgctcgccgcctccacggctacggcgccggcgtgatctggacggcgacgacgaggtgctcgtacccggatcatcggctggagaaggcgctggcgacgaaggtgtttgatcggattcatgtgaggatgtacggcgccggcgagatcgagcggcggtgcgtgatatcgtcgaggtattcgtgggagaaatgggcggcggcgtatccgggaagcaaggtgtatatagggttggtggcgtcgccggagcaggacgaggcgtgggtttttcagaaggatctttattatgaatatctgcagtttgttaccaagctgcctaactatggtggtttggctgtctatgataggtactatgataagaaggctaattacactggtgagggttaaatggttaacgatcgatcgtctttgttgatgtactggctgaataattaaagaagatccctcgtgtttgtaatgttgtgatggaagaataatggacgaataaaatgaggtctctaaagaagttatgtatgtaacagatgtcagttcatcatataataagggcctcatcggatgttctaaatggccaaaatacggaaaatgcgttttcataaataaaaaataatttaaatgtaaaacttttgtacatgtgttattcgtgcttcaaaaaacaaatatagaaaaaaccacgatgaagaattttaaaaatcaatcataaaattgagtttgaaaattcaaaatttggcttcggattataatccaatggcgaagcgatgagagcctaagtcgttttaaccaaagtcaatagtggagcgagtaactagcagcactgactgtatgacatttttgctgagcgtgtctatgtttcacttcatagcatctcaatatataaattgttgggacatgaatttcacaaatttgggttttctgccctcattcagtactaggtacagcgaagaatttagccgacaaatacaaggagcacaatgcccaggatgtggatcctctttagtagcaacatactacactgcagtaatatgtggacatcagaatagcccaaaaataacaaataagaaaacaaaaaataaactgcttgctgatgacctgcaacgtctccttgctcagttcctgtcagggagaacttatgatcacattacaggcacaacaaaccaagttcaggtctagatgaaaacaatataactaaagcagtaatgaaatccatacttgtggataaaaaaaaaagttggaagaccacaatgcaagtcaacgggcagatgtttctccgatgtgttcagactcaggcacaccaacagactcagcatcaccaagtgtcccagtggagctgcccctcatagaacgccatgaggtctccagctgcaaactctcccttataccttctgccacctccgtcatctttggccgatcacgccctgcacgcctagtgcagagcgagatcggccaccttccatacagagttgagatcataatctgctcttatcctcgggtcagtgacgccctcgatgtctccttctgcgagcctctcatgcacccacagcaggatgttctttttttccgtgtcgctgatggggatgattgctggctgagctgtgatgagcaccaagagaacgacttcaaagctgtatacatcgctcttttcgcttagatgagaggtttcgtagtacctgaatgctcatgatataaaaggattatcacatcagattcttctccaattgaatgccagcagttatgctaatcttttatgtaaaatgtaataattaggggtccaggacatgcatactcaggatccaagtatccaggagtacccgctgtaaaatcaaatgtgtttttgattattattttgtgatgaacaattggcatcggagattattggtttttgtcacaccctgaaaatcctaaatttataaattgttgtttaaattgaattattagaaatgattttaaaagcctagaagaaaagatctaattttaaataataaattccaatatagaagtgggccagataaaattttattaaatacttcacttgattctatagttcctagatttttctgggatttatttgagccaagaaagtatttttaataaatggaattgcatttcatgaataatttaaaaagaaaaaggttttaaagtcctcttttagctttgggccgaaagtcggcccaaaaccccctctctctctccccggcccaagcgcgcccggcccagccagcccgctgagccgagccgccactctccctcctctctcccgctgacaggtggggcccacctgtcagggtcgtcttcctcctcccgccgcagccgcgccctagccgcgcgcaagccgccgccacctccttccaaattcggccgcgtctttcccgatccgatcaaattgctagaggggaaatgatcctcgggatctcctcttccttttctcttttggaaacttcatctaatttcgtttggaaatcgccggatttgatctcgattcggatttgattttctttcctaaccttaaaccttccatctcgccgccggccgccgtgggcctccatcgctgccccctaccccatatataaggacccccgggacctcctctcttcgtcgccaccctcgccttagccctccaccgccggtagagctctagccgcgtcaagccgtgcgccgccgtcgccgccgcaagtccagtcgtgcgtcgccgccgctccggttgtcgtcgtcgctcgggaaggccgccatcgggttcgccaagtcgtcgctgtcctcgtcccatccttcgtttccgccgaggaccaccggagcatcgccgtcgtcgtcgacccgaacgtctccgccgcttcgacctcaccgccgtcgccgtcttttgccgtccgccgtcgtccgagccttcggtgagttcgccgcgtcgcccactacccgctggtgccctcgtttgcgccgccgcgccgtcgttcgccggcgagcacgaggtgccgagtcgccgccggtgatgacgtcatcgtcgacgtcagcgccatgtcagccgtagaccgcggtagatcagttagatctcggccgttcgtttggattagattagatctcggccgttcgttttgtagaccgtctccgtgcacccggttcaccgtgaacccgagccgatgacgcaataaatcctttttccttttcaaaaataattctttattgcgtcataattcaattaaaatctaaataaatgatttaatccgatttaatctttaaaaattcataactaattcatcttagctcggatttagttggttcaagtctctaaatttttctaaaattgagatctacatgttaaaaatatccacaagtgctgtttatgattttttatgtactgttttggtgatttttgctcttttatgcttacattccgacgttcccggagagtctgagtttgcaggagaagactttgaagagttccaaggtcagcaagtcaagtcacacagatcctaaacaaccctttgagcatgttgattccgtttaaagctattgtttctattcaactattgcatttattttgaatgtcattgggtgggaataacctattgcctttgttatagccctttgttattgcttacctatactttgtcacctggttaataattggattagctagaacattatatggttttagctaaagcaattaggatgcttagccatgcttagagacactagctcatataaatgggataactaatgattcactattactaaatgatggattaatggtagctcatgatggttaatcatgataggatgattaattaatttgccaactaaaacatgataatggtgggttgtgagcacatggttttgatggtcgtgctcatgacaattaaggaccggttcacgattttcggttgtgaaacattaaccgtgccaaccacaagccagcgtgggcaacgggtttaccttttgtatagtgtggttcattgtggagcaccagactgtgaagtggcggagataagcccacgggggtcgctggggagtccatgccttgtttataagggggtgattatgatccaggaacgctgtactgcttttaattgtgttatgcgaatggtattgtcacaatctctattcgggtacttgttaagtattgcgacgcatggttgacatgatgttgaggttgtgtcttgtgggtacagtggtacacctctagctagagtaaaactattcgaatagccgtgcccgcggttatgggcgggtctaacaatgtctttcgtgattagtctcatacctctcaccataataaatgatgctgtaattggtaataacttgttagctcctggtttggaatgatgtattcctggtttggagatagaactgtgcagccgagaatggttattcagaatggttgggcctatacaacgggtatgttgtatatcgttggattaatattgtttaattaaatactttactgttttactaaattctgaagtatttattaaatgccatttatgcaaatgagactatattatgccatcctttgttatcccctgcacttgcatatttgttgcgtggcttgttgagtatgtcatatactcaccttgcaatcattcatcagaggaggagttctacagtgatgctgaaggtgtggaggattaggcgtagcgctggtcaagctgcttgtgggatggagacgcctgcgccgtttatcttattttccgctgcttagatttttattgtttgagaggaactatctacctctgtaatgactttatattcgcttattaattagagtaataattgtactctattatcaatttgttattgtgtgcctcggctgattcctggacgagggtttacacacatgtaagcgtttggaattttggatagaaattccgggcgtgacagttttgttatttggaatttatttacgaagtggttttggagatgattagatttgaaggtgaattgcaggtgctgtgattttatgtggaccggtcagaccgggcatgtgctgccggtcagaccggcgtgtatcacgcagtcagaccggcgtagctcgcggtctgaccggccgactctgtgtcggtttcggtttcgggttgtttatttggattctagatggatactatacgtatgtaatacagttgtttgctactaatgagtcaagttggagatagcttggtctcggaatatggtttctttgtttgttccatgtgtaggtgactcgatgcctcgggagagtatttgcggtgatggaccgggagtcggcttggagataagacgacatccgtggtggtcagagatcatgcgggatacttaggctagagttgatgcacgtggttgatggagattccatatggcatacgatggagttattgtgtgcgtatgggatgcggagtcgaatttggaaggagtctaaatttggtacgattggttatgtaaagtttctttcctgtgctagagggtttcctaaggtgtttaggactcctagtatgaatttggttcgtggctctaggctgcctacctcgggtataaatagagggggagcgtgaggcttcccggtatcgcttttgagagcaattgagttgagttttgagttagggtttcgagtttagtcgaaaattttgtaaggagtgctgtaggtgcactttgtaaacacagagagaagtaataaagtcatcatccactttaagagttattcgatttgtgtttcaccgggtttcagtggtctaaccggcgacacaccggcggtcagaccggcggcatcgtggtggtcagaccggcgggtgacctgcggtcagaccggcggcggcgacaggcgcggcagggatttcagggcggtccaaccgagagatctacaccggtcaaaccggcggctatgctttggtcagaccggctaatctactccggtcagaccgatctcatcgaattcgagggtaacttttatttccgctaaaagttttcggtttttgggtatatcaaccattcatccctctctggttagcttagttcttgctattcgatcctacaagtggtatcagagcgttgttttcttctttggatttttatcgatctagagtttttgccatggctactcccgctcgtttttcaactaagcctaatgttttcgatggaatggatttttctcattggtgtagtaggatgcaatcttacattatggctgaagattatgatatttggagaaaagtttctcatgcttatgtgattcctgaagccattaatactgctgctgaaaaaactgcttttgaacaaaattgcaaagctcgcaatattcttttgagtggtatttctcgtttggattatgatcgtgttgctcatcttctaactgctcatgagatttgggttgctttgagtaattttcatcaaggaacaaataacattaaagagcttcgtcgagatcttttaaaaaaggagtacattaaatttgagatgaaacttggagaagctttggatgactatctttctaggtttaataaaattttgagtgatcttagatctgttgattcttcttataatgctaattatccacaatctgagatttctcatcactttttgaacggtctcaatatgtctatttgggagatgaaagttacatctattcaggagtctgttaatatgtctactttgactttgaactcactttacaccaaattgaaaacacatgagatgaatgttctttctcgaaaagttgattctaagtcgactgctttggtttcttctatttcttcttcggatgttgatgtttcttcatctaagccttctttgcttgctgtttttaatgccacatccgatgatcaactcgaacaaatcgaggaggaggatttggctttggttgctaactgtattgctcgagctatgaataatgccaggaacaggaaaagaggtggtccaaatcgttgctttgaatgtggttcaatttatcatcttcgttcgcattgtcctaagcttgggagaggcaaaagagaagacaaagatggtgagaagttcagcaacaacaagcccaacaacaacaagccgcagggttcatctcaagcgaggaagttcaaggagaatcttaggagggcttttgatcaagtctatgcctcatttgagccatcaagtgatgtagatggtgagagtggagatgatgataagggaaagaacatctccggtgtttgcttcatggtgcgtggtgaatcagacattgagtatgaagatcatgaggtaagtgcttttgaggaagctattaatattttgagtgcaaaaaatatgaagtgtgagaagatgtatagaaaacaggaatttatcattgaatctcttaaatctgaaattgatagattaaaatctcttattcctaatgatgatgattgctcaaattatgaggttttaatgaatgagatttcaaaaattagaaatgttaatgctacacatgatttgaaaaatagatcttctcttgcttgtagtgttcgattaattttttgccaaaattcatagaaaaaataatatatcattgggcattaatttgcagcccaattttacgaaatacacgtgaaatgtgtctctatgacgtgtgggaccagaaaattcaaatatcatacgatgttcaaatatattcaaaattggactcgttttgttgtatgttttgattggaaaataatggttccgacagaattcatatttgatatatgattagagagatataaacatttgaaggagaagatcaactagtgttaaccgtatatccttaattggtttgctgctcctcaccggttggtaattatccttatgaggtgtggcgtccactgtcaattagccaagttaatcctcgtgattatctccagcacacacacgttctttttatctggagcacaaaattctttttatcacgcgcaggtcgttggattaacagacgcgctggcttatccagagaattaacgcgtgatttcgctggcttgcgctggaatctcggaagggattaggcgaggacgccggccgtcgcctctacccttatataaggcgctgtccctcacgacgccgggggagattggagaaaacccccgacgcagaggcggctggcagaggaggagacgtagcagggcaaccctgctgcgtgctctgatctgatcaatcacccatacatccagaagcctatatcaatagatacacaatcacacgccgtcgccggcgtcgggcgctgcacagcacgcaagcctgagccggcgatgaaccttaaaccacacgtacacgcacccacaaatatttgattaggagcttgattccgattaggcaaaaggagattaaattccatcggcggcaattcgcgaggagattaatcattgccggcgacgattgtgccggtgttcgtcatcaagctaatctgcatgtgctgcaggcctgataaaacatcaggggagcaaaaagatcagatgcacgccgtagtgctgcgcagttgcgtggccc

SEQ ID NO: 12812 - DNA, 8547 bp, Oryza sativa
tggaccaacggcccaacctgaacacctgggcttgatggagcacaagtttgagccgggcaattcttccttttgaactccaaataaaataaagcaaagaaaggaaaatttcagcatcctgaatgcgtcgacaccaagtagaataaggctgtgttcggtttcaggggttggaaactaatcctttcagcatgaaaaatggagcgatccattagcacgtgattaattaagtattagttttttttaaaaaaatagattaatttgattttttcaagtaacttttgtatagattttttttttaaaaaacgtaccgtttagcagtttgaaaagcgtgcatgaaaaaaacgagtgaggggggttgggaaaaggggcatccgaacacacccttaaaagtgactcgtaaacaccgcaaatacatgtacttcacaactactcccttcatccaagaatatagggtattatttctaaaatagcacaaattaagaaagagaaaatagtatatctgtgtagcttgaaaaaacatccttgacaaagtagtagtagtaccagtacgttctctgtaatctttttggtttttgacacggatggtgtggagtagtggtactactagacgttctctgtattttttagtttctcacagaaatcgattgatggagggcttgcagtccttgtttgttttgggagaagataaatccactatatttctggatatatcaatggggcaaaatcccctgtacttctagacatagtgagtatttctttcgtccctagttttaacataagaatttatcagaaaaaaaatagtttcagagtggtccactacacctctttgaaaccaatagtactctctcctcatcattttctctccatattactaaaagatataattttttttcaacattttccttaatttgttttgcttagctaaaactatactccctccgtcacaaaataagtacagttttacaccgtttatatccaacgtttgaccgtcattttatttgaaatttttttatacttagtatctttattgttattagataataaaatatgaataatattttatgtgtaactatttttttaaaaaaaatatataatttttttaaataagatgggcggtgaaacattgaacatgaatacttacggctgcacttattttagaacggaggtggtacctatttacggatggagagaataggtatgttgtgatattactaaaggtgcatcctgatgaacaaattactattagccaataatgtggagttcgggttcaatgctttagaggtaattaacatgtcgtcaaaactgtcaaatcatggtaagaaacctcagtcaagtggtcaaagagatgaccctgatgtgatcaatcgatgtggcacttcctctcctctctgccctaaactgaagaactgatgaaaggctggttggttgaatcacctgccaagccattctccaagcaacaaaatgtgcagaaatccactgcagcaaaagcatttgggcactggaaaatcagagtactctgcaaacgctcgtagtacctactcctactgcttataaacagacaaggtttttactctgtttcatgcgggagtatttacctgtcactcctcagtcaccaaagtaaaatgtgccggattgactgcgtcacaagttcagtggagtaaataaaaagtcacagggacgaatcaaccctgcactaaaaaaaagagaggaacatacatgagagtaagagaaagatagtgtactagctaggagtttggttgtaggtgtagcatctcctgatgactcagcagtaacattccttttccattttttttttaaatttgatctctcttctttctttctcaaaagcagctccacacaaaaaggacacattacaagacgagagacttgaaacgtgtctctgacatgcataccccaccaccaaacattctcactctcactctctctcagtaaccagaagaagaagaaagaagcaaagcatacaataggattaggaaaagaggcttacttttactaattactagcgctaattaacaatcttgcagtgatgatcaactagctagtagctcgctaaaaactagtgcaataatgcaaacccaacctctgataatcatgatcttgattgatctcgattaattagctagaggccgtggcggtggtgccggtgatggtggtggtgaccaaggacgaaatgcatcggtgccggagccggagcaggagacggcaccggagcggcaaagatgccggcggcggtggagttgaacggcggcagcatcgaggccggcgccggagcgatggcacccggcggcgagagggcggcggcggcggggtgaggcgggcactggtagcacttggcgaagaggccgaaggtgtcgacctggtggacgaagttggtgatgctcgcccacccgccgaagccgaagccgaccaccagcacccacgccaccacgaacgagtttatcacgtacgcccccgtccatcctccggcgaacctcggcggccgctccaccgcgttctgcaatccaatccaatccaatcagttattaattactatcatctcgtgatagcaggtacaatagctgactataagtcagctataagcatatttcaagaagataaaagagtagaggtaagagtagcgggttacagatttgtaagccagctacagcacagactgtaaaatgcatatgtgtatgacaggtgggaccaaatattgattatgtagtatatgtttataggtaactattgtatgaattggctattaattggctattaagttaactatagataatttagagtcagcagttagctatactattaaactgctctaattataattttcagttagattactgttcaagaatccaacagagagcagtatatatgaatgcagggatcagaaagaaaagattatgcaaaagtctaataatattgcacctttacttaattatatatgtttgagttattatactactgttaccgaattatacgaaacagaacatgcaactgtatgtattgtatgtactgtttcagaatcaaacagaacagtatatggatgcagatcaggaagaaattaaagattatgcaaagataagttaagcttgcattgggatgatgtcacaagtaggtcattaggtgaatgatggtattctactgctactagtatactgtgatgatgctgttgctgaaagctttatttttgttgctttctagacatggtatcatgggtgtcgacctagctctctctctaatgcaaatacaatgcaatattgcaatgcagtctgtctgctcggtgccaatggctcccggacagcagatggtacaaaaacattgcagcaggcaagcatgcagcacagcagcagcagcaagcgtcctgattaatctctacaccactttcagtagctttatggtacatatagcttttcttttatcatatcatatcatatcgccacttgctctggtttctagctcagctcaaaggaattgcatgctgtcgctgctcagatttgtcttgcattcagtctcttcttcaccgagaatgacacacttgcaacactcagcagcagcagaaacaataataatagtgtttaattaccagtgttacgttgagttcattggaatttgccacgtcccagcagcagatcaatcaaatagacgccaactagctagtcttgttaatggctagcgctagctttgattaattaagacaaacaattaattaattaattgatctgttctaattatcagtaagcactagaagaagcaagcaaggtgtgatggggaagcatggtgggctcatgctgtctaggctgcattgcaacaaccagctgttccatcaatcaccaaacatttgcttctgtatctagatagctagcatttggcaactatgtatacataggaacagcactgaaactatatcatctctacctaaagcctcagcaaatatggttgcaatggacccccaatgtaggcactcaaagacaaataaattcaagcatgtatatatgtaaaatgcattttgatgatgagaattagaaagataaagaaaattagtactccttccgtgttaggttataaaatgttttggttttgctcaaagtcaaactgtttcaaatttgactacgtttatagacaaatatagtaatatttataatactaaatatagtttcatcaaatcaataatgaatatattttcataataaatttgtcttgaggttaaaaatattactacttttttctacaaacttagtcaaacttaaaacaatttaagtttgaacaaagttaaaacgtcttataacctgaaacggatggagtaagaagaaaagtaagaaggtacctggcgggattgcggggagcggaaggtgaccatgtaggcgagggaggggatgatgtagacggtgaagctgacgaggagggagccgacggcggagttgatggggccgaagaaggggaagatgatggcgaggaaccagatggggaggacgacggggaggcgggcggcggcgcgcttgcagagggaggggcagccgtggaggccgacgagcttctcccagacgaagtagagcggggtgcaggcgaagccgaaggtgatgaactggtggatgagcatgagcaccaccgcggcgtcgcgccacggcgtccgcggcagcagcgccagcgcgttcgagtgcgtcagcagcgcgtccccgaacgcccagtacgccgccgacgccgacggcagcgtcagcgtcagcacgtacaccgtcgccagcaggtagatcgccttgaacttctgcggccgccacatcgcgtgcattatctccctgcatttgcatttcatcccttaattactttcttaattactactactataagttattttgactttggttaaaatcaatctactcccaagttttatagatataaatgtagtaatatttacaacaccaaatcagttcaatcaaatctataattaaatgtttattttggttaaaaatattatttttttcttacaaatttagtcaaacttaaagcagtttgatttcgaccaaaatcaaaataacttataatctaaaacggagggagtacatgtgtgtgctttcagattcgtgcaagagaaacgacgatgcagggcccagatgttggtgggcattgcgcatgtcatgccacgtgtgaccggacggtttaaaatatggcacctataagagtttataggtgtttgttctaggttcataacatcttttttagttataggtgaccgatcgaagttaaatattggttttctaacctgtaccaaagtgattttcctgtagtagcatgtatacagtgtggtcttgtcttgtcttggtttggtacataaagacacaaactatactccctccgtcccataatattaaggaattttgagtttttgtttgtaacgtttgaccactcgtcttatttaaatttttttaaaattattaattattttatttttgactttctttattatctacaatactttaagcataacttttcgttttttatatttgcaaaaaaaatttaaataagacgagtggtcaaacgttaaaagcaaaaacttaaaatctcttatattgtgggacggagggagtacaaagtagctagagatgatggatgcatgctagctgctatagactgagcttacaccaaagggcccagttagcttgtgttggcatttggcattacattgctataagactagcttgatccattaaacatggcaaaaatgactggttagaccacaaatacatgagtcaccaacgagatgtgatcgatgttcattcttcatttgctagcatatatatcaccctcttaatcaacttagacgaaaccaacagcatattatagccaactgccaaattgatatgagctatatttcgtaaaacaactacagaaatacattccatggctaatattacgagttttttcgacggttgcttagactcgacggtagcactggctcaacagaggggatttgcaattataacactgcaaacattaacttttgttataatgacactggacccatattttatagacacagatggacccatttatcatccactcgaagtgttaaaacagcgaagccctcatgtttacagtcccaatattacaattttctcctccatggacagatgaacgggacacgtgtacttggatgttaggaggaaccacatccacgtctcatcacgtggtaccccgtgtgttcctatatgtgcaagtggtggtccctaagtttaatgggaccacatgtcagtaagtacttcaagccatgcgtgcatggcacgtgaccatgcatgccattatgcctcgcatggtgcgcactcacgctccattagcagtgagccgttacactactgctaagctagcttaattagtggaaagaagtaaactaactaacaataggcaggcagcaagccagctataagtggatacagtactaatcgttcgtactttagagtaattaaactaaactaaacttagtaaaattaagtaggcactaatgaccaatcaaatggttaatcgagccatagctaatcaagagagaggatggtcggcttacacggtgacagcgtggcccccgaaggtgtagaggatgttggtggcccccgtgaagtagagcacgatgcttgtgggcccagagtgcgccacaccctccacctgcattattcccaatatatgcactattacaattactatctatcactattactatcattttgttatcataaataagtgacgtttgggactttgatcttatattaaaaaaagatgagtaattttacagttcttgaagatgtatcgtgaggtactattttttatattataaatttgatacattttggtacctaaatactatgaggtaccaaattttatattaaatttttggtacatcatgatacctcctcaagaactataaaactgctatgaatattatgtaagatatatatgtacctgtccgtggatgagggaggcgacggcgatgtaccaggcggtgtaggtggtcatgaggaggccgaggaaggaccaaatgcggtagttgtggaatgacgggatgaagacggtggtggcgcagcaggcgccgaagatgtacgtccatgtccgcttgtccagatggtcgttgatgtagtagatgttgctggcacacccgatcagttggatcaccgacccgaacagcaaaaacgtgcagttgaaggccagtcccacattcctccagtgcctccccagtagcccatccagcaccttaaaccactggttcaaaaacatgtatcaccatatcacgtactgatttatatatcgttaacgatattagagcaggtataatagtacggctatataaagccagccataaacatactttaagaagataaaaaaaaagagagacatgtatcatcatatcacatattgatttatatatgtgagagatcgattttatagtccttgagaaggtaagtaggtacctggatgacgtggttgcggaagtcgaccttgtcgcgctccttgcgggtgcggtactcgaggtagaggatgctgatgaggtaggcggtccagctgccgaggaggccgtagaagagctggaagaggaggccgctggccatgcccagctgcgcgaacgagtagggcagcgtcagcagcacctgcgccacctggttcgacgcgcagctgaaccacgcgtcgtacgccgaccccccgtgccacagcagccccgacagccgcgtcctcgccgccgtcttctcccccatctccgacgactcctcttccacctctccgccgccgccgtgctgctgctgcagccccagcgcctgcatcgtcgccgcccccggccccttctcgtccgcgtagccgccgccgctgctcccggacgccatgtttgttaattagctctgctgctgatgctagctttgagctgaactactcactgtgtgtgtgtgtgtctcagctgagctagctatgtgtatgagctgctgccagtgtgggtgtgtgtggtgtgttaagctaaggggaggagtgaggtggtatatatggagatggtagaggccggcagggctccagcagctggggcataaagaaatcagtgaccctcttttcctgtcccttttcctaacctttctttgcacctccctccctcttttcgcttcaaaattaaaaacaaaacaaaacaatgcgagagaaagaggagagaagagagcgtatgaagaggcacatgtgtcattttacgtacctctaacgtggtcattgacatgtgggtctagaagtagtgggctcgcatatcagtgaccaagtctcttctgactttaaatcggagattgttaatccgtgtgctactggggcttttctaacgaaatcctggggaaagaagaggcctgcaacctggggcattcatgccagggagagagatagagcctagtgtgagacataaagtagtgtacaaatctaagaaaaaaaaaattcaacttttcagcaaataaaatggtagatggatcgaggtgctactgctgcctgtgtgctggtgctgcgatgcaacacaactggaaggatgaggtgagtgac

SEQ ID NO: 12813 - DNA, 1467 bp, Oryza sativa
ttgaataagacaaacggtcaaacatgtgctaaaaagtcaacggcgtcaaatatttcgaaacggatggagtatatatgtatacgattgagggctggctacaacctaacaattgcagctgacatttaatttgacatgtatccgtccgttcgtctgtatatagtatacgatcgaattgtttagtcgatttgatcacgacgatcgaacaggcgtacagcagcatgcatgcaagatatatagagtatttcttgtgtctttgtcttgttcggattgcactgtatgggttccaatgcttttctagcagtactccctccggtttaattaacgttttagataaggttgaagtcaaacttttataacttagactatcaataactttaaaaatatttagtttaaaggaactagaacaacatatatagatttgtcttttaaaatactataaaaaagtaaacatgcatttatttattatatatattataatagaaaaataaggtcaaagatgtatcttgtagaccgtgtcattgtctaaaacgtcaattaaaatgaaaccggagggagtatatacaaaattaattatactccctccgtttcgaaatgtttgacgccgttgattttttagcacatgtttgaccgtttgtcttattcaaaaaatttaagtaattatattaattattttcctatcatttgattcattgttaaatatatttttatgtaggcatataattttacatattttacaaaagtttttgaataagacgaacggtcaaacatatgctaaaaagtcaatggtatcaaatatttcgaaacgaagggagtatatagcaagatctctatagatatattccttccgttccctatttgacgttgttgacttttttaaatatgtttgaccgtttgtcttatttaaaaatttttgtgaaatatgtaaaactatatgtatacataaaagtatattttatgctgaatcaaatgataggaatagaattaacttagatttttaaaataaaacaaatggtgaaacatgtttcaaaaattaacggcgtcaaatatttagggacggttacgtctctctagctagctcagtagtggcatgcaaaataccataatgtagtgtgcatgcatggcgagagagagagaagctatagctgctggtggtataaattacacggggaatcgtatagtataaaaagaaaatttggcgggggcgcgatacatcccgccatatatacgcgcgcgcgctctcggtggccggccgccggcgtggtctaccacgccgcacgagcgcccggcgaccaccacccacacctctcccgagatagacagagagcttttctcctcgtcttcccttccgactccggcagggcagacgccgcgcctgcaccggcaaggcaaaacccccccccatccctgcatgcaaaccagcataaatatgtgtcatttttctattagtatctgcatcgggggaatatt

SEQ ID NO: 12814 - DNA, 1296 bp, Oryza sativa
tcaaatcctaacttttaactttacatataaactctcaacacgagaatgatgaaattacctggaagttcacgagtcatggagaatactcggcatccttagcctacaaggtgcagttcttggggtcgctaaaaacaaactttgacaccttaatttggaaagcttgggcccacgcaagtataaaaccttcgcatggctaataatctaaaattgggtctggacctcggaccggctggcgatcaggggctggcaaaacaacggcgtttgtcccctttgccggtgcacagatgagacatccctacatctgctggcggattgcagatatacaaggaaaatctgggatgccattgctacttgggttgcctgtgaacccatcatgctgataaactgagcgcaattgaccacaacacatcactggtgggaatcacttgaaacacgtcaagaagcacccaagcatgggactcgattcttaatcctcataatctcttgggaagtttggaaggagcgaaaccaacgaattttccaaaacaaggagctaaccacggtggccctaatcgcgaagataaaggaagaggcgaaatcttgggctatggctggagccaaacacctagcagagattcccgaccgtgatgctgtaaatatttttttccttacctgtaaaaagaaaatttcgaacgaaaggcaaagcttgcctattctttttaaatatactatatccgattttgaaaactttcagcttaaacttgaaaactttcaaattacgacattttcaactcgaatatgaaaatattcaagtcaaatttgaaaactttcaactcaaattacaaaaattttcaactgatatttaaattttaactttcaattcatgatttaaaattttcaactcaaatatttttaattattaaaaatatgtctatcgctaattgccattagcattaagcatgctgggaggcgattaacgttacacgcgtcggagatgccgcgttggcggtgcacaccatcgatcctctcttggcgcaggtgcgcgcgcttcgaaagtgccagcgatgtacaaacccaatgggctcagtgctcaacgagaggcattttagactgggctatagcccatcgaatgaagctagccaaatcctggcccggtaatgcccggcccaacaatccgaaatatccagtgaaaggcaggcacctgctcgccggccgtttgcttaagagtgaaaattaagtctgaacatttctctttaagtgccaagagagccattcaagatcattttgtcatatattatttttttgattggatttgct

SEQ ID NO: 12815 - DNA, 13678 bp, Oryza sativa
ccacacatgaaattggtaggttggaaaacttcaaaagcatgatctgttcatgagcggtattatttttagagagtgaaaggtgcagtggtactattttttagggccgtctctagaaatttggggccctagggtgaaatgcaaatgccctataatttaaaaagttatgtctaatataaataaaacatattttcgctcaattatatagatgtaatatgtgttgtaatgtacaatacaagtaattttattcaaacattgtaatttgatttaatggatcattcaaattataaactacaatcatgaactcatggtaatttgatgcatattatgaatttacaatctatcatatatgtactcaatcactgtctaatcttaccggtccgaggtcaagctgtcaagagtcgagtcgaggatgatgagcggacgaggagggggaaggcaggagccgaggcgaggcagctgttttgccgtcaccgttgccgctcggagcctcggaatcacaagcagcaagttgtgtcgccgcctcgccagtcactgtgcatggaattgggatggacgtctcagcagttgtcacggcgcggaatcagaatcgcagagcagccagctagcagcagggccaagttaggccatcgcacagtccaatagtgccccacccctggcaatctagcatgaccttgctgatcgatctgcctaattgggctattggcagttgcaagctatagctgggcaattggaagtgggcctcatgtttatatgggaaaaaaattggaggccctatgcaatcgcttatttggcacgtacccatcgacatgcctgctatttttagtaacaaggtcgctgattaggacaattcagcgcacaccatttgatatagtctcctcctattagaatgtatgctaataaacagaaggcatcatttactcttctctctctctctcttatctacactagaaaaaatatccgtgcgttgcaacggaaaggttattttaatcatattattattttttagataagttaatcatcttattattatacggtttagttaaggtgaaatttactatgggaattcacttggatttgtttcttttacaaaattatgagctgtaattagaagtttgattatctcaagtaattatcatgtatgtttttttaaagagatttcttatacgactctttttgtattttcaaaagcgaacgaacttaaaaaaacgactcaaacacagatctgtatttccaaaagcgagtgatttaaaaaccgactcaaacacgaatgacgtaccaaaacaccggcaaaaatatctttaatttttgtaaaagtaaagtgcatatgtggtccttaaactcgtaaggttgtgtcatctaggtctccaaagtctcaaaatacagattcaggtcccagaacttgtcaaagtgtatcatttaggtcccaaatcgatatagcccctttaggatcctacgcggcgctgatgtgtcacaccacatgaacgtgacgtgtcattttctcttttttcttcttcttttctttttctttttctttttcctttttgttttcttgtcattcttcggtttttctttcctttcttatgctccggtcgcagagaaaggagaagaaagaaaaaaaaaggagaagaaaaatagaagaacagaagaaaaaggaaaaaggaaaatttttaaatgggttccgtttgtcacgttatgtccgtgtggcatgccacatcagcgccatgtagaaaggggctgtggtgaattgggacttatatgacacactatgacaagttctagaatttggatatacattttaagagtttaaggatctagatgacacaccattattagtttaaggactacctgtgcactttactctttttataatagtagggatatacaattaaaagaatatgtttgatattttttctaaatgataacgtcacgccattgttcatatctaaaataagaagatacaaaatcagaaaagaatacgatcgatcatggcttggatttgttcttgtagtcgtatcgctgcgcaaggtagacgaacacggccacctccagagcggcgagcgcggcgagcaaccagtagaagtagtccaggtgcgcgcggttgaggtcgtcggcgaaccagctctctccgccgccgctcctcgccgccgtcgcccagtcgatcgccgccacgagcgcgccgctggcgtagctcccgacgcccatcacgccctgggacacggcgagccccacgctgtggagctcgccggccacctggtcgtagaagaactcctccagcccgatcacggcgagcacctccgcgacgccgatcagcacgtgctgcggcaccagccaccacacccccatcggcaccgtcgcgcccggccggttgaccaggccggcgtcgcgggccacgcggagccgcctcgcctcgacgagcgccgccacggccatggcgaggcagcccgtcgccatgccggcgccgatgcgctggagcattgtgatgccgccgccgccgccggtgaggcgcctcgcgagcggcaccaccatgcggtcgtacaccggcagcaccgcgatgtaggtgaagctgacgaggcactgcagccccgccgacggcaagacgaggccgccgccgccgccgctgccgacgcgccgatccattgtgctgctctgcttggtgaacagggtggacacctgcgagacgacgacggcgaacactatgctgctcagccagatcggaagaagcttcacaaggaagaatcccctgccgccatcgccatggccatccaccaccaccaccacctcctcttgtggttctagaagctgttcggcggcatcctttcggtttcgggagaagaagaagaagaacctcgccgtccacgcacgacgcgccgcggcggcgccgtcgatggcaggtcgctcggcgcggcggtacgtccccgtgccgagcaagaagacggcgaggtagagcaccatggtggcccagcacgcggcgaacccgacggtccagccgacgttctcgtcgacgtagctgagcaaggtggtggagatgacgtagccccaggatatggagaagtggtaccagttgaagtatgagctccgcgacgcaggccgccgcgcgccgccgccgccgccgccatcgtcgtcaccctctctctcgaactggtcggcgccgaacgcctcggcgcacggcgtgtggaagccctgcgccagagctagcaggtagagcgcggcgtagaagacgacgacgacggcgccgccggcggacgacgacggcggcgacgtggctcgctgcgccgccatggacgacgacgacgccgtgagcatccccaagctgagcaggtagagcgcgctggcgacgatgacggcgcggtaccggccgaggccggaggagtcggcggcgaggccgccggcgagcgtgagcaccagcaccgtcccgccccaggcgttcgccgcggtggccgccgccgccgtggacatggccatcgggccggtgaggtacagcatcaggttgccttgcacgccgaagaacccaatccgctccaagaacccgacgactgcgccatggccatgcatgcacacgtcagcaacaaattaagcctggctgagagagatgatgtcatcactaaagcctgagaagccgccacttaccgacgaggaagaaggcggcgcgccaaccgccgcggcgggcgtcgccgtcgtcggggtcggcggcggcggcgcatggctcgggacgacgtgcaaggaagccgccggactccatggctaatggcgcaacgtgcagctgtgtcaagattatattttatcgtgctagctgtgcactgtgcagcatgggctagtacatttcaaggccagaatatcagtattaggcctggttaacaaaaaaaacattacatccaatctttagatatatacatgaagcattaaatatagataaaaacaaaatctaattaattaattgtacagtttgcatgaaaattgcgagacaaatcttttgagcataattagtccatgattagctataagtgctgcactaaattaggcttaacagattcgtctcgcggttttcagacgagttatgaaattattttttttcattcgtgtattaccttctgacattcggtcaaacgtccgatgtgacactcaaatattttcttttcgcgaactaggccttagcaatgcttctttttccttttttccttttacaatatgtctagatcagaataccaatgatgcctagagccgagtgaataagacataaagaaatagttaatatatgtcactgtatttagctatcagtactgacaagtactaccaccacctaatatctggagtggctgtctttgtactgaaattagttgggcccgccaccaagggtctactccttccgtctcaaaatataagaagttttggttaaatggagtacattttactactataaatctggactgtctgtagggatggcaacggggcagggcggggccgggttgggctggaacggccccgctcccgacccccgacttcaccccctgcccccgcccccggtcccgactggagatgcggggctaaatctagccccgtccccgacccctccgtggccccgcaccctgactggggcccgcattgaataaaatctccatcccatcagcataagaaatacaagacagctatcaattcggcaagaacaaaaatggtacaaaattcacacaccatcaaaaatagcataattgtacataattgactctccgaacggtggccgcgcctgtgcgccgtgcggctcgccggccgccgtgcctgtcccctcgcggctcgccggccacagcgcttcccctcgcggctcgccgaccacagcgcctgtgcgttgcgccgaccgccgcgcggctcgtcggccaccgtgccctgcgcaccgcccgtgcgacgtgcgtcgtcggcactcggtagaccggagggagagcgggagagggtaaccggagaggggagaggaggggaggaaagaggaggggagctggggatgggagaggccgagagggcgaccgccgtgccctggcgacctgcattgtgaagcgccgccgccgtcgcctatgtgtgagacgggaggggagatggggttggggagagactagagagagagctagggttttgtttatatatgtcactattttgttgtattgggttctattgggccttttatgcgctacattttaagagtttaatatacatcccccggggccctgcgggtgaaatgtctctcccgtcccctccccgcccaaatacagggcccggccccaactccccgcaggggacccggccccgcgggggaaattgccatccctaactgtcttactgtctagatacataggactaggatctggacggaccgagtatttgataaggcttcaacttctaaatttttcttcaggatttatgtctagagtgaagttgtggagcataaactcagctccagctctctagttcattttctagagtactccagcctatttcactccctttttgacggagctgaaaccgtttggctgtgcttcattggagctgagaccgtaccctcactttattaaactaggaaatgaattttaaactcccaatgggatattgttaaatattttttttaaatgttagcaggatagacaaatatttgatatattatttcacaaacatacaagttaaatttgacttctacatattacattaaataaataacacattaaagtatagcttagtcaaatttgtcttacagttaaatttaaatttacatatcggtagtgatttatcagatattaatttaaattgttttattattatttggatgatatataaacaatgaatgatgtggtctgaaaagtttagaatcatcccgtataattgacacgtgactgacatatcccatctgttttctgatcatttcatttactgttcactgttcaataattataaccaaaccaaaccgaccatgaatagttgcatagatatagtttaaatcaaaaactcaaccaaaggaccgtaaaaactcacaccatctctccacaaggcaaatttaaaaagttgtgctcccggtgacacgatcgagagggtggtgagcagcggacgatcgattacttctctttcacgtaccagatacttcctccgttttaccatctaaattattcttatattttccatatttatattgatgttaatgaatctagacatccgtatatctgtatagattcattaacatcaatataaatgtcagaaatgctagaataacttacattataaaacggaggaagtaacatgaaaaaaaattctcacaatttattaaatataactggtaaagattgttctataataaacacgctcaatgatttgagatgagctcttcgacctgtatcacaagagatcacgaccagaataagggtgtgtttgaaaaggaggggatcgagaagattggaaagatacgtaaaacgaggtgagccttagcacataattaattaagtattagctattttaaacttcaaaaatggattaatatgattttttaaagcaactttcctacataaattttttgaaaaaaacataccgtttagtagtttaagaagcgtgcacgtgaaaaacgaaacaatctttctctctttctcctgcgctcgaatgcagcctaagagtagtaacacgtggtttcgggaatacatatactattatatcacatcactgctcactctctgtcattactgcttgatgttagaggatacgaacccgcacaaaagatacggggacacgacgaactcaaacctgacatatcctattaataattaattatgaattaatatcgcctgagggcaactcattacccactcgacaaaatcgaaaagcacaaaacgaactgtgaactaatttattaggtaagggctagaccaattatgcaagtcatatcaattccaaccaccgatcgacatgcaacacatcaaaaaataataaaccagtatatatatatatatatatatatacggctctaatgctactaattgccttgactaattaagcacctcacaaaaaaataataataaacagatgcggcttctttgctataatttccgcactaacgatctttgctaatcatacatatttttaaaatatgggtgatatgatcttaaattgtttagttaattacaaatagaataacaacggaaacaaaaaaaatcacatgttgttgccttaagtttatgggtccatggaattttttatttttatacatatatacgaggtttgtatgtatacttaccgagttttttttaacaacgtagtcactcacagcacacgcacactcacccctatgaacgcacgcacgtaaaccctacccctatgagcatctttgaatactgggccggcaaatccttaagattgacgaagttaccaagttaccacaggcgcctcgctgtcgacggataaatcctagaaaattcgctctgtacacatacatataaatcttttttacatttaaagtgtatacatacttatataaagtttatacatatgcaaagatttttataagtgtatatacaaagtttatattgtatattaatgtaaagttcaaatcaccctctacattatgcagtagtacaatttaccctttcgtagcccagtcgtcttcatcggcgtcgtcgcactctagctatgctagtacgtagtaggagcggatctacagttaaagggctctagctatgctagtacgtagtaggggtggatctacagtaaaaagaccggtgttaagtaataccgatgactttatgttagagttcgcagctcggcccaccaaccgtggaccacccagatcacattgggcttgctccaccccagattcaaccggagccacaattttaggtcctggacctacacaacccaacagactagtctcttgggtgaggattgctcccaccttttaagtcatactccccatcatcaattaccgatcactggtggagaaaccatctttggtcggtcggccgaaatccacaatagtctcggttccactaaaaaccggttcaaaagatgatctttagtcccggttcaaaaggttagagctactttttgatctttagtcccggttggtaacatcaaccgggactaaagattatttttagtcccggtttaaaagacggcaggtggtgtcagacccctctttatctttagtcacggttggtgacaccaaccgggaggtgtgtgtaaataaaataacttattaataaaataagataaaataaaataacttataaaacaaaataagttatttaaaataacttatttaaataaaataagttattaacttattttacaccaacctaacaccaatcgacatgcaccgtgcgagatcgagaggaccaaggcgcacgggaggatcagttaataagttctgacatttatctccttctctcctcactcaccccatctcttcctcttcctcctcctcccatctcttcctcttcctctttctcctcccatctcttcctctacctcctctggatccgcctccttccctctcctccccacttctcaacctcctctggatccgccccctcccgtctcttccccacttctcaggcggcggcggccgggcggccgcggaggcggcctcgcgcggccgggaagcgcggaggcgccctcacgcagcggccaggcggcgacggaggtggcctcgcgtgccctcacgcagtggccgggcggcgaggcacagcgcgcggcgggcggtggggtagcgcgcggcgcgcgcggcggggacgcgccggctctcctttctttttttttttataatttgtgattgagagatgtataatttcttttttagaatttgtgattcattgcatggatctgagatgtataatcgatctgtgatgcatttgatttgtgtgtaatttttttaagatttgtgatgtatttgatttgtgtgtaagtaacttaggatttgtatttgtgatgtgaatgatttgtgatgttactttgaatttggagatttggggtttgatttaggtatatgcatgacactcgatttggggatttgttgtttgatctgggtatatacatcccacttgggagaaaataaaaagaaaatagaccaaccgggactgcccctatcctctctttagtcccggttggtagcattaaccgggactaaagatccctctctttatatcgatctttactcctggttatttcacccgggactaaagatagcgatctttagtcccggattcgtagtcccagttttccaccagtggatgtgggactaaacccaacacttttggtaaaacctatagtgaaactctttatccatatgttataacattatgatctaagcataattagcatattaagacatcgatagatatgttatatgacaccaacgaatcgattttctggatccgccactggcacgtagcattgcaacgagctttaccaatgaagaagaagaagatttatgatgatgactagcatgcatgcaagtagttgatttaattagctgctatgtccgtcttgtgcttttttcttcacgacgactgtctctgtccgaatccgtctcgtgcatgctccccgtgtgattgaggcatgcgacgccggagacgccatcgtggccagccgtcgcctggggattacctccttgtcggctatatatcgcgtagtcaccgctgcctcgtcttcccatcctgggttcctgtactggcagctgtggcttgcaaattactccctctgttctaaatattttacaccgttgattttttaacacatagtggatcgttcatcttattcaaaaacttttgtgaaatatgtaaaactatatgtatccatataagtatatttaacaatgaatcaaatgataggaaaagaattaataattacttaaattttttttaataagatgaatggttaaacatatttaaaaaagtcaatggcatcgaatatttagaaacggaggaagtaacggtcagatatctagcctcctctgtcccggcatagagagaggtggcagctacctcgccgccgcaacgggagcactgccttcgttattgctgaagccttggtgaggtggaatcgtcctgctcctctagcttctactcccgcccgcactcgcggccccaattatcgtccgttgaggctgaggataaacacgcatcactgacaattgggcctcaccgattttttatttgtatttactgactagattgcaacttgtacacgtaggtcgaaaaccactctcgaatgagttaggagataattcgtttagagttaagagttcagggtgtgaaatattggtattttaattagtttagggggtaaatcgtacgacataagtttagagaggcaacttgaactttcaccttctttatataatatatgtataaattttatatatacacatctacgtatagggcagaaagatgaccgtgcactcgcttgtggtgccacgcaagggagggggacgataggtgggtcccaacatgtgagtgaggcttgatcgggtttgaagggtagtatcgtactttcataactgtttcactcttaaatttattcggatataataaaataatattacgggtgtctagtaaataattactacttttttgcagtgccctagcacagaaacgtgttcttgcggtgtcccctagatagttacattttttttatatcatgtagcaaattttgcacatattagtttgagctattgacttagaagaaagatttattggttgaaatcgatggttagatttgtttcgtcaaaatttatagtagttttttctagtttattagagggactctcgcccagcatgaccctgtcgacccctgatccagatcaatacacaggacattatacaacaagagatatttgccagtaattagacttgcatacttgaatgttaattattatcacgtactgcattgttaaaatcaacatcaattcagcgcatgcaaagcacattcccaaatgccgtaaacacgcaagaagccatgaacacgcacgcgtggctttgcatccattaatttctccgataaatgaaatgcacgccagtagttgcgagatacagtagctacatcatcaacttatttggtggaaatggagatcgagcagtgaactcgatcgatcgatcagtggctccccgggggacggtagatcggagtcggcgatggcgtgccgtacgccggcgagacagggggccagaaaggcgacggcgatccgtatcccggcgccgtgggaggtgggcatgccgtcgccggcgttccgtattccggcgtggatggtgggcactccggcgccggcgttccgtatgccggcgtggaaggaggatattccggcgccggctggccgcattccggtgccggcgtgggaggaggagggcactccggcgctggctggccgtaacccgggtcggcaggggggcattccggcgccggctggccgtatcccggcggcgtgctgggaggggagcatgagcatcccggcgccggcgtgccgtacaccggcgagggaggcggctggtactccggcatgggcttcctgtggaacatgcgatggcgcctgtggcaggggaagcagatggccaccgacgagcactccggcgaggacgacgtcgacgacgggaggtgcgtcttgccggcgacggcgacgaaggtgcccgtctcgccctccgacgacagcggctcgatcttggatggctcctggccggggcacggcgcgtcggtcgccgcgctgtgcagctgcgcgacgcagtcggcgccgcggaggtcggcggcgagcggcacggcgaacgcgcccgcgccgtcgagctcgccgacggccttgctctcgtactcctcgctgctgccgttcttgcacttgatcgccaccttaagtcctgtcaacaaaatgaacaaaaataaacacaacatttttgtgcatttaatagttgctttgattggtgatcatgcaaatgcacagttagatgacacagtttcttttaatcaaagcgaatcggttacagtgactgatccaagaattttcttgagcctaggtaaagcataatcctatggcctgctagtaagtttttggcccaagcaatatcatctgtgataacaggcccacacatgtcaataggtgtctgttacaacatctgtcgttatggtagaggatgtgcgcacttttagatctaaacataacaatgtttatataatcgactcgatggttattttgtacccaaatatcgcgtatattctacttttaatttatgagaggtgtcaattgtaatctttgtcaaataccactgtcccatcatcaagagtgtactccgtatatactccctccgtttcgaaatgtttgacgccgttgactttttatcacatgtttgactattcgtcttattcaaaaaattaagtaattattaattcttttcctatcatttgattctcatataattttacatatctcacaaaagtttttgaataagacgaacggttaaacatgtgctaaaaagtcaacggtgtacatgtgctaaaaagtcaacggtgtcaaacatttcgaaacggagcgagtagttgcttgcattcgtacttacccttgaaagcggtctcggcgtccatgttcttcctgccgcagccggcgcacttggccgcgccgacgacgaccgacgccgtcgccgtcgtctcaccggcggccgccgccgccatcagtatcatcagcgccgcgccatggaggagcagccagcttgctcccatggcgaagctacagttgtgtgtggctctcaatagtagttgcactgtttgcaggtgaagagcaagggcgtccaatgaactgcttatataggcgatcattgcatatataattgcattactggatgttaataattcagcactgattatttattttatctatttatttacagctcgatcgatatgatgatccatggagttaagatgtgccacgaaaagagttaatgtcaaacgtacgtatagcgtaggagtgctacagtaagctacattttgtttagttaatttaccagcgaattaaatctcactggcagtgatgaaatggtagatagtatagagtatagagtataaatatacgtatgcatactagtagtatgtactttggctatgtataattaaatgccggctcaattcaatatgttgtcgccgttgtcatgatctcttatatcgtgagctacgcttctatgtaataagtagaactctagttctagtttgtgttcatctcagtttcgggggaaaatccagcagtacccactatacatataaaaatctcatcgggagaaattcaaattgttaaaaaatatttcccgaaattgaagcagttcaaaagagctttaatagttccaagaaattttagttgtcactacattgttgattataagctgtaacggtttaccaacaaacaaaaataatttataaataaaacttatatatatatatatatatatatatatatatagatatacattcttagctgtttaaatacaaatgttgtaaaataaactaccgttaacccaaaaatctgtcccaaaattaaattttgaagtttaaattttggtttataagctaaaggatgaacaataggagtgcttatttttttttccttggaccagaaaaatctcaagagggcccgagatagcaagatcctgcagagaatcttgcatgaccacacataggagagtagaggatgtagttatgt

SEQ ID NO: 12816 - DNA, 483 bp, Oryza sativa
gcatgtcatgagcattaagaactcgagaaataggcacttatcaatgtctgcactgctagcatgaggatcatcctccatatccctgtatgcccagtcaagtatattccttgtagcatcatcaaaattgaaggaatcatctctgcagcttctcagcccacacaagagcccgctttccaaaaccattcttgcagaaatgagaaaacaaaatgttaattgtgacagtgttgggttgaaaagccaacttaatcagtctgccagtcagaatcatggcccgatctagaacatcgctgcagatcccatccatcaatgtgttgtatgtaacagaattaggagcacaatccgttgcagctaattcatccagtaacatcattgctcgattcagcagatggttgctacacaagctgtgcatccaaatattatatgtgaaaatatcaggttcacagccatctgcaagcatcttattcatgaaaatcatggcaccat

SEQ ID NO: 12817 - DNA, 4534 bp, Oryza sativa
catttgattcaagtagcaggaagttatagaaaagctagattcagtcatggtatgccacatcaccgttagtaagtttgtaacaattattttgtacgtgtagccttttcctttgctgaattacttcaaactatttaagaaggtttacagtttacaccagttgggatagtatttcatggacaggtttcacctttagattataaacagtggttacctttgttctgttgtggttgaaattttacctgccaaacactttgtgagcatcagaacaaaaatttatatctcgatttgctcatatgattctgtacatgttcacaatgtttctgaatatttatccggtgcaatagatgaatttattcatgtacggtactcaataatatctggataccacactgttgaatacttgaatggcctaggaatttgaactggtaagatcaaattatggcaaatgctctgatgcactatggttatcatagatggattatcgttagtcatcttgcttcatcaggcaaaagcatccatagtctgagttgtttctgaaattttttttgaagggtgtgtagttgatttcccacttctgttcttgtatgattattataccatttctgatctggctcaaaactatcgaaatttcctctgttctgtttgtcttgtggttgaaattttagctattcatgactcgtgagtagcagagaaaaaaaaatacttcaacttactcatataattctgtacatgttcccaatgtttgtgagtacttatttgaatataatagttgaatttagtaatagacagaacttggtaatgtttggataccacaatttgttgaatgacctagctttttaaactgctaataggaccagtaaattgtggcgaatgatctagaagttcatttcttcttttgcttctgcaagtattttttttatacatgttttcttagatggcttcccccatatatgttccatatttggcacagtgtttcatagatttctagttatgattttaacttaatattggagtcaatcatctgctttattgtatgtatctgatggttagtttgtttctttatgctttgaatgcaaagtgcttcaagatcgtaagatgggtatgcactgatcttaggtttagaatttctacttgtggcataacaatatttgattgctgcatcctgatagttcctgtgattggctttgctcaaaccactgatcttatgtttaacattgttgtatgagtgcctttggtactattcatatctgtgctcagtattgatgttctcctcgatgtcacttcttttgcatatgactttcacaaacagtggaaagcctaaggactatgatgtctgtgaaggaaccaacggatggccatgcggtagatccggaaaaatcctctgaatcaagtgtaggagtttgttcaaaggagctatctgacagttccagtatttcctgttgtagagagaaccaacgggacttaaactgcaaagaagtcctacacgaatcatcaatcaatagctcccctaaccccaccgtttctctcatttttttggattatttttgggctccttgtttaatttacacgttgtcttttactgttttgggctcctcatgcagattagcttgacgctttgccttgttgtgtccggtaccatcaaccgggtgttggatgtttatgccgagcatgtatgctctatgcgttttttcaaaaaaagaaaaactctcaggaaacaacgaagtagtcctccttattctaatttttacgaaaaaggacttacctttatatgaaatacaatgtaatcccaaaaagtacgagggcattctcaaaaaaacagatcctaatccaatccctcctcttactctgctgccaacccatccccaacacgcaacatctctctgcccaatccgccatccccatccatcaggctaatccatgcggcctcctcccggccgggggcaaggacggcgccggcgtttacaaagacgacggagcaaggggacgacatgcctcctgtgctgacctcctctaccgtgatggcctcctcgaccttgtggttgcgtccacggggggagggaggaggcggcacccgcccgagctgccgccggtgctcccctcctccttctccatccacttgtggtgacggcggcggtggcggcggggggagggcagatccggcgcccgacgccggcggatccgccgtcgtgccccctcccttcccttgtggcggcagtggcgaaggtacctacgttggcggcagagccggccgcgcgtctgccgccgatgcccttccctcatggcggcgtcggaccggccgccggcgcaggactgccatacgtcttcccccgtcgccgcgttgcctctccgtcctctcctccgcagcttcccaactgttcccctctcaactctcgacctctcctctctacgcggaacaccatgaccgtcgccgccgaggtcgacgcatcccctgacggagaggagaggaggaggcaagcttgcaatcgcacaaccatctatcgatttctcccttccttctctttcttctttctttctttctttcgtttccccctctcacatgtcaggttattttttctcctcatcctctccggatgatttcacttttgctcgaaatctctcatgttgttgtgttgaaggcggcgaagggggaaactttggtggtggtggtggccggagaggaggatggcggcagcggcagtgacggcggcgggtacgacaaggccgggatggactccggcaagtacgtgcagtacacgccggatcaggtggaggcgctggagcgggtgtacgccgagtgccccaagcccagcttctgtcgccgccagcagtcgccaacatcgagcccaagcagaagatcaaggtctggttcccaaaacagaaggtgagcaaaagcatgcagggatatactatcaaactggtttgccttctgtgtgtctggctgtgaaatgttctggacaaattggttgacaatggagcaatagcaatagtagtgttcaattgtttgccttggttgtgcatactctgcttcaactatatttaggaattgcaagtctatgtatttatttgttttgcttcctttcttgcataatggaacaacctttatataatcaaggaagtatactgtacttatcagagtatgtgccagattaagccatccattaattagatgctgaagtaaactatatgactatattgcgatgtattctaattccactacttacaaaactgtagggtataagatttgcttatttttagaagataggctaaacgaggatcctttaggtgatatggccaaactaagacacatatacataacgtattatcatgcatctgatagtaatgcaaaacaatgcagtcctatttactttcactgcaggtatttaggctcatcttttatttttctcaagaggcacttaacatgatatacaaaatttgaagagttacattctttaaaaaacttctatgagttctgcctaaatgattgttatccatagtgtgcctaaataattgttcgatctagaggtgatccaaagattcgtctatattagacgtaacaataatgcagtgttttttttgtttattttttagcctacaaatgtttgacaagaagaggatgaaagagtgacataggcgagctctgtagcatatatagaatgtttgctatccactggtacatctttaacccgagcctacctactgtatagatgtgtttagtacgtgcttactatgcttaattttggggataatatagtgcgacgtgtaagaaaattcagaactatgttgtatgctctagctgaatttgtttacttcctacaaaaaaaatggatgaactactgatccagttcatgttgtgatcctcctccaaggagtttgttttgtttctttgctatctgaaagattccttttttttttttttgctttgttgaagtggaaggagctcattggtgtacctttgttgaaatggctccttttaatcctcattgtttcacatgtctgtttcattttcgtttttaaggggctggccttattaaaggttgtttaaaagcttaaacaagacttctgtttgattgatctttagtccctattttacctaccaggtgaattgtcgcctcgggtaagatattgctaacagggaattaactctatttcattgccttgtaattaacttgttatactaaatcagaagattctccggaggaggggatcaggggagaagaaaccaaagaaatggcagcaaccctcttttttccggaggcgatacattgatactacttcgatagtagtagcggtagtagtcgtcgtctatatggatatagaacgctacagagttcactactgctttagctattgatactacttcaatagtagtagcagtagtaatattttggaactaaacacggtcatatatatatatatatataagcaactgcaacgaggctatagggtcgtaaacaattcactgacacgtaccgggcctctccatgtttcatgagacacacgtcatacgtgcagtatgaattatcacggtaacagt

SEQ ID NO: 12818 - DNA, 1264 bp, Oryza sativa
aatgcctctctctctaacctaatgatgctctctttgctgcagctgctggcttgggcaaagcttgctcgctttgctacctgctgcatgccctgcctccttgctctccgatcacccaaccgctccatgcacaaacctgcaaaacacctctctctctagatgtgtccctgtgtactggaccagccatgttgcttgcaagcaatgctgctgctgacaaattgggatcacaaggaaaagaattagtatattctagctagctagctgctgcatcagatattcagagatggtgagtgaatggtatcaatgccctttcagtgtcttgcatggtgtgctgcctgcagaaaaggatagcttgttgctagcagggcacacaattgtaaaggtatgcaacaacaaggtgctgcacatcatgccatttccctggcatgtggatgctgctaattgcctgacaagaattgggccaaacagcttttagctttcaagggagagagatcggtcgatcgatgagcgtgtcaacaaacgcactcgatcgatcatcagatggtccaattgacagatatatgttcaggcaacggtggacatgctgtgtgtgtcgatcgatcgtacgtccttcagatcgaaatgcatgaataattccttattcctgtcctaatttcagatgagagatgctgcaggtaacgttaactatgcaagctactagctacctgcaaatctgcaacttgctgccttcagaaaagttcagcgaataagccactacaaagttcagagatcaagcagctgacggtgtgagcacaatgcctgacgtaggatcaagctggctacgcatgtctagctcattgcttgatactactcaaaattaaactagctctacacatcagattctgagcagttacaaaaaagttcaaatctgaattattacttcaagaactatagctagtatgttgaactatatatactgttggtggcaagcatcatcaggtcgatcttgatgaggattttgcacccaaaagacaggtaggaaagaacaatgagagcaggcatgatgctacttaagccccccatatctcctgagagtcatgtgaaatcagaccaagatctcccaaaggtataaagtacaaacatacacacgctctctctatatactatatagtatatttatgtctgcagttagctcttcatgcatgtgaatgtgcaatacttgattcctctctggcgtgtactatatagcctattatacttgacaaaccctgacaaattaaacaaatac

SEQ ID NO: 12819 - DNA, 4517 bp, Oryza sativa
tagaaacatacggtggtggcgtagtctgcagtctgcaggcgcaaaatacctgctttgtcttgagtgcaagctagcatgcatgctggcatgtagaaatggagagaaaaaatgtgtagtgcccatgatatcttaggtgcttttgctcacttgtcaaccatgtccaaggtcacactggctattactccctccgttccaaaatataagtgattttggatggatgggacatttcctaatactacaaatctggatagcgatctctatccagattcatagtactaggtctcatccgttcaaaatcccttatattttaggacggggggagtctcatccgttcaaaatcccatatattttgggacggagggagtactatatagacgtcgtcgtacgtactctcatatatgtgcatatatggtttttaataatcttgaatatatactgagttagtcaatttatttaatctcatactaggcatttgttagatatatattatttttctccaaggcttcaaaatcttgggatccaataatcacgcaaagtataaaattcaattgaatatggccagtgtgagaaattcaaattataattaatttgaagttgtaactataacttgaagaaattcaattcatgttaatatattacctccgtacataaatataaatataaagatatttggctataaacctatttgtagacagaggtcgtggtcgtatactgtagaacttctgaccagttcaaaaactaatatagatagtgttacccaagataatgagatctgttgagatattgccgagaaaaatgatttataggaatcacatgactggaaaggttgaaaaaatggaacttggatataacatggaaaacccttgcaggagaaaatagacgtactaaggcctaatcactactttgagaaagtagacattataagtaaaggtgggtacttctatgatgcattgtctacttaattcatttctccctttcaacttgggcgtgttgactttcaatttgatgtttttttttctttcaacttctcgctaatccattttagacttaactggttgtaaactaggacaacttagggtgagctcggctgcaagggctgcagcgctgctgcaacctgtacgaacagtgaagcaagaaaaaaaaaggcagctgctggctgcagccagctgctacacctgcttgccgtacaggcccttatacaatagcataggaactaactaaatagcataggaactaactaaacataaatattttcaacgaattagttcaactcatgtaaaaatatgtaaactaaaagtatattttagttctcgtatacattgaaatggtatgccatatataatcctcatcaaggtctcaaaacccatctagatacaatataatggagaggaatagataaaaaaaaaacttagctagtgaaatctatatatcagtgtgatataggtgtacatgtacatgttttttattactttaatatacattaaatgttagtatcggtagtgatggtggttctatctgcagtcagccactacaactgtcatgtggggccccaaacaaaatttgttggtggatcatatttgtcaagctaaccactggaaaatatatagcatgaatgattttataaaatgtatgtcaagctaacatataatgttcgactgatttaagtagtattatctgataattagataatagaaaatagtctaatatcgaaaccatcacacgaggtcttttttaaaaggaaaaagtacgaattaccccttcaaactatcgcggtcgtctgaattaccccctgaatcacaaaaccggacattcttcacccccaactatgcaaaccgaatgaattacccccctcgacccaatccacggtggttttggtctacgtggcagtccagttaggaattctatttataaaatagttgtgggacccacctgccatacttctattctcactcttcctctctctctctcacgggtggcaggcgagggacagagcagcggcggcagcgcgagacgcggagacggcggcggcaggcgggggacagggcggcggcgggttgccgggagagatggagctgtgcctccaccggtggacggctgcatggaaggcggccaccgccgtttctccctttcccctctccttttcctgcaatatagcagcggaggtggtctgggcggagaaggccgtggcagggagggccaccacctttgcgcgagcgctctctgctgctaggagcagtggtcgtcgctgcagggaggaagaatggacgagaaggcagctcagtcgtgtcgtcagccgtttgctcccccttctcttccgctaggtccgccttctcctccgccaccggccgccaggtctgccttcgcctctgccactagccgcctgggcgcctagtccgcctctacgtccacccatcaccgcctcgagatcccccttcgcctcacctcagcggatgggtggatgggccaccatgctgccgccgcgtgacgacaccacacgccgccacccggagtacgagctggtgccgaacgccggcagggacatggtcacaggtctcccccacgacgcactcgtccaccgtcccttagcctctgcgctcgccgccacactcgtccaccgtccctcagccaccgcgccgccgccgccgcctcgcctcctcagccaccgcttgcatagttgacagtgagagaagagagagaggaagaatgagagaagagagagaggaagagtgagaggagtatgacaggtgggtcccacaactattttataaatagtattgctgactggactaccacatagaccaaaaccaccgcagattgggtcgaggggggtaattcgtccggtttgcatagttgggggtgaagaatatccggttttatggttcaggaggtaattcggacgaccgcgatagttcggacgggggagggaggggggtaatccgtactttttcctttttaaaattccgttgtaacgcacggtgcaaaggagaaggccggcacgaacatgtagccatgattggtgattctgatgagtcatgagcgaggagtccccgtcatgtgtagtctcactacatcttgactggtcagtggtcactacataaccttaacaaatgccttgtccttacttaggggtacctaataggccatgcgtgcctcttcaataagatgcaggttttctaaccttgttggctgtgcttttgatgtttctatatccttaattctctgtagcacataggatcggtattgttgttgtagtagctagctggcatgatcatatatctgtaggctccaaattatgcatccaacagtgaacaatgaaaacttatcccagaaattatggtttgctactcctgataatggtgtgatcatgccgtcaacatgtaatctgattcgtatacataaatgttgtacactctagctaggcagctgctagaaatgttgttcctccgcttccaatgcaaaacatggaatcagatagaatttgaatttggaccggaatgtgatatttaatttccttcttatatatcttaatctagtgatatgaaaacagggttttgtgtggactgaaatctccaaaatcagtaagatttggagaatttcagtaccctgacagagtgcattctcaataacaccaactactcccttcattccataataaaatcatttccagatacattttattctgtaactgaaggagattgaattttgccttttttttccactgaaatttctcgaaattcttcacatacctgtatgaaaaattaagacatctatatatattacagggaaaacataagatctatttagtaggagcaaaaataaaaagaaatcccttggaattcccaagatctattatatgtcactggtggacaaaccctttttaatcccggttcacaacccccctatagtcccggttatgcaaccgggactacgaatccgggactaaaaatacctatttttagtcccggttgaaataaccgggactaaaaaaggatctttagtcccggttggagttaccaaccgggactaaagatttagtcccggttggagttccgaaccgggactaatgctcttttttctttttttttttggtttcctgctgcttgcatgatttcgagccccacgaatctccacaaatctttcgaacaccacgtatcattcaaaaaatccctaaatacatcaagctgcattttctatccccaaatacatcacaaatcattcacaaaatcacaaaatcatctccacaaattcattcacacatcacatatcacacagatcagaaaaagaaatccacatcgcacagatcggccgcacagatcagaaaaagaaaccacatcacacagatcgaccgcacacatcacatagatcaggaaaaaaccacatcgcagagatcgggcgccggccgtccgccgcctcgccggcctcccgcccggctgcctcgggctccgccgccgcctagggagcgtcgccgcccgctgccagccgcctatgcggccggtgcccgcctgctgccgcctcgg

SEQ ID NO: 12820 - DNA, 5924 bp, Oryza sativa
ccagcttacaggagaagccagcttacggcgtaagccggcttacgacacaagccagaaggtccaaggcttacgacgtaagcctccaccctcctccgcctataaatagggcccagaaggtccaaggcgaggacaaccgatcttcggtctcctgcttctcctcttgtagcttgtactcaaatccagaagaaataaagcttccactcactcatactttctgtgttccacaactctgtgtttggtttgcttgtgtgctgataagtagaatcgactggtttctcaacatgtcatcagcacgagactcttccgagctaaaaaggtaaacaggtgagaaatcagtttctactgatcatcttgctctttatatgcaaatcattcttctactatagttgaaataagcagaagaacatggtacctgaagtaccatcctccgatatcctctcagcaatacacgataacatgatggcggctctcccgccgttatcgtccaattgctagagttgatacatcctctcagcaacgctcggtaacatgatggcggctctgccgccgttaccgtccaaaggcttgagatggtacataatcttagcactattcgataacacaatggcggctctgccgccgttatcgcccaaattctagaggtgatgtaggtgcctgaagcaccggcatggcaacttaatggacggctctgccgccgttgccgccaaatatcggaggcaaacgaaccttctgcacaaccctgaagtgtcgttatggatgccctttgttttatggacaccacccatatgggcccttgatgccactaaggtcggctctatcgccatgaagcgtgggctcatagtggggaaagtactatatggtttatcttactttttacagtctgcacaatatacatgaagtgcccatgtatgctcttcattttgttttacatgcttactttgctgtttgcatgactttcataacattttttttgttatgaaattgattttctagcatgattgataatatttaatcaagcaatctgtaatcctgaagattacttaagttaatttgctaggaaagattctatgggaaactgtgtgataatcctgaagattacacacgatagtaatcctgaagattacgcatgaccaatttatgtcgaccccgcacatcgtatttacctgtcgtaaatactaatgatgttgcagaacatgtcggacatagcaaagaaggaattcaccgagcttgccttggatggtagtaactacctcacttgggcattggacgttgagattaaactcgactccatgggtctcgatcatactattgtgttgcccgaagttggcactgtggagtctacgaaggccgagaaagcaaaggcattgcatttcttgcgccaccatctccacccaaatctgaagtctgagtatatgaccgagaaagatccactggtattatggcaatccctgaaggatcgctttgaccagcaagggtcaattgtgctcccacaggcacaacatgactggatcaccctacgcttccaagactacaagtctgtggtgacgtataactctgccctccataggatcatttctcagttgcgtttatgtggcctgaagatcactgacgctgagatgatcgagaaaaccttatctacctttcatcccaacaacatagtgctgcaacagcaatacaggaactcaaagtacccgaagtactctgatcttatctcagtcctgttagttgcagaaaggcagaattaggttcttctaaagaatcattctgcccgacccactgggtctattgtaacgccccgattttcgttcgggaataaaaatcaattaataatacattttctagaaattaaataaaagttaaatcaatttaatcaagtgaaataatgggagaatttgaaattttcctttaaaaatcattggccgggaatattttgtaatattctttgtgccctaatgtactctccggaattttccgtgaattttcggagctcgagaaatagttttaatagcacaaagatcattgcatcaattaaaataaaaagaaaaaaaaataaaatcctccctcctctctttgggcccctttcggcccaattccccccctctctccctctcgggccggccttctccctcagcccgctcgcctctctctctctccctcaagtctgttttgcctccccagccggcctctccctccctccctctccgacagatgggacccgtggaccccacctgtcatccccaacctcaggccggcagctgccgttgctgccatggccgcccgagccgccccacgacgcggccgtttccgcccacctcctccaccccgcgcgcgcgcgctcgtccgtgggacctcgccgcccacgtccgcgccgtttccccccacctctcccctccaaaaccgccacccacaccccacgatgccgcccacgccaccggcggttgccgccccgactccgcctctcccgggctcgatcccgcctcccctcccctataaaaacaatcccccggccatcctctcccttttccccaactttcccgcactccccgcgctctctcccgctctccccacacgagcccaagcgccgccgatcgccggcgaccctccagccggccgctgccgccactgtcgacgtccccgcgccgcgccgcttgcaccaccggcttcgccgtgccttgccgcacctcggccccactccgttttcccatttcatcgccggaaccacctccccaccgcgctccctctctccaccactcaccgacgagctccggccgccgctcctcgccgctccagccactgccaagccgcgccctaccaccgtcggcttcgctgcatcgcgtggtaccccggccgctcttccaccttcgttggagaccgccgaatcaccgccgtcgtcttcgccccgtggagtgctgccgcctccctctgctcgagcctcatcagccgcctccttcgccgccatgcccctcggtgagctccgccgcctcccttttcgcctcctccgctcgttttcgccgctccccggccgccccctcgctcgtcgggccgacgccgccatcaccgttgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccggtggccgtccggccgcgcgccgccgtctggtcgggttggtcggcgagccaacccacccctccgccttgcacctctaccgtggactcggtccacggtgggctagatccttttgcccgctgacgcgtggggcccgctcatttggtggacccggtccaagcccgcacctccttgacccgctgacgtgttgggcccacctgtcggcgtcggcgccccttgctgacgtcagcgaatgccatttcctttgagaaaatatttaataattgcgcaataaatcgtgtttaattctagaaattcatttaaatggcccaaaacttctaaaattcatatctaattcattcgaactacgaattgagccattcaacttgcaaaattcatctaaaattgagctctacatgttggtttactttttatgtactgttttcttggtttttattagagtttttcctcgttttgcatgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtcttgtgggtacagttgtacacctctgatcagagtaaaactattcgaatagctgtgcccgcggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacaattttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgccgcttttgtttcggtgtgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacatctatggcagtgcctgaagcacacgccaatgttgttggaaactcacatggccgtaaaagaggccatggtgaaaagaaagggaaaggtaagggaagtatcatattcaagggcaagagcaagggtaaacccagaggtaaaggcaaactcaagaaggttacaggtgaatcatctggggtaaagcaggataactgctatagatgtggaggcagagggcattggtcctgtaactgccatgtccccaagcacctggttgagctctaccaacaaagcatgaatgagaaaaagagccaacatgagtcccacttcaccattgagcctgaagctcagattgaaaagcatgatgacatgcttatcaatgttaaggatggtggggacgtccgtatggacgatgattgggacaaccttcttgaaaaagatgatgacatatttggagatctgaagtaatctcctatatgtcagtcatatgcagtgttccgcatgagtagcacatgtagaactttggtcatgaataatgctcctgaagagcacgcttagtcttttattgggcctgaagtccttgtaatgtttcccttaatagaatcaacttacttcatgtttaatttcatttctgtttatgttccataaacatacttgggtgggaatcccatggcagaagaggatatatgtctagtagacagtgccaccactaacacaatcttaagggaaactagatatttccacaccttaactaagaaaactggaaatattatgaccattgccggaagcaatgctcatatagtaggcaccggaagtgctactctagttctcccta

SEQ ID NO: 12821 - DNA, 1700 bp, Oryza sativa
ttcatattgatgttgatgaatttagatagatatatatgtgtagattcattaatatcaatatggatacgggaaatgctagaatgatttgcgttgtgaaacggagggagtatttcgtattgtggattgagatattttagaatgcagggagtacaatcttgcgacgaccgaatgtgtgccagcttgttaataattgcgtgattaaactagtaaacatataatccggtcaggggtcgcgcatctgctagcttgtctgtgcatgatgcttaattgccgtttgctttagttcgatcgtctccacatcgtgctgagagagaattatatcaatccaaagaaaattaagagattgtttaattatatgcatgttgttgtttgttgttgggtgttgttttgctgtcttaatctgattgcacgtgaaagcccaaacggtcggtttaggtggatattccattcccttacttttatattattccaagtcgtaattatttatagggttcgatccggcttttcttctttgttgtttcatgttactcgcttaaaaaagacatccgtgccataagtaagctttaagatacaacatgactataaatagtggatcgagtggacgagggagatgtcggcccttgacaaccaactttttctagctagctaccttttttagtaacttaatattttattttaaaaaaatggtaaaagtttaacctcgtatatattgatagagattaacttccgaggcatcaagacaacacctatgttggtatttgatacggtcacagataaattcgcaagcataagaatattgttgtagcatttcaccttagagtattataggtttatttaatcacaaggaatgtgtgtgtatattatttaagaacataatccaatcaagaacaacatctaatgctaaacttatgttagataggattcttatggtttaattaattagacttaagttaaaggtaaaaccttatcgattacttcgggcaccgattctcctctggtctacgaagctgagacggccctgtagctctatggtgtacccggacgtggaaagatacaaaaggcgcatatggctgtcaccgtctgctgtctacctcaatttccgtggagcacacaacaaatgaagataaccgctaacctagacatcacgtctaagttattgattactactctagcttcgcgcaggaacttccttctttatccagagtcctagtactggagtacttaatataaatactaagcgatgaactcgcaacggtgagaatatatctcactcaagtaagtaatttaaataccaaaaggaaatctcaaacacttactttattaaagaagcattcgctgagctacaagagaggaagagagtaccgatagcttcggaattcctccaggccttcccctcactctctacctattttctccacactactaagggatgcctaaagtatgagaagtgacttgtactccactttgttgtgtattgtgaaatggcttgagctcctccttttttgggccatataacggttggaattacggttgtggaggtcggtgcatccacaaccatcattgggaggtgatcttgcccgttcacgtggaaggtggagatgaggtggggctatggtggttcggccaaacccctggttcagcagacctgtgggccccaactctctccaccaccttcttcaggagctaacatgtgggcctct

SEQ ID NO: 12822 - DNA, 10574 bp, Oryza sativa
cgagacctaatatgcttttgcagttaatctattagctagatatagtgcaaccccaaccagaagacattgggttggtgtcaaaactatcctcaagtaccttcgaggtactcaagatcttgggttatggttcccaaagaaccaagatccatccatggtgggatatgtggatgctggctatatgtcgaatcctcgtaatgccagatctcagactaggttgatttctttgtggtaatactgccatttcctggcggtttgtaaagcagaccctggttgcaacgtcaaccaaccactcagaaataattgctctatatgaggccacacgagaatatgtggggcttatgcggatgatcggtcacatccagaagtcatgtggcctaaacattgataacacccccaccatcatctatgaggataatgctacttgtgttgcacaaatacatatgggctatgtgaaaagcaatttcacaaagcatattactctcaaattcttttatccccatgagctccagaagagcggggaaataaatgtcctgcaaactaagtcatgcgaaaatctcgcagatttatttacaaagtctctgccagcatcaagttttcatagatgtgttcgtggcatcggcatgagacgacttagtgaattgcaagaatcagggggagcaaacaattaagagaatagcccatgattatgatcctgaagaatcacaaacaagtcctgaagacttgatcaactgttgtactctttttcccttggtgagttttttttccattgggtttttctcacgcaaggtttttaacgaggcaacaggtgcaacacaatattcaaagtgccatgtactcttttctcctaccattttttcccactaggtttttgggatgagtttttatgaggcatgcgcataattcaaattcgtccaagggggagtgttatgaaacctatcttattgtggacgaattaaattataagtgggaagcttactacagaagaaagcttacgctagaagccagcttaaagaggaagccagcttacggcacaagtcagcttacagaggaagccagcttacaggagaagccagcttacggcgtaagccggcttacgacgcaagccagaaggtccaaggcttacgacgtaagcctccaccctcctccgcctataaatagggcccagaaggtccaaggcgaggacaatcgatcttcggtctcctgcttctcctcttgtagcttgtactcaaatccagaagaaataaagcttccactcgctcatactttctgtgttccacaactctgtgtttggtttgcttgtgtgctgatcagtagaatcgacaggtttctcaacaattttaaccattctgtggtcacaactgaaagattatcagcagatatacatttgctattctgacgccccatatatatataatcaaggaacacatgcgtaaaaagaaaatccaattttattgcaggctaaatgttcaattcagccacaacatgcacatgcagagggacagccagtagttgcacttgagcattagataacaaaggagtccagttacattcctccaaatgcaattgaaataagttcactttgggtccctgcctagtccgattttcatcccctcgtcacaaaaccggatacgatgggtcccccaacttacgaaaccgtttaaatgaggtccctcggcggtatttagtccagttttagctgaggtggtacctacgtggcttcttttgactaggtctttatccaaagtgtcgttgatggggtgtttatgtggcaattagattcgaaaaaataataaaacacgtgggacccacatgtcagtttcacacacaaataacaaaaaaaattgtgggcccatgtggatccacacgtcatgctcactacctcttctctctatcccctctctctctatcctctctctctccctcttttctctctccagccggcgaagcagggagggcggctcttgccgacaccgaagtccctgatgagcaggatcttgaagctgcacccgtcctcaccaccgccgctgctccccgcccccggtggcgcggcccacaacgccggccgttggtcgaaaattccccattccaaaatcccaatcgcgtcgaattgagtgaagccatgaacagtgtgggtgcagcgtccaggctaggtggcgagcctctgcagactgcaggccggcgcggcggtgcttgcccgctcctagtgccgcggtgccacctggcctgcacggctgtgcgcctgcgtgtagcagcccagctctaagccgagcaggcagcaacaccaacaagtcagcaagggcaaggcagcaaagcaactagcccgattcagcacaaatggatagaaaggggaaaggaaaggctttggcatcataaaaatgtaacatttgttgagtatttgacaaatgacaagtgaaaacattgcaatttgcaaaagtataatgaacaatttgtcattgattcacatgtctgtaattttccgtaattttgtttgtagatttgaagagctatttcaccaggtagtccagtagttgccgagcagtatgctttcattccacagcgcggcggggggagaagtcgcacgacctcgacggcaccgtcgtcggcgggcccaacggcaacaacgtgttcaccgaccaccggggcgcgtacctacagacggaggcctgcacgtacaacacggcggccatggttggcgtcttctctaagctcatggaggtcgaagccgagcgcggcgcctctgcccgctccgcttacgtcgccggcgacgcgcaggccaacctcaagaccctggtcgatggcctcgtcgccaacggcaacaccaacatcaaggtggacgccggcacgcacccgcagacggccacaggccacgggcggctcctctgctcccaacggtcggcgccccgcgcccctccggccaccgccgcgctgcgacttctcccccgtcggccggccgctccgcccacgacgcgccgcttcacccctcgtctccgcccctctctgcctctgcccctctgctctgccgtcgcccactccgcccgccgcccactccactccgtcggttggagagagagatggatagagaggatagagagagagggggatagagatatggtggtgaggatgacgtgtgggtccacatgggcccacccattttttattatttgtgtgcgaaactgatacgtgggtcccacgtgttttattattttttcatctaattgccacataagcgccacgtcaacgacacgttggacgaaaacctggtcaaaaggagccacgtaggcaccacctcagccaaaaccgaagacagtaccgccgaaggaccttatttaaacggttttgttaagttgggggacccatcgtacccggttttgcgaccggggacgaaaatcggactaggtgataaatagagggacccaaagtgaacttataccaatgcaatttcatatcaaacagtcacggatgggctttaggaaagcagaactgggcccggcccagtagatcacatagcccaacaagatctaaaccgcatgctctcgtttcaacaaattatcacaccgattgcatttgcatctgctgcacaggctaaatcaaacacgtagccatgaaccattcacctcacaagtcacaagcattgcatttctatggttaccagtgcaggacgaaatgctcaactagcccaagcaagaatggagcatgacaacctcaggcaccaaaagctctataaatatttgcattgcacaaatcaaaagtttccaagttttaatcagagaagttcaagatatcagaaagaacaacacataccaggatgtctcagctcaagtcttctagcctggctgcactgctgatcttcctcctggcagtgttcaccactgcagcagcagcggcaggtacagaatgccagaacgatgtcgaggtgctgaagacaacctgctacaagttcgttgagaaggacgggccgaagctgcagccatcacctgactgctgcacctccatgaagggcgtcaacgtgccctgcgtctgcacctacctgggcagcccaggcgtcagggacaacatcaacatggataaggtgttctatgtcaccaagcagtgtggcatcgccatccccgggaactgcggaggtgagcaggcttcacttgattggccacactgatcacctgggtaagaactgacaataacacgccggctcctctggattgcgacttccagtggggcccaggtgtcggtgtcagctgggtaagttggtgtcatctggtatgggaaactttgatgttttgtacatgtggtggtgctcttgtcaacattatatagataaggagagaataggacaaacatgacgcttgaatagcagaagagaagttctatccagcaatatcaaaagtacagctgtcattttcaaaaaatgtaaaacaaaaataaaacgaaaaacccactatactagtgccaataaaagaagaaacaaaagagaactacattattgtcaatgccatttgttgatgttattattacttttgtttataagaataacaattgtacttataaggcctacgatttattacaggatccaaggtctaaaacaagaactgattgacttggtgaagttggctgacaaaagcaaggcacctagcagttgcacggctgatataggtaaataatgttggtcaacttttagagtacacggattgtacgtcaaccttcagcatgttgtgataacaaaatatgtatcaatgatggttgtctatatacactgaaaatgcaagagtatttttaaatcacatgttgtattgagtattgacccagctatcaactgtttgttgatgtgccctgttccttagtctgataaatgctaatatagcacattgctaaaagcataaataaatatctagacatattggacagggtgaacgatgaagaaatgtccaaactccaaatatgagtaggataagtttgaaaaataacaaagtagcaatatataaaaacaatctagggatgctctgcaacattaaaatcaatcacatattcagcaatctgcatctgccaatacaaaacaatcaaaattaattttcatacgcaatatgtagggcaccatgatatgcaagatccttcttaaaacaattttcttggagttcccatgcttctaaaaattgtagatgagcagttgacttatatgctagtgttttgattttgagtaaatttcccagaactacaggtattttgaccaaactatcgcgaaactatagatttaaggtgttctgtcacaaaactacatatttagcacaaaatttatcacaaaactacagatttaaggttaacatcacaaaactgaatatttaatattgaagttatcacaaaactacagcttttagagtttaaatccctagaaccgttgttatgttggagctatacacattattattttgttcctaaattggttctaagcctatagttttatgataatttagttactaaacatgtagttttgtgacacttcattttaaatgtgtagttttgtgataaatttggtattaaatgtgtagttttcttttgtttttgaagctgaataatgtgaaattgcttaaaagttataaatagcctggtcaggaaccaaagcttcagaatcccactcttgcaatccaactagacagaagtaacaagaaaaacaatcagctaaatttttggccaactttacaggtacacatataatctgtttaaaatgcctcttgaattacaattcaataatcccaaccaattttactgacagattgattgctagagatttgtacaacctacggagaacaaaactccgatagaacaatcatgaacaacagaaaaaaaaaatctactctaattacacattgcagcaaagaaattactaacccatgtctgctggtcttgctgccaaaatcacctggaggctctggactggaagagttccagccttcccttggcatctggaagtagtgcatcgacacgcatgtcctgtatcatgtgagcctgttttgatgcccagagaagcacagcaagcacaccagcttgagccagctcctcactttctggcacgtgcaatgcaatgaaacagagcagtatcagtgcctctatctgcacctcatcaccgagatacaccagctggacaaggtggcgagcaccaccgctgtccacgatggccttgcagtggtttacatgcaggtggttttcattgcatgcgaacttggtgagcgcaagcacggcctccttaatgactggtggctcacgctcatcgagcagctccacaaggggagcgatgacgcggttctcactcgctgtgaaagtgcgtgcaaggcagccaagagcagtaatgcaagggagcaagagatcatcgtagtctcccttgctgacaatgtgaagcagctggtcgacgacagccttggctgctggagagctaggcttgaaagccgactgtcgcagggcaaggctgtgctcagcgacacgggaaatttccatgattgccattgctgagaagtactgtacgctagtacccatgccaccatcacccttctcaagaagcaccgcgaagcagagcagtgcacgcgaatcagtaatgctcttgcagacacctagatgaccgcgggcaagcttccacagagctctcgctgccatggcctttagccgtgccttggtctccggatcctccacctcccggacagcaccacggccactagaaccactcgtgcccagctgtggcctgaagggtggaaccaacgacccattcgtcttagtcttagcagccatcgcggattgcacgaccgactgcatctgattccttttcgtgtcttgctcattggacacccttgggggctcatcggtggaggaggaggtgccacggtcaccaccgtggcgcatgctgagcgtcttggcaagcacgacagagtgcagcgacgtcatgtgctgaggtgcagcagcgctgttcttggagctgctggagccgacggagtacctgctgtgctcctggatggtccctgaggcgaggtgaccgacgagatagcggacggcgttgttctgcgcaaagagctcctggcacgtagcgctccggtcagcgagagtaccaatggcatcggcaacggcagcctgcacgcgcatgggtggatccttgagcgccgcggcgaagacggagcacaccccggcctggacgagcttatcgatgctctcgtcgtcgcagccgagcaagccgagcgcgcgggcggcggcctcctggccgtcgtcggtgccttccttgagcagcctaagcagcggcggcacgccgtcctcctcgatgatgagcttggcgaagtgctggctgtcgcgggcgagggaggcgaggttggcggcggagtcggcgcgcgcggcgagcccgccggtgtggaggcgcgcgacgtggtcccagatgaggaacagtatgggctcgttctgcgcgatgttggggagccccctcaggtcgccgtcgtcgccgtccccgtcgtcgtcgccgccgccaccaccaccaccaccaccaccaccggagcgaggcgaggagatgcgcagcagccacgcgacgtcctcgagcgcggtgtcgaggagggcgacggtgcgggggaaccccgcggcggggctgagcgtgaagagccgcctgaggcgcgggtggccgctggcgcagcgcgcggcgagggaggaggccttgaggagcgcctgctgcgccccggccatgatgcgcgcggcggggcggtcgtacaggtcggcgcgcgccgcctgtcggagcaacgccgcgagcttgtccgcccgcgccttgagctcgccgcactccgcgcggaagcaccgcgccgcgccgcactgcttggcgacctcgtcggccagctggatcggccgcgccagcatcgccttcaccccctcccccatcccaaaagaaaaaccaaacgattctccgcctgctccgcctccgggaaccagaattccttcgagaatcgcgtctccgcggggctgaatcggcgggcggcgagggatttgggggggaattccgaattcggggtgggggatttggggtttttggtttgcttggtggagttgcgagttggtggagaggtgggtcgtcgagtcgagtcgagtggagaagagagaggggagaggggaggtggggcccacgggcggtgaccgtgtcgtcggccgcgtgtgtttgctgttcttgttttcgccgtggtttctctggagattcccggaagatagggtgggcgttatcctggccgtccgattcgggccggttgcaaagtaccccttctttggagtatgatccttctttttttttatttctttattattatattgttttcttcggcgagggggattacgaccgttgactcgttgaccatgaatatgagctagtacttttttatttttttaatatttctggtgacagttgtttgttttttttttctttttgggtttggattgtagttatccagggggaatgtacaactgtatttggtcctgttctggaaactgataaattctagtaacaaggaataactggggtgtggccaatgagattttggaaattatgggtttccatggttatggctttttagtgtgatacaaccatatattctcataatttgagtaaaaatcttaaacatcgtttaaggagctaaagattttgaaaaaaaacagtagatagtaaaaactccttccaaacatagcctttatagtacgatatgtatcaaatatagcggtcttaaaacgagttacaccacgagataactaaaaggggacacatttatccatgctaaggaatttcatggctttggagaaaaaaattatcggttgcaagagccaggggctttctgttttggcaaaaattttctttcgcggttttggattgatgcataatatatagagcctatagttcctcatggtggggagcacaaagttgtcccctagtaggagcataagagcatcaaccggatatctccctaaaaatggccaaacatgcatgtcactatattacatttgactagctctatatggtcttatggcacaaggaatatgcccattatttttaccttattctgaataggagatgattctttttttaccatatatttgatcaatatatattataggtcccgtttgagatggatgatggttatgatgaagtaagtgcacacgaaaaaaattagcttatgattaattaagttttaattagtataaacttgaaaaatggatttacttgtcgaagtaatttttctatataggaagtttagttgtttagcaccatttagctgttttaaaaacgtgctaacgaaaattgatgtagaatctgaatctcataataaatgaacggagcctcagaattgatagaatcaacaaaatgaactggccaaatctatattttttaaatgtgaccaattcttaatagtctgatctagtttgatccgatttgtcagctgccatgtcctgttctcatctactactactgatgttatcatctcaactaaagaggagttgaacaaacaaatttttagttctgaaaagaaactattttcgatgcatcattaagcttggagaaaccactaatccaattaattaacttgcacgtttcttatatgtcaataaataacaccccgcatgcatttgatcttccatccaagatcgagaggctcacgtacacaatctgacagaggccatatcgcaatcatttataactaatgattccctagtctttatcaatgtatagttatgtcagaagagagacgtgagtcacacaaacacgccaatcccacccatgctgcatgcataccaggtgctgaactctacgcttctcacgttttaacgcgggaattactaattcttaatatattttcttaacatattaataaatatattaaatattataaaaataatatattgatttgttaaaatattgtgcaaatggtgtgaggggtgatgatgggatatgcttgcatgttgatttgtagaattaaataaattgtagataatgttgtatgcttgcatgaggttaactatgtaactattaccagctagtagttgatgatgtgataagattgtatgtcgagttttaggcttagtagattataactttatataaagtatagattatttttctgttattttcagggcaatcgatcatatcataccttggaaattaataccatcaatatatacttactgttatcataataaattatcataataaatgattaaattgccgttgcaacgcatagagtttcactcagtatatagtactagtacattgcacgtggtgactaaaaaaagaatctgccagtaccaatttgccaacacacaaagtagaagtgaagcctagcattaagccaataacaaattggttaaacacagcaaaaaatccgctttactttggagagccagctggaaaaagtgataataatctccgagggccagctggtgtggaaaaaaaggagggaaaaattcccaggccaccaattcttgtcctcagctttatgcgcctcgcacttgcagaataatagaaacgaataccacaggaataatggactagtggtcacctgagcgttaatatcgtcattctgtcactg

SEQ ID NO: 12823 - DNA, 428 bp, Oryza sativa
acgagcccattcgtccccgccctgcccgtctccgggagaagaggagaggcgacggaggagggcggggatcctagacgcgatggcggcggcggcggcggccggcggcgcggcggggaggcggccgtggaggagggttttgcggagggcgagcattttgcttggctccgtgtgcttctgactgggctgctgcgcttgcgtggtctcaaatcaatggaggtaggaagccgacactagcgggccttgggccgaacaagctagaaggcccatttacatttttattcggccaatcgaaaaaaaatcagtcaatttctcacccgttggatagagatccaacgcatgtgcacttttcacgggggagggtcgagcactcgagccctagcgccgcctcgccgtcaccagcaccatcgccgctgagctcccacgccggc

SEQ ID NO: 12824 - DNA, 3746 bp, Oryza sativa
tttcatacatgaatacatgctattaactagcacttctttctcactaaattattatttttttcaatgctctatccttaagatctttaattttattgggtgcatgcattatactccctccgtattttaatgtatgacgtcgttgaatttttgaccaacgtttgaccattcgttttattcaaaatttatgtgaaaatatgaaaatatttatgtcatgcttaaagaacatttgatgatgaatcaagtcacaataaaataaataataattacgtaatttttttaataagacgaatggtcaaacgttggacgaaaagtcaacggcgtcatatattaaaatatggaggtagcatatttattagggtgatccaaactatgaggtgataataactactctctctgtcccagaatatagggatttttagggccggatacgggtattaagaaagtaggcagaattaaatgggagaaggttgtgattggttgagaagtggaggtaggtgagaaaattgaatggtgaagggttgtgattgattgagaagagaacgttggtgaagaagttattatgttttggggcaaaacttgaatgctagaagtcgttatattttgggatagaaggagtatttcttggcctttatgggttaagtgtggttgcgccttatattttggaatgtagggagtaccataaagtaagacatcatttattacttattcacagctttaatagtacattgtggatatccttagagcgggtacaataagctgactaggcgggctccaaaattatgcactacagcatattcctacgtggagggaagagaactgatgggagagaaggaaatggatgacaaatttgtcgccgggcgatatctctcttctcaacgtgactgcagtccaactcgactattaaaaacacgcttggtaggtcccacacaccacaaccaatccccttccccaccgagcgagatcgatctctctttccccctccaccccagccgagcccgctcgatctccgcccgcccctcccgtgcgatcttgtgcgctcgactcccacgcgtgatttccgcctctccctcgcgcgcacaatctacctcctctctacttactacttcatccacgagcgtgaaaataaatttacatcttcctattttgccggccccaaaaatccggtggattgacgatgccgcctccactatccgccttccctcttctacctcgcttaatcgctcaccgaaaaccctagttctttaccaccaaggcactaacaaccttgtctcgccagaggaagagagaggttgcgccacctccatgtaccatcgcgagcttttcttaaactcccggtgtttcaaaaattgtgatatatgtgcccatatgcaataagtaccttgttttttttaggatatcaatggtatttgagttatgatgtaatagtgccttgtaatttttgtactacagagaatttggtcctggcagaaatggttacaagagtgcaatttactcttgatcatacacacggatatgtacatgttataattaattatttgattataagatataataagtaaataaacaatctattatattagtagtgggctttaacaatgagctattagtgagcaactggctatactattagctttgctagcctatagcccaacaaagcagtttccacgtaagcacatagtgacacgtcatagccacggcagcgacctcgctggctgaactcaactacttgaaaaataccgagctggttcaggttccctccacaactgctccccccctccacctcctcctccgccgccgccgcctccgccgccgccgccgccgcttccgccgccgccgcgccgcccgatgcgcctcctcgccgcggcggcgagagcacaccgttcgtcacaccgccatttcctcctctcctccagcttccacctctcctccgccgccacctccactaccacctcctccacctcctcctacgatcccatcaagcaattcctcctcctcctcccctccaacacccactcccaccaccaccacctctccctgccggcctccctccgccgcgacgccgtcctcgcgctcgcccgcctcatcaaggtctcccctccatgcctcctcgcgctccacgcgctcacctcccccacgtcgtcgtcgtcgtcgccgtcaccgctcccggcccgcttcgccgccgcgctgcgcctcgcctcgtcggcccaggcgctccccaccttcgcgtcgctcctcctcgcggctctgctgccggatgcgacccctgatctgctagcgttctgcgaggggttccgtgggcgtagcgggaggtacgccgcgcgccgcctcgccctccatgccttcctcgccgctggcatggctgacgaggcgctcgacgtgctcgcgcgcgtccgccgcgccggggacacgcccagcctgtctgcattggcggcgctgctgcgcctgctcttccgtggcggggaggtccgggctgcctggaaggtgttcgaggaaatggctgcgaggggaccgaggcctaaccttgccatattcaacgccatgatctttgggttgtgccacaggggtcttgtacgtgtcagcggtggcctgctcggcgtaatggggaggttccacgtcgtcccggatgcgtgcagctataacatcctgatgaaggggcactgcttgtatgggcaggcagaggatgccttcaatctgtttgacgagatgcgtgtgacaggttgttgtcctactatcgtcacgtataacatattgatgaatgagctttgccgtgagggcaggatggtggaggcaaggatgctgtttgatgagatgttgcaggctggagttgaagtgaatacaatcacgttcaatgttttgattgatggttatgcaaaggctggacagatggagaacgctaacatggcctgcgcagagatgaaggccatgggattaatgcctgactgctgcaccttcaacattctttcggctggagcatacaagtttgggaaggctgcgttgtttgtacttgatcagcagcagttgcatgaaatgtttggttcacagttgtcaacagatgggatagatatgttgatctgtagactttgttgggatgggcgattggatgatgcctgggagctcctgtgtagcgctattgagaagggtgttcaagtgagcgtttcaggatttaatgcgctgattgctgcatatagcaaggagggatttgatgaagaagcttttgagctatataaaactatgaacaaattaggtcttgcaccatcatcatcaactttgaattacttgataatgggactgtgtaatcgtgggagacttgatcaggcacggctgttcttagaatatatggttagaatgggatattgtgtgattgcatcttttaccatctacttggactcatccttcagagctggtgatgtattaggtgccttgaagtgttgggatgatatgaaaatagttggtttacagcctgattttgttgccttctcggcatatgtcaatggtctttgcagactagattttctagatgaggcttacaatggttttatcgagatgataagaagagggcttgttccaaataattttacttacaactccctcatatctgcattttgtagggctgggaatgtgtctgaagcattgaaattagagcagaagatgaggcagagtggccttgttcctgatatttttacgaggaacattttaattgatggcttttgcagagaagggggattgaacacagctaataacctttt

SEQ ID NO: 12825 - DNA, 5888 bp, Oryza sativa
tcttcccaactaacattgcactgtggcgggataaacggtgtcaagtaacacagtactactacagcacagtcatgcattagaagatgcatacataaaatgtcttgaccaatatatccactttgaatggaccgtttcaggagattactcttaatatgctgatttttagagagaactaacttgcaaatatacataccaattaaaaaatttaacaacatattgtgtgccatgttcatgtaggtataaatcttaaagtaagtggacatgagaaaactatagaaaagaaacttcgcatatagcagatttcttgatgttttgatggggattgcttgactttccatatataggaaaggataaactataaatgatacagtagttcaccaaagtagttgttgttctaacggtgtcttacaagtaagacccatgtgctgatagtttgttcagcacaattataggagtaattccactatttcacaatatatgtttttttctcgaaaacgcaagagaattgagtttcatttcattaaggggaagaaaataaaagaaaaatacaaagtagaagagaccaatgccctcctaccgcaaaaaacacacccacaccccggtcaaccccggctatctagctgcctaggtttgccgaaccactaaaaaacttttggcggggcagatgctcccactagacaccaaagattaccctcattccctaccacctgcaagactgtcgcaggtggaaaaattttcaatagctacatcttgatctcctcaatggagaaataccttcttaagcaatgcacaaatattgtaggtggcttctacctgcaagattaccctcattccctaccacctgccttccaccgtccttaatcaaagtttttgaaagttaggtggccgtattatgaatttattagggagcagccatggtttcttactctcttaccaactttttcttagattttgtgcttctagctggcttgtgcgaactgtgggcattacaaatattttgaaacagaaggaacaattggattggtacttatactagtaaccacctttatgctggttggacattgaaagtgttccaaaaactctccaaaaaagtggatattggagcatttgctgaacacatgtacgcccgcaaaattatggggacaaatgctgtcaaaccaggaaaagttacttatgaagtttactctttttttttgtcataaataatatccacgatgatcatgaaaatttgaaaccaaacagggcaaatatgccccacaagtgatttttcccatattttcagtatattattcacaacccaactacaataatatatacaattactcctaaaagtgagaaatctacaggtgcattattgaacttctttttttacaaaaaagaagtgcatatttctctgaaagtttgggaaggtcctaaaaaaaggcataaattgcaccctcaatttatcaatttcatatttacgctgatttcatttttatgtaaaacatttattgatgttaaccttgtaccattatcttggcctaagaattctaatcgcacaaaaaattaactttcctgtagtctgctttaaatatcctatggtgccaaagttctcaaggtgcagtacttagagaaaacataattctttatttactacttaacatgcaaacttatactcaggtggttcactactgaaattaagaaaagagcatgtgttcaaatcaatataaaaaaattataaaacaattgttaacaaatggttcagcatttctactcttcaattctataagcatcacaatgcagtatcagtataagctatatcaaatttctaagagaaatgagacaccgatacttccatccctgtaaaaatgcaacagtagatttaataattggacctattacctgtctgagcacttattaaggttgtcaagtgacaaattttctaaagcagagcaagatgaaccaatagcttctaaagcttcatcgccgacaccaagccataccatctttaaggatttcaaatattggcatccttttgcaacagagatcattcctttgttttcattaacatgcttggactccacggataggacttccaagttatggcagtaggtaccaattgcatacagggatctgtatgttatgcaaccattgcagaaagaaatatcaagagagaccaatgatttactacgtatctttacaaattcaaccagtccttcgtccgtcaactcttgaacaccacacagctttaattcactaagattgcatccctctgccagagtaatcaacccatggttttgaacatagccaccctgtaagaaatgttgtcaataaaaaatgaaactcaggggaatacaacactaaatatcagcatgaaatgaaacctcaatgcgaagtttacaacgtgaactgctgacttggacaatgataaacctcaaaaaggagaccattaccacaacggaactcactattgctacaatatgatcctcaagtttcattcgacaaaatagttaaaataaaagaggcatctatgatcaccattcaccataaggaagcattaacttcttcatagttccaaagatttgcccgcattggaaatgaaagcagatcatgctacgtgtgaaacaatattgaatgcacgaaagaaaacagaacaagtacaactaacaagaaattaccgaaagcgctaacgattgcagattccggcaacgatttgcaattcccaccagccccttttcagaaatgtgcaaaaaccagtttagagtcagcttttcaagccctttgcaaccctcaatgagatgaagtagcccagcatcagtaaatgaggttgggttgacaccatcactgccattttctttttgcgtatcttcgcttagtgtggaacactgcatatgttgctcatctaacttggggttttcgttatcccaaccctgtgcctgtgacaaaaatagtgcattagtgacttgcaaaattgatagacaaaccacatcaagaaaatagtttccagagatctaaattatatgcagctctggcaaaatgctaatttctcagggagaccaagaaaacaaaatcttaaccacggatttagttgttgaaccaataaaacatcggatcattcattcaattccacaggggaacacaagagatgcgagaatttcgcgcgattcccgaactgcagccagagaaggactcaccctgctccgctccgcggcggcggcggaggcgccggcggcaatgtagaggccgtggtcgaggaagacatcggcgaggcccgggaaccggtcggcgacgcagcggacgacggcgtcgccgtcgggcccgtcgacggggaccctggcggcgcggcgggacgcgcgctcgacgccgcgccagcggcggcacacgagcgcgcagctgtcaaggtcggccttgccccccgcggcggcgacgcggcggaacacctccgcgagcaggtcgtccgggagggcggcgttgacgaggccggaagcggaggccatcgcccgaggcggcggcggcggctatcaccggaggtagggttccatggaatccctaagattggaatgaaatggaattgaagcggaaggaagaggggggttttagagcccaagcctttgcaactgccgttacaactttgggttaattagacacatgccattactaatttgaaggtttagaaaaatatcattactatttgacaaattgtaaagatgccattacaaatcccacgatactggaaacatgccacgttctacgcctgatccgcgattgtactcgtttttatgcgtaccgtatttacgtatggaccataatgcccttgtgtatgagtatgtagggaccgagtggaatcagtttgaccaagtgcattcacagtgaaccgtaaacctaacactaggcttctccggcggcggcgggatttggaggcggcgtcggcggcgtcagcgatggcatcgggctttggcggcagtgtcggcggcagcggcgggctttggcggcaatggcggggagaggcagcccgattcgttcgacgggctcgagcggttgtagctttcagcgcacacgggccgcagcgtcgtcggcaccatggttgagatgtgcttgcggcaaagccgctgcagtgaacaaatccaacacctcgaggaatctagggcggcggtggattcagtgtgggaaagaggtaaaccccattgtttttcattttcttttgttgaaattcctttcttttttgtttcgttttcttgattgatgccattgatttgagatgtgttgtgcagccaaagtgttgctcgttgtgaatatgggaggatctgttgaacgaatatgtggaggaaatggttgcttattcccatgctggtgaggacgatggtcaaagagacatgttgcgacagcttgcagaagagcataaggaagagaggtcgaggatgcagggtttggttgaggcaaaccataggcagatgcaatccatatatcagcagctgaatgattctaagaaaaagtgtgagcagctaaagaagatgttgaaagaagagaagtgtagtcgtagtagacaactttatgtgatgttgttcttgttggccataattatgtatttctatgtatgttctgtaaattttgtggccatatttggtacaagtaggtaaatcagtgccattttgtgtaatgttaatcactgtctataaattatgtggattcaatttctgagtaatgacataggtgtgttaattatatggatttaatttcccactctgggtgctctgttaaggataagtctggcagctcaaggtacaagctgatattgtgtgtttgcagcaagagctaactgctgactcctgcactaaaactatgctaatatatgttcacttggtgtaaaaaaaaaaggaaggtataggacattgaaatatcttttggtgtgaagtatataaagaactgaaagttctgtgtttttatttcctctttgaaaagactgcccatcattgagacaaatgaaaaagaagtacaggaaaatgagttcacaggaaatttgtgcattcagatggtattagttgagatgatcagcaacaaatatttcacatggtataagttgagatgatcagcaacaaatatttcacatggcatgtgttcaaatgatcagcaatatttcacaatatggactgcatgttcacaggtttggactaatttcagcatactgcatgttcacatgttgcacacagtgcatatcacagtgccaggcaacataggcctcaaaatacaggttcaagacagtggcaggtaacatgaaggcctcaaaatacaatatagagtgcatatcactacagcaagtcaggaaggcctcaaaatacaatatatagtgcatatcacagtggcatgttagcaaggcctcaaaacacacaaacttcaggattgtaaatattgtgacaggcttctaacaactttagctgggccttctgaggcagctcgagcatccttcttcttctggggtgtcttctttttcttgggcgtcttctttttcttgggtgtcttcttcttcttagcaggccttgatgaactttcatcttgagttttcttcctgcaaacagtgatatggatatgttagttagcaaatgcaacatatgtaaaagaattcaaaataaatagtcaaccatgcagcatattacctcttcttggggaaagcagtaggcacttcatcagtgtcttctggtgcttcagcctctttgcaagtcttggcaaagtgcccaaaaccatggcatctcctgcatcgcacccttcttgcccctggttcaagtgcacccctgatcctagtgactctaggcctccctgcacccctcttgagtctaggtggacagactttgaagcctaaattcaccacaggccattgtgatttgtctggcatagttggcactctccctgcataa

SEQ ID NO: 12826 - DNA, 538 bp, Oryza sativa
acttcgccggcacctgcacgacgactacaccaagccgtgctcctaccactcgacgctcgtcgtcccaaatcaccgccgccaagaggtcccaatccgatctccttttgccttggtgatttgttcgattgcaaagcaatcccatggaactcctttgctgacttcatgaggccaattgcatccgatttcttcaaatcagagtccgcatcgccgcctcttctcgtgttcgacttggcttcgtcttctacaattgtgccgcacgcgctgtgaccggactccgagtccgcatccgctactgcgccgcgaaccccatcagaaaagataccgcgtaatcaccgctcaaaccgagcctgctaccaatgacgccgctttggtctacgccgccggcttgaccacaacgcgaggatcgctcacaccgccgcggccctgaccatctccaagcttcatgtacgcctccacgacttcctacaccgccaccaaacacttcgggtcaattccattgacagcgaatgccgccgatcaataaccagtgcctgccaca

SEQ ID NO: 12827 - DNA, 1002 bp, Oryza sativa
tttgaggagtccaaaagttttatatgtttcacttaaattatttgaaatctaggtatgaaaagcaattgtgaactgaagatttgtacaaaggagaaaaacgtatggcatataggtagagtggaagggaaccagtcgcgtatcagcatatatgcttaaaacaacagaatatatgagtaaagttggcaaatgcgtctttatcgtccaatattctgtttagatgcttcctttttttagaaacgtttagatccttctttgagctgtaaagtgacttcaaactgtcataggtctaacatctcatattatgcacactactaaaaaaatgatttttctggacaagagccccccgtaggttgcaggcggatcatcgtaactagttgtgcctgcaaaacccggcatgcatttttttcgtacggctccttaaaagacccacatgcaaaaatatatttcgcgggtggatctgttaaccaatccatccctataaaaagagcagcatctttgcatccaacaacaaccaatcaaccaataatagacatatatcggcgagaaattttaaccaataatcaactaatccatccctagaaacaccaaccaatatatcccaaaaacatgaaccaatcaagatcgggagaaatttgggatgccttacacacaaatcgggagaacatgcggcgccgctgaccgctatgctccgcccccgctactgtacgtcacacctaccatcgtgccccgccttctcacacttgtcccgcttggcatgcctgagctcgccggacacgttggcacacttcttgaccgtcttcccctcgggccccgtggtcgtggtcgtgatcgacgccacctccgacttctcaccagtggcatgctccgcccgaccgctcaacacgccctcaccctaccataaacaccaccaccattcaccctaggcaccttctcccctcctcctcactccaccgatgggcaactcatctctgacgcggcctcgccctagcgttgggtgcagag

SEQ ID NO: 12828 - DNA, 6342 bp, Oryza sativa
tactgaaccaacagttgcatcgtattatcctctcctctcccttctctctcttgatgtttgttgcagcacggggaaggggtggctaggaggcccaggactgcgcgaactcctcgccgtcctacggtgcacacctcgcgaagaataagtggcggggaaggggtggcggccggtttgcagcaaagggtgggggcgatggctactcggtgaaggggagaggcggtggcaaagcgtaggggacacgactgcttcaggttgaggatggccctgatgaccatgacggctcgagttggcaaggccgggacgacaatggctaccacggcgatggttcgtcttctctgcctactctgccacgcagaacctcaagagctccatcaacatcatgcatgtgcatcttggacaacgaagacaacggtaatcgagaccggaccaccagatctagcggtggcggtgcttgggaccgccagatgtctagctatatctggtggcggtggtagtccaaggagatggctgccctcggcgacgacggctccacgtgtaagctcggtgacggtggccctcggtggcgatggctccacgcgtagttcggcaatggttaccctcggtggctagggttgcggccagctcggtgatggtggcgacgacgacaacttcagcttgggttcctgcttcctactgctcggcaataacaaatttgggaagcttgtgttgatgcatgtgaatttgggataaggatttgggacattaattgtggatcctgattttaattttttttccattttaatttttttcctcctataagaatattttcgttggcgggtctctttacctattgtacagtgaaactagtttttttcgctagcggccttcttagcttggccacctgcgaaagtcaatttttgctggcggtcggcaaggccaatgaaaaccagcaaaaacctgatttggacgctagcaaaaacctgatttgtacgtagtagtgttagtacttcataaaaatattactatccattattcttgccaatctcatttgataagttagtaactaaattactacgagatctggtcgataaaaagattacttccattatatgcactacaattacaatatgatccactagtaatgttgtactcaagtcctcgtaggactctggtatttttactcacgtacggtttaattgaatcacaaaagatcgagcatatgctttctcttttgcaggggcaaaatgatagtaggagtatattgtttacttagtactccctccgtttcaaaatatttgacaccattgactttttataacgtgcttgaccattcgtcttatttaaaaaatttaagtaattatttattttttttatatcatttgattcattgttaaatatactttcatatacacatatagttttacatatttcacaaatatttttgaataagatgaacggtcaaatatgtgctaaaaagtcaatggtgtcaactattttaaaacggagggaatactatatataattatatattgtttcattgaatcacatcacatgagtaaaataattaggagtaccatgtgtacacgcacagttacacacgtccagtgcggtgcggacaataaaattacaaggtacggtgcggttgcgatgggccctggccggcgactttgccggcgatgaccaacgcaactgccgtgggatatcatcaaccgggtcggcggggccgccgtacgtcctcctccgcacggagcacgtacggtgcattgtccaagcggcgtcacacgagccgcaagcccaccatcccctgaacagggttcactctatcggttgagccgtttatatcgggggtcaccgaaattccgaaatttcggaaattttaaaaatttcggtctaaaatttccgaaattttgagtaaaatttagttgaatttaaacaaatattacctaaatttatgaaaaaaatttaaaaaataaaaaatttcagccaaaataatatcgtatcggaagtgaccgaaatttcggtccgaaatttccaaccctgccctgaacacactgtcagatgggctaggctgggttcggttctagaggatggaccgttaaacgagccatggtagaaaaaaatctaggtaaaataacccaacaaatggacaggcagttccatcggccagctcaactggtgggtagactattgctgcaaaagacttgtaaattaacttcttattgcagatcattttctttatgaaatgttatttgaaattttatatttgactttaattcctttttaaactattttggcaatggcacaacaggaacaggaaaagaaaacccaataaataccagcatgataaaattttgaaaaaagattttagctgtttcaaattttgttacacgttaccatctaaactccttgggaaaagaaactgttgatttggatatatattagtatatatggtcttcaagataaaagtttcaccgtcaatttctattgcaaggtatttaaaaatgctgataaaattatactaacagtattttttttaattcattctaaatatttaaaaggacattaatatcgaaaacttttaaagtttgccattaaacacatctaaactgcaatgagattccattaaagtcaacagtatagttgttccttcaacatatatagcagattgttaaagtaggaaaacactttccagaaattcagtaaaccactgagaagttcatttggaatatctgaattaatataattgaattaaactgaaatgttacaataaccctctttttgacagcgacacaataaataaaggttagttttaaaatattaacagcaagaggaccaacagggcaacaggacagagggcccaaaaccaagcaggatcaattgataacattttggttaaattttcattataaactgttggatctagcagtcaaatttgaggttaaaaaacaatatatacatgaatacccagaatccaccacatctctttaatagtacctacatatactgctgaactgaagacatgaatacctttctttctctatggtgacctacagaatgtggcacagatgtagcagtgccacagatgtaacagttattcaacttgaacaattcaagttaaacctgggaccaaattaaaatctccggccatgctgcaaatacaccccttgtacttccaacacaatctcaacaataactgttctttcaatgcagccaattgttgttgcaaacttgcagttaattgttcatgcatctctgcatgcattgccctaaaggaaagataattaagttgcccagtgccagatgcacaatggcaagaattgcagatctgagaaaacagagagaacaatcatcaacttttaacggcacatttactaacaatctgcaaagccggtgcctgattgaactggtagctcagctgatcactactatctactacctagctagtcgcagtttaatttaacacaccatctacctagttgcaatttaatttactctctcctgcatatgccaaatgcttctgttgcacttgcatggatatgaacataatattgcatgtagctttgcatgcatatgctcttcttgatcactatataaacccatcactgcctctcttcttgctcatctcccaatccactacttcttgctgatcatcatatatctcttgtgagcttcagcaatgggggctctgccaagggctctagtcctcggcgtttgcgccgccgtcttgctggtgaacgtgctcgccgttgccgccgacggcgacgccgcggcggcggcgtccatggtcgtcggattggccaagtgcgccgactgcaccaggaagaacatgaaagctgaggccgttttcaagggtatgttgatatcataaataatcacgcaatatggtccaattaatcattgtcatttatttaaactactacctgaaaaatgcttgttctaagttctcataaatgcaagacgtttttggttgtcctaagtcaattttttttaaattaaaccaaatttatattaaaaatatatatcgcaatatttatgacaccaaattaatttcattaaatctatcattgaatatattcttttatattgtgtatatattttgtgttgaaaatgctgctgcatttttattcttgattttgttcaggtgttcgcgtggcgatcaagtgcaagaacagcaacggcgagtacgagacgaaggccaccggcgaggtcggcaagtctggcgcgttcgccgtgcccctcgcggcggacctcctcggcgacgacggcgagctgaggcagcaatgcttcgcgcagctgcacagcgcggcgtcgaaccagccatgccccgggcaggagccgtcgtggatcgtcaacgccgccgccgacaagaagaagaccttcgtcgccgtcgccggcgacacccacttcccgtcgtcggagtgcgcgtcggcgttcctctgcgacccgttccacaagaaggacttcttcttccactacaagaacccgtcgccgccagcgccggcggcgtaccacaagccgccgccgtcgtacacgcacccggcgccgccggtgtactcctacccgacgccggcgtactctcacccgacgccggtgtacaagcagccgctgccgacgccgtcgccgccgatctaccacccgccggcggaggagaagaaggtggcgatgcaggacgacgcggaggctgaccccgagctgttcaagaagctgctgccattgatcaagaagaatccattcctcaagttccccaagctcccgcctgtggaggtggaggcaaagccatagatggtcgccggcttcgccgcggcgccatgatcgatcgatcgaagcgaggaaacatgagtactagctggtttaattgcttcgtttctttgtgtgtttttcacaccggctactcgagctagttaattactgcccttctagcgttgttgaagcttggtctgttgcctgcctgctagcttaactattcagatataaataaaagcttctgttctctatgatgtgattacatgtttgccggattgaatggatacctagctactagcttagctagcttaattaattttattggatgcatactaaaatcttgcattttttccatacaaatatttacttcctcgtttcatattataagacgctttgattttctttatttttaagtaaagtgtacgaccggtcacttagcttgtatcacgtgtcatctagaacttgtgtcactgtgtcatctagatccccgaactctaaaaatgctaattcaggtcccataacttgctaaagtgtgtcattctggtccaagatggctacggaccattatagcatgctatgtgacactggtgtggcataccacacggatgctgatgtggcatgccacttctgcttgtccaactaaagaagagggaaaaaaagagagagaagaaagggaaagaagagaggaaaatggaaaaaagaaaaaggagaaaaggaaagaaaacttttccaagtgggccccagttgtcagtcaatatagagatattgctggtgccacgtcagcatttgtggggattttggattatttatcactctcttcgatggtgcattctcaaatgccatcattcccattaactttgattatttgccattgtgacctaccaagttgtttctattttaccattttttaactaacaactcagcaaaacgatgagaaaatgaccacattgcccctctcattcatcttccttctaccatcttcctctccgacatggcatgaaccagtctccaacatgggacaagccaagcagtagggacaactattgccatgaatgagctggggcagcaggacgagcaatggatgtgacgatgcttgatggttcgccgttgggtcgtcggggcgaaggcaatacatctcggttgcaggccctctacctcgcataaatcttgtgaacttgagagaagcaacgcaaatggaggtggggcacccgggggggaggtgtcagggttatggataccacatacctaatagtagttgactaaatctcggcatgacccaccacttaccatgtcctatacggaaacaacctgcggatataggaggagttccggataagaaaagacaaccagagttctacatggaaacgataaggactactcggattgtatccatattggtttccctagttctacttggacaaggggacacctatgggtataaatacaaggccccctaaaaggagaggggatacagacgatcaacacacacccaccatagaagacacaaaacaatatatcaagacacaagatcaacatacaagccaacatacgccaagacaagatgccggatatcgatttcagggataagcacggctagtcccctacggtgtctccagatac

SEQ ID NO: 12829 - DNA, 522 bp, Oryza sativa
tcttaaagttctttaggtttgatcaaatttatagaaaaagttagcaacatctaccacacgaaattcccccaattagtttcacttaatttaaccttaaattttttttggttccaaatttggtttaaaaaatattactatatttttctataatttggcctgaagtttgacttataaaaaagtcaaacgtgataatatgaacagagggagtataactgttagggctaggcaagacctaatagtattttatcttaaagaaagataatttgactttccaacaaactttattccggctatttgcttggtaattaaagttgctactattgcatcgaaatgcaggtttgccctacactgcctttgatctctcctgcacgaggaacatccataattgacggcgtgctacttgagtacagcttgaaagccaagcgcggtggcggcggcgaccgcgacggcaacgacgtggagctcatcgacggctgcatcgagttcacttcgccgtctaccatgccggtcggcgagaaactg

SEQ ID NO: 12830 - DNA, 9375 bp, Oryza sativa
  unsure (1)..(9375): unsure at all n locations
ataacaacttggtaggtgggtgcgatatagtataagaacatgagaattgaacatccgagtacaacaacttgacaagtaggcgcgttctagtacaagaacttgataatttagtattttgatgcatcaacttagctaacatatgctaggtgatttttttttcacgatatcaatatgcaattatatagtaatcctacgtatatttataatattggatttaatctttaagaattatacttcacatacaatttacattcaattaacttttaagatttttttttgttttcttcaccttcataataatatttttttacatccagtttaattgatttttatttattagttattaggataaaaataaaaatatgcttatacaaatacacgccaatatattgtcaaaataagtacttaaaaattgaatctataaaaaaatgctccaaataattaagttgccgcataacttcttaatttattgaatcaaaatcatatctaccttgtaagttattacatttatatgatcacttataaagtttttatattaaattatacctatctgccaagttgttgcactagaactttcatttctcaagttctttcaccaaattgcacccatctaccaagttgatgcaccgtcggtgcaatttactgtaaatcatgcttaaagtactttgtgtgataaaacaactcacaaaaaaaacaattgcattaaaaaaatcaacgatgtcatttattaaaaaaccagaggtagtatcaaatatacacttggagactgtcacaatgccattaacaacatgtaaaagagaataatggaaggactaaggaggatattgtaagaccaaattgcaatttgactatctgaatcattatctttttttaaaaaaaagtccactatgccagttgccaccccggaggcaccgagggataagggcttgcatattacacaatcgctggatgactggctccgcaatttcagaaaagctatattgcgagttggtcttttaattacaaccaagttcagaaaactgcttgtgcttgaaaaaacttttctgtaatgacaatgcacagatagctttattcacacgacgcatggaattgaagcttcctctgcaatcaatttcaggtttcaacagaagctcagctgagccaacatgaaagctgggaaatttgaattcagtttcccccagaggctgataatttgggttcaaatttcccctgattaagctccaatcctcctcctttttttttcttttttgtgggtagctccaaatttcttgtcagcacctcagggccaagattttcggtagcagctacaactccaaaatggcttcaaaaccgtcgaaacagtagatataactgctcaaatttatgtgctatgtcagctcatatggccgaccatgatactacatctgtttgatcttcgaatacaccaacaaattacaaccagcagtcgtagcaagtgtttttcttgattgttcagtcatgtttacacactgtttgtacacacttgtctttctgcatgatatgctattgtaactccgactcaatcagtacacaacaagcggaaattttggatgggatctagaaggaaagtaatccgatactggacactaggactcacgactccaccaatacacgaatggtggcttccccccataaatacatggcaggcatgtgcatctcaattcaaacaacaggttgataccacattggtagatttaccatgctgctaaggattatgcgatggttaatttgtttaggcaaatcaatggggaatagcattcaaaattggtggatcagggtaaagaccacccagccaccccttggcaacatatcggtagacagcctccgtgtagtgaatcccgtcccaggacactgatgctgttggattcttgcaagcgaccactccaggcatggcgcaagtagcgcttgcgttccagttatacacgccaccagtgccacagcaagccttgagaactccatcggcaccgaatcctgcagatgtaaatgttcagagataagccactgccttagtaggtcctgtttggggagtttaagattctgagaatttactgattggtagccaacttctgagaatttagagaaactgggtttttcagcttctgggttctagttaatttattttttggattctacaactacagattctcagaatctgggtttctcagaatctgggtgacaatctgaactgtttgggggagctagagattctaagagaagctgcagcagctagaagctcccccaaacagaccctaagactgaccataatcctttcatagttttgattataaaacgtttgtataaattggttgacacttttttattagaaaatgggataaacccagcctctgcatccaatcagatatacacagccaaaatcctggttgatgtatgtaacttaacaaagctagaacacagtatgtaccaaatcggcgaggttcttgggtgactcgaatgatgggttggtagaagtcggcgaagatgatcttggcatgagggtacttgcgcctgagcctgacgagagctgcgcgaagcagcgtgttgtgcctcttggccacgctgttgatggcacgcaggcatccgaggccatcgtagtccgtcctgttggggctcactcgttgcgtgaagtgctggtgcacaccctgttggtgggttccccggcacgaccacataaaccgcgccttggttgatgagactctgtgatgtgcaaattaagctgcagatttagaatgtggcttgacaaatattgctcatttttcttatattcagaagcaactttgccatggtgtgacaaagagatcaaacttttttcttgaaaacataacaaactcaaaccaaagtaaaacttcacggtattacactggagatttgctccaatccagcaaaaaatacctcgaggtaccggtaccctacagtaccaaatcgtttctgatcgttggatctaacaatgcccatcctgctcagctagattcaatgatctcaaacgatttagtaccgtgaggtaccagtacttcgaggtactttttgctggatcggtgcaaatctcattacactgagtgatgggtgtacctccactcccatggtgatttttttcacgactcgaggcatgtatgattcgacctcgtgtttggccttcccagccatccacatgaagttgtagtcgttcactccaaactctccaacgataaatagggacttactgaagcagttcttgaaatctgcagtttgttgaaatcaatttaagcccactgcgaagtagatacaaatactcattggttatatcttctctgaaggccagaatgaattcgattatctaaaaataaagatcaatgctgattattggcgcctatgattcagactactcgccatttgcatcttctttggttgtgttgcaaatcgatggcttgagctcctcgaaccagccaagctgcacatcaagtgaactgttcaaaagcttaaatgccacaatgttgttcctctggaagtagtcgatgccagtcgccggcgcgccaccgacggcgaagtttacgccatgggagacacttgagctattcgctagggaggctggaaggaaagggagaccaaattcctcggctagaaagcacaacaaagaaaagttagtactgctgagttgtaccatgtaatatgtaagtaaattgctctcatcgtcctcgtcaacttaatactagtacctccgtcccaaaatataacaatttttggctatgaatctggacacatagttgtccagattcataattaacaatgcttatattttgagacagagggaataccttcgttttgtaatatatggtgtcgttgactttttgataaatgtttaaccattcgtattattcaaaatttttgtgtacatataagaaaatttaagtcatgcttaaagaatatttgacgataaatcaagtcataataaaataaatgatagttatatttttttaataagatgactgatcaaacgtatcaaacaaaataaaaaacatcatatattaaaaaacggagggaataatattttggacgaactggttagtacgtgcaactcaatggtgcacataattaacgagcatgcaagttcacaatagaattctgaattctcctggtataatttgctagaagtatttctaggagttaacttgaaagaattgtttgtgtagcaccctgaatctttgaacgttactcaagaaagcgttttaagccccaaaggacatacatcttcgtgtgcatgtggcccaaatagctattaaaaaatatgaaaaaaaatatacagattatgatgtcacatattgattcacaaacatgctactccaaattaattagatactgggagtagaaaaaataacaattcaaaccacaaaaggtgtgtgtgatcgtgttcacagttattttctttcagtgtacatatattgaatttaatcttgcgtgtttgttcatagatgtataatacaacaaccatgcttcaattcttttttccatatattttacataattgagtgggccacatgcacgaaacaagggcataaatactcaacttaccaatgaaatcgataatgactcttccatcacttacgcggccagtgggatgaccaaagaatgacatgccgtaaggaggcttgtcattccatacgggcgctaccggagttgccatgatgacgaaattaccggtgtcgatgtacgagtctccaagagaaaacatcgagatgaaaaaatgcgaggtagagctcatatgggagagacagaagatgaaggcaatggagaatacaagcttgagctccatgatgctacttgctagaaaaaatttgaggagagaacaccagagacacatgagaagttgaggggtttgcaagccacttataatcacatggagatgatcatatgctttataaaagtaacactgtttaagacttgagaagtagtaatacacgttgtttaagtgatcaagtcttcaggtacgatttgacaaccgaggtgatccttcttattggtcaatccagaatattgcaaccaagctggaaaatatcaaagaccataaaggttataattgcaggacgaaagaattgtgatgttacaaaaatgcaagttgagtcaatatttgggtaaagatccacttgaccaacccagagacgctgtgagatgatcacggcttcaccgttacagatgtgttggctccgcttgttattgacgccgtttcagaaaagctgcgttggtctgaattacagacaatcttcagaaaactgcttgattgattaatggtagcttgaaagaaattttctttggtaatgacatagtaccgagcgtcctggaatctcaagccatcaattatgggatcctagcacacgccgccagctgtgccaatccccacgggcctttttgttttttgttcacattttttttcccgatcttttttcttttcttttttttttgctgtttctttccattttttttcaatctttcgcactcctctttacaaaatataaaattgaaaattttttattttcacttgaaagttttcaaatattgacttgaaagttttcaaattttgtgttgaaagttttcaaattttgagttgaaagttttttaatttgacttgaaagttttcaaatataggttgaaagttttaaatttgaattgaaagtttttcaaatttgagatgaaaacttgaaagttttcaaaatttgacttcaaaaaatttaaatttcgagttgaaagtttttaattttgtgttgaaagttttcaaattttgagttgaaagttttaaaattttgagttgaaagtttttaaatttgagttgaaagttatcaagtttgacttgaaagttttcaaatctaggttgaaaatttaaaatttgagttgaaggttttcaaatttgagattaaaagttgaaagttttcaaattttgacttcaaaaaatttaaattttgagttaaaagttttcaaatctgagctgagttggaagtcttaaactatatttgaacaaaatatggttgaacgcggcgaaaagaaaaaatcggtactaattactcccagagctaatcttgttttctaatatggcgtaattaaaaagcgaaagatcaaattaatcacatcgataatgacgttttctaatagggatatacgccataattaccagaagaaaaatcaaaactaatcatggtactagtcacgtttttttctcagactccggttttgaccactgcgctaacgacacgtgtaccaggtggacgtatgcgcgagttcgacatctggcgcgtatgcgctaattagttctttcctcaattattgaaaaccacatcttgttcacatgaaagagttgaaaattttgaaaagactggtagactcaggtcctcaatactgtctcactgtagtctactagtactccctctgtccaaaaaaaaaaacaaaccctggtttccgtgctcaacgtttgaccgtctgtcttatttgaaaaaaatattaaaaaaatttaaaaagacaagtcacgcataaaatattaatcatgttttatcatctaacaacaataaaaatatgaattataaaaaaatttcatataagacggacagtcaaaattggacacggaaactcaaggtttgcctttttttgggacggagggagtagtagtctactgcatgacttggattgtcaggtgagccaacccaaagatgagagttttaggaagctgggcaatttgaattgaggcttccccagacctccaaaaatcttatcctcagggctatgatttacgaagcagctagatatcatttatattactacctccgtcccaaaataagtgcagccgtaggaaccgtgtccgacgtttgaccgttcgtcttatttaaaaaatttatgaaatttttttaaaaaaatagtcacacataaagtactatttatgttttatcatctaataacaataaaaatataaatcataaaaaaattttaaataagacgaatggtcaaaagttgaacatgaacagtgcaaaactgtacttattttgagacggagggagtactatgaaagagagtagtggtgccaccacaacttttgcactattttttaaaaaaattagtccgtgataaaaaaaaatcgcagaacatatagctgctcaaatttccatgctgactggcatgatcaactttttttttggattgctattgtacgtaattccctcatcaatcaactaatactcattggtactataagggcgctggcaaggaggtacccctagcatttcctttcccttttcttttcaaagaggggtcagtactgtcgaagttattacaaaggtaacttatacgatgatatactttactgtttgcttgggccgaatttgggtcataaccacattcgtcaaaatatggttttttttttatagaaactttggcgtcaacccatcggttttctggtttttctaattttttctttgacagcatctgaaagatttaccctttgatttaccagaagtagaggcggtgtgaatttgttttaggtgtactccgatccaggtccagcccaaaacggcccacggagctctggtctccctctgaggcacggcttcgttcatcccaggcgtcactacgccaccaacctgcctgccgctgtcttgcccgcagccggagacaacaacatccgccatagaagcggttgcctccatgaagcgtccacggacagcctgccggagctagctcattttaaaacgaaatattaataaaaaaaattcaaacaataatgtccaactacagattgattgtacacactgatataggccgtgtttagttcctcctccaaattttttttaacgtatacggataatattttaagtattaaacgtagactaataacaaaacaaattacagattccacctgtaaaccgcgagacgaatttattaaggctaattaatccgccattaacaaatatttactgtagcaccacattgtcaaatcatggcgtattaggctcaaaagattcgtctcgcaatttacatgcaaactgtgcaactggttttttttcgtccacattaatactctatgcatgtgtccaaacatttgatgtgacggaatttttgaaagttcgaagggaactaatcacagccatagattacatttaccatgctgctaggattaatcatgtcatggtttttgctctcaacaaatcagtgatggtggtggatagcagtcaaaattgggggatcagcataaggaccatagagccaccccttggcaacgaaccggttgatggcctccgtgtagtgaatcccatcccaggatatcgaggccgatggatccttgcaagcgaccactccaggtaaggcgcacgcggagctgacgttgaagttgtaggtgccaccggtgccgcagcaagccttgagaaggccgtcgcttgcgaaccctgaataattaatattgcaaatgttgagacaaattaaactccggtcactatctcagtgatgcacaccgtagaattgtcatcgtgtttgagaacgaaagcacaaacaattcctataatctttgccaatttcgatgggtaaactatttgtactccctccatcccataatataagggattttgagtttttgtttgtactgtttgatcactcgtcttattaaaaatattggaattattatttatttttttgacttactttattatccaaagtactttaagcacaacttttcgttttttatatttgcacaaatttttttgaataaaacgagtggtcaaacagtgcaagccaaaaactcaaaatcctttatattatgggacggagggagtatatcttatgcatgattgcgtacaaaaaatatatatactacatatgtttcgtattataagtcattttgactttttcttaactaaccttttttgagttgagcaatatttttaacataagacacatattattaaaacatatttaatgttacgtttaataaaactcaatttgtattatagatattaaatttttctataaacttgatcatacttgaagagatttgagtaaaaaaaatcaaaacgacctataatataaaacagaggtaatatattgtatgaactagttggtgcatattactttcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12831 - DNA, 508 bp, Oryza sativa
gttactaccgacctcccaatgacgggtgtaccggttttggtgcccccaaccgtcattctcaagctataataggacctaccctccttcattttaacacacaccaagaaggattcaagaagaaaaagttctcttagtttactcactttgctctagtgctagtaggattagaattagaatagtcttccttagttcttcgagtctccggagaattcgggtatggcccttgtaagactttatccagtaataaaatattcttctttatatagttttggtccttgttggtatttcttaacgacattactagaaatatgaattcccagcaatgacgccagaaatggtcctagtatatatatggttatagaaggaatcggcaagcgcacggatataccattgtagcatttcacctgggagtattccaaggtatcgtatttatttaatgccaagggaacattgtaagagagaactatgctaataatgtatatatgctacttgtatgatcagagtctaa

SEQ ID NO: 12832 - DNA, 797 bp, Oryza sativa
ccacgtgggcgattcaatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctctccaagactgccacatcacttgagcagcgctcgaatctgggcgtgcagattcgtttcatctggagacatggtaacgtcgcttcggtcggcgagcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttcctttcgccactattcccctttccttcgccgtttgcgccctaaactctctctttgctgtgcctcaccttcgccacacacactcgttctcaaccctctctttctccaacgacatggcacggggctccgctctgctcgacggtagcgtactaccgccttcccgcattgtgagcgagaggcaggctgggctgccgcgccgcttcatgccggaatccgccaccggccgggagatagtgatgc

SEQ ID NO: 12833 - DNA, 8792 bp, Oryza sativa
gcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggtagctggactctgggagtccgagaaaatgaaaaaggctctgggagccgattaatcaagtggaatggctctgggagccgagaagtaatgatctaacccgggaggtcggtgcattgccaaatgagctattgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgccctgaagagaagataaagtgaagtgaagattagggtttcgtcctagttcccagccgtcgcctgtggtgttgggtattagaccgttggttccgctgctgctgttgttggtgttcgcctcgtccgtgtcgtcggttgtattctcgggctgtctgagctgcaacctaagttaagataaataagtcctctatttattttaaagattgctatgattcatatttgtcaccgtgggtaccagcactatgtcctgggactggtaccgagatcgcggtttcgtagaaagcggttcgcgccgttttccctacgacacgctcctgtcaggtgccgttgtacggtggtatcagattggggtgtgacaaacatcgactacaatccgctggtttccaccgtggtaggtcgatctgatccaatctccttgagtgatttgtactctcagatggttagctacgacaaccggatggatcatcttcaaggaggcggacaaatccaatcttctgccaacgccgcctcacgcggacgtggcaacggcaacagcaacaacttccgcgatcgtggtggcggcggcaatgcaggccgtggccgtggcaatggcggacgcggtggaggtccacaaggaccacgtccggtctgtcaacggtgtggcaaaactggccatacggtgctcaagtgctggtataggtttgatcaaacctatcaccccgaagagaaggttgcagcagtagcgacgaattccgcctacggcatagataccaactggtatgtcgactgcggtgccaccgaccacatcactggggagcttgacaagctctctgttcgtgagaagtataatcgacatgagcaagtccatgcagccaacggcagaggtatgaacattagtcatatcgatcattcagtaatttcgctgcgagaacacagggacggaagaaacaatacggacccacgaggtagtcagaagggaatggggccccaggagatcgagagactggtccaacgggtgctaaatctcaactccgtggatgcgtctctcatcccccacggtatcctccccctctgcagctacccagatcgcgcctccatcttaaccattatcacagcggtcggggcctcagaggagcaggctcctaagggctatgacagcgcaggtgggagccgccggggggatcaatctacccccggagggggtcgtgcttatgggccccgcgtcgggggctcggggagcaaccgccctaccgacgcccgggggaagaggaaaatgggaggaacacctcccccatctcctccccgagggggcggggcggtgcgtgccagcagcaggcgcccggagggggccgcgccaacctcgcagcccgagggggagcgcaaaaagaagcggctgcgcaagatgggggagacagaaccatcccggggaaacctaattttccctccaaggtggtcatttaaccgaccccctcgcaggttcgtcccacgctcattgcgaccgtcttttcttctattccaaaagcaagttttttcttacccatcctgtttgccttctggtttttctttctgcttcagtgatgtcccgtcacgttcctcccgccatcccaagtccggccaatccgaggccgaagatccggcggccgcagaggaacggaggcgagaatctgaccggcgagaggccgcagatcgccttcgggaagctgaagaggccgcccgggaaaccgcccgggctcgccaggctgaggataccgctcgggaggaggccgcccgggcccgccaagccgaggaagccgctcgggaggaggccgcccgggcccgccaagccgaggaagctgctcgggaggaggccgcccgggcccgccaaactgaggcgatggcgtctttcgaggcagcccacgacaaagctgctggcgcgtcgcttgggcctactccctcgggcgacgctcaggcgacagcctccggggcggctcgcgacgaggccgcgggcggatcgcctgggcccgctccctcgggcgactcccaggaccaaacgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcatcgccaccaccgcgatgattgaggcgcaggactccctccgccttcaacacgggagctgggaggcggagctaaagaaaaagctcgacgccgcccagggggtccttgacgccgccgctgcccgagagcagcgagcaacggaggctgaagcggcgtcccggcggcgcgaagaggcccttgaagcccgtgccatggcgctggaagatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctctcgaggagtccgaggccgcgacacaacggctggcggacagcctgtccctccgcgaggcagcgcaggaggagcaggcgcgccgcaatctggaatgcgtccgcgccgagagagccacgctggagcagcgggctgctaacctcgaggcgcgagaaaaggagctggacgcgagggagcgcagcggcggggcggctacgggcgaaagcgacttagtcgcccgcctcgcagctgccgaacacaccgtcgcggacatgcagcgcgccctggactcatccaccggggaagccaaggccctccgcttgtcgggtgagatagggcccggcatgctttgggatgcagtctcccggctggatcgcgccggtcgggaagcgggcctctggaaaggccagacaatttcgcgctccaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcattgggatgagcccccaggcccccgccaatctccaattttttctttttctttcttctttttgtatagatcaacttaatctgcaatcaaaaatgatgaaaaatttctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgacccccccccctcaggggtagaagcgacgaaggtgttcgatgttccacgggtttggcagctcagtgccgtcgcccgtggccagccgtacggagcccggccgggggacgccgatcactcgatacggaccctcccacattggtgagagcttgctcagtccagcacgcgtttggacgcggcgtaagacgaggtcgtcgacgcagagtgatcgggcccggacgtggcgctgatggtagcgccgcaggctctgctggtagcgcgcggctcggagggccgcgcgccgccttcgctctttcaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcgaatccccagtccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcattacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaattcagaaagctcgattgcccattttaccacccgtcctgtaccctctcgattatgcaagatttgatcgagggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctctgctaggggccgtatccccggggcgttcttcgttcaagtggcctttcggggcgcacttgtcttctgtgccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccggctccggtcgtcaggggccgtaggccaccgtccgactcgggggcctctcctccccgctcgctcccgggccaagttagcacagaatgggggtgcacgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccactagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgtacattctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccgacatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtg

SEQ ID NO: 12834 - DNA, 2875 bp, Oryza sativa
aaactccggcgagaaacgtgagcacacgctcccccgtcgacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccaccctgtctgagcggcggatccgggggcggccgaagctgccacaccggaaccggaggggttccaggtccaggcctcctccttacgagccactcggtccgcgagctgaaaaagttctgcggtagtctggggctctttggaggcaatcttttcgaacatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggtggtggcggcgccggaggtcctggtggtggcggaccgtccaccagcacccaggcgctgctgtgccgtcatgaccaagttggccacgtcgtccagccatcgctgggccggagactccgggtcagggacgatgggcgggtgacgtaggagcgcgccaacagcccgaagtgcgccttgaggcgtgctgccgtcgccgtagacgaggaggcgacgctccccatctcgccgttcttctgcaccacccgcgactggcgatgctgcggatttttcgaccctctcgagcgcctccccctgcttaggattttgttgtggaggaggtgggggcgtacgagctcgacggcgtgggtttggctccccgtcgtcgccgctcacactcggagagaggtcgtgcgcctttgcttgctcggccattaggctgaacaagggaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtatgtggaaagatcgcgtgccaggaagaaacgcgagacacggacgatgtatacaggttcgggccgctgggaagcgtaataccctactcctgtgtttttggtggatctgtgtaagagcaagttacaaaatatcaaccagccctctcctctcccgggaaaatccagtcccctctctttgtgggcatggtcctccttttatatcttaaggggataccacatgtacccttttctttccaaactggacttttcttctctttatggacggagattggtatggttgccgtccgaatgacacttcgatgggacagcccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctagaggctctcgtcttgacggaacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttatgtgagccctaccgtgttcacccaacctatgtacatagtgcataccccacaaggggtcggggcacctcgggcctcggggccggggcaggggcaacccgacccccccctcggggaaatcaggaggagggcggacacctcaccctcgggcccgacgtccccgaaggtgccaggccacgtgggcgattcaatctgcctcaagcctccgggcgcaatactcccggtcccatatcaccgacaatatatatatgtctatatatatg

SEQ ID NO: 12835 - DNA, 2579 bp, Oryza sativa
  unsure (1)..(2579): unsure at all n locations
cccatatccccggcaatatatatatgtatatatatatgtatatatatatgtatatatatatatgtatatatatatatatgtatatatatatgtatatatatatatatgtatatatatatatgtatatatatatatatatatatatatatatatatgtatatatatatatatgtatatatatatatatatatgtatatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcctagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagataggtgaacaagggcaggcgatgatggaaaggaacaaagaaaatgccgccaagaagaagtaccatcaccacttgnngtcaggaggctatagcgtcgcgatgccgaagtgggagcagatggaggctagcatgattgaaagggtgtcgaaccggcaacagccaattggccggaacgatcgaagttctggtactatgctcacggggaacgctcaacccagctgatggctcactggtcttcngctatcagatacaagaggctgcgcgacaactaacagatgcagtggaagcctcctctcaggcacgttccgaccagacagaaatagggacgagctgacactcgccctgcagactccagagcatccaggacgaactcgagggaaaggggtgattctttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatacaaacacaggacgaatcgacatgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaagg

SEQ ID NO: 12836 - DNA, 13637 bp, Oryza sativa
caggtcccagcatcgactcctcctcaggatctgcaccgactcctcctcgtggctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctagaagtcgcaccaatcgaaaaggcggaagtgaaatacatgtacgaattcggtaaaccgcttgtcaagcctgagttgctgcagtccctacccacacaaatgtacaagttccatcagctgtacatggagatgagcgcccccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactatgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcaaggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatgtagtttattcgcatgagggataacctaaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatataatatatatatacatatatatatatgtatgcatatatatgtattgaaacatatatatgcatggtttatatatatatatatatatatatatatatatatatatatatataaaccatgcagcaacaggggcatgcaaaaaaaaaaggtcagctcgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgataagtaattaattaaccagcaaatgggttggtgtagcattgaatttccgttgcaacgtcttaatccaaccaatggcgataaatatatatatataagagacttcatgtgaaattgggacagaatcaacttcaattccatccaatttcttccagctgtctgatgaagatcagaagacatgatctcctggggattggacgcatcaggaactcgagccgaaacatggattaaaccaccctaagggacaaccaacgggagtgggtaagccaagctacagctcgtcggagcagcaggtcacccggacacggcgacggctaggatccgacgcaattaggacgccatagatgcgcatctcaccgacatggcactcgtgtgtttttttctcatcgcctatgctcaactcaaccagttctgataataccgtaacgagcttagcatgataggctcgctgatgggatgaagagaaatgggaacaattggctcgtttttgccttgggttagcttttggatgtgcggaaacaagctgaggcaactaattaatggactagaatatagcttgtctcgccttctttgccacggcctatacgacctgctttccgtcattccttgtatgacaaatatcaaagctaaagaatcagttaccgatgccgatattgctaaacatctctccacaattttctttctcaatctcgcacgttttttcagccaatgattttccttgagatccgtgtcatgcccatgataccacactaaattattagtagcttaatcgtatcgatcatccggattagattagagatttcatgcgcaggatttttcacaatttgcttcttttgaaatatttatttcgcaaatatacctctgaaaaaacttaacgtagaaatggtcctttttagacgtcagagtggctggcgccgtcctcctaccgatgtggcggggcggtgctgaggtggcatggggagcgcgccaatgtggttggggcctcccccccccccaccccagcgccaccatttttctcctcccttgtcctctatagtgtagaagagagagatatccaacatttttatatttattttcacacttaggagcacataagaaccaaccatggaaaaaataaactcaaataaacaaaatatgtgacatctagaattttctaaatatctaccgaaaatgggtgtcatttattaaaacaggcgtaactttctcatacggactcggaatcaagcaaataatatatctacggacatctatagaaaaagttactgaatcgagccgaaaaaaagacttgaagctcatccaccctgcgatgaatcacaatcacaatccccaactcccaaatcattcacaatcctcaatccccaatcaaacacatcacagaacaagaaacattgaagaacatcacagagatctgtcactaacacagaaatcattgaagaacattgaagaacagggagggcgccgccactgcctctcgacccgccgtcgggccgccaccacctcccctcccgccgcatgccacctcccgctgctgccacctaattttaggtttaaatctggacatacattatctccagatacaaactcaagattaagtgtttctttaacagagggagaatacagatgacatgaccggcctcatgtgccgcccctccccggatctggcgaaagggagggttcctcccaccgcctctcgtagccactgccgcctcccgccgccaccgccgcagaggcggcagcggcggcggaggggagggcaccgcccgccgcccgtggggagagagagagagaggcgcgggattggatgagagcgagagagagagagaggcggatgtgaagcgatgagaccgagagagaggggctcagcgactcggtcttatcctctccctcggtcttatccgctcctcggctcggctcagtttaaaaggaacctataatttataataggtgctggtttttaatattaaaggttccgtttttaaaaaaaacggtataaaatataatatgtgccggtttttatttagaatcgacacctataattacttaaaggtgtcggttttttgcgattttaacccgtggaggtgggaaaaggcacctatagtggcgacacttatttgatgttttgtagtagtgcatccaatttctttcggtctgctagcaggagaagtgtgtaagctagggagctgacaaggatcatgcagtgatctactgggtattggacgcatcaggaacacgagccgagacatagatcgattaaaccaacctaagggacaaccaggagcgagtgagatcagcaacaactctccggaacaacatgtcgtccgggcacactatctaggatccgaggtggctacgccgtcgtaaagggacatgccttgctagccttgcatggtgatacgagcatctccagtatatgagtaaaatcgaaccatgtttgataaaaaaaaaatacaacacactgtagcaaccgaccaactgtacgtatcagagcaaaaatcgatcacaaaagaagactcaaactcaacaacgaaaaggtggtatgcagccgttggtcccacgatcgatgtcacacattgcagccaacgaatcaaaattttgttcgaccatgctaatcgaaccaggactgcaggttcctacgtatgccagttgatatatgtctcgtcggccgaacagtgtaaagtacggcgagctctatgtggccatgctaggtacgggtgtaaatggtaagccgcaaacccacttatagatcaaaataaacagatttacggcttattttgatttataagtggatttcgtagattagctacttacactcgtaatactaggttatctgtagtgtagcataatgtatgaatttacatgtgtcatcgataagacagccatccgtatcacttctctgggtaatctggtttgggggttcttaagcactgccgaaccaaaatgagatcaggagaggcacaaccttttcattgatcactgcgccatctgcctacaaggctacaacctagttgttgatgagcttttgttgatagagaagtattaaatataaacatttatgtacatacctcttctatttggtgagaaataagcaattgcatcagcggtaatttttgttatgcgttcgcacagttacatggtatgcagtacgttaaccttgccgatattttggttaatttgtaaaatagtcccctcttgtatctaacttaaatccatataatacaccacacgcacaaattgtctcccattcttccctatctttgttttaacaatttagtcactgggttgctaatccaaatggtaataataagtaaacaatgtagcacccacccacccgttcggtaagtaattaaccaacaaaaagggaggattggtgtagcactgaatttttagtcactattagtgagcgtgcacgtgcaaggcacgtcgatactattgaatggagttaattttgaaagagtattcagtcttggtactaacaaaaatatgtgtattcgtaaatatgtgattattccatatagctctaaaaaaggttgagattgttttaaattgctgaaacacgttggaatgttcgatttgaacataattctttgtaaacttgaactccaattcatttacaccgaaacaatgtcaaacatcagttttcaagtatccattcattattttacaaatattacaacttacagaggctaaaaaaaatcagagaccatttatctatcagacgcttattttgtgtgaaaaaaatcaagcgattttcaatggataatagacagtcgcacaccacttctgagttcttacatgcatatcctaatggcatagattggccgatcgccgatggcagtataagcatacacaaggacaaactataactacactaaatgaatggcataacatgaactaattttttgatttaattagattaacattctcattttcagcctgtgcttgctgccgacgctgttggctgactgcttcctcatgctgaagtagccctggtagctctgcaacgccctgctcactgaacacccaacgtcggtgcgtaaagactggattttcttttgttagttcctgagatcttgtcaggtttcagaattaagcatttgctagtaagttcagttgatgccagctactgaagtttctaaattcatcacctttagctcaatctcacctctgatgaaacaaggcatggcttcataagctgcttgccctctgcacgtaaccgctatggaaccacgacagtgtgttccgtcacctgttaatgtgtctcattctggaactgaatctgtcaaggggggtagtactttggtcagatatttgaacctcagacctgcagtgcacatattatgaatttcgatgctgaaacttcttacgcaagcaacaactcattgtaggcccctcagatgttgcttagcaaagtcctcatgtagagatatatatatatacaagttgcaaaatgaaattattttgcttaacagtatatacactactgaaatagtgatagcaaagcactatatgaattggcattaacactccaaatattatgtagtgaatcaggcaacatgatcaatcaaaggtaattagaaggttaacaaatagtatattccttatgaattacgatgtgattcaaatactcttttaaattcctcttatatggtcaatattgttaaccttcgtgtggttgatccaataactgaaggacatgtaatgttgttatatgggtcactcaattaattcccttttctggctattatatatgagaatcgacaatgatttctgacatcaatgcaatatatatgtgttaaagggtccttttaagatcatatgccaccaaaccactactgaatacggcactgaatagaagaatttagtcatttatgcatatttgttgcattttttatccattgagagtatataattcgatatatagctcaagttatttattacctgagaagtttttggacatctgccatttgacattgtaaaacaccatggtgacttgataattcctgccaaacaattgatttaatcagcatctgaatatcatagataagaagcaggaaacaagaaatattgtaagttgttacatcatccttgttgaattgtttcgatgtacctctccaatctgagcccctgcaatatatcggattcaatgtcacgtgcaaaatatgagcaccgtaagaaaattcagcaaacattatagtgtcagcgttaatcgggccatacatgatgcataccttcaaggcaatggcataataataataatcgtgaaagcaacaactctatttggccaacctccaaccaagccgtagtaaacaactaaagataaggccagcagtaggccggccttattgagataatccaatataaagttaaggatatatatcgcctgcttcaatcccagcacttagtaaaaggataatatttccagggtcattttgatgatcaaaagattgttggattacaataagcataggattgaattgataaatagctttgcaagtacttcctgaagcaattctgatgacatcaccttatactaaaagaaccatcttaatttctaaattatgtactacaagcatttttaggattagatagttgtaatgtattacaagcatttttaggactgggtagtttcaaacatagatatagagcctgttttgagtctacattcaataccaaatgtgcaagttttgaagtacatgatgaccaaatgatcaagaaccagatcgtccagtgccaaacccaagtttaaaccatcagaaacaaatgcagagataaaaatgttcagatttcagaagatgagatgacaaagcttaacctgttggaaatcatggcagatcgaagacaccaaggcctctgtggaccatgtgatcgtcaatgacaatgacccatcattgaactaaagtcaagatgttaatcttcatgccttaaataagtacatttatttagtgaagttacaaccagggttttcaagtttctttgagtttgaattccaaaactggtgcattaaagtataattttgctcacctgaacatgcatgttcaggacatcatatcaagctcaagagagtcaacttaggcatgccactcctcatgatctcataactttcctgtaaagaaacaaatataataattaaattttacatgaagcacaggaaaaaaaaactataatcgcttggctgaaatggaactgatcctctttggccatcatcaaagcatagataaacctcaaatgaatctgatggcaaacaagatgaaccaaccaaaaaaattctgaacaatatatgttgtccctagagagcaatagccaatagatagtcaggagataaaaattgacatctctattggacttttcacacagtaaaccctaaaaaacaaatgatcagctctagctggtgtgctctttgcttcagaggtacacatagcttttgttgacgatcactaaagcttatttgacagcacatataagttaataggaaaagcaaactataaatcgtaaccatcaaacttaataaatctatcgctagatgatcttggctagattattcagtttgacatgctattcttcaagaacatcgagcaactaccggtgtcgataaaatatcatatatctagtttttgtgagaggcaagtgttgaaattgacctgctaagtgatcatggaggagacaaccatgtagaatactggcacactcctaagtagttggcagggcaggcacctcactggcggatagaaccgcgtcctgtttccatgcaccatctgacccatcaatacactgagtagaaaaaggttaaaaaataattaaaaaagacaaatctagataggaaatcatgttcctttcacagggtccagatgaaatgaaaggtatgaacttacaatttggcagaagatggagtgattaaaagcataaatacaatctgaaaaaagatgaagtgattaacaaacacacacaaaaaaatttttgcaatggacgaagagaagagacatgtcatgatctgattgtatctcgatgtagtaagaaaagatcagagcagccaggcagtaggaagaattgttagaattaattaaccatatgagcttgcatagaccacatataattgaaatatggatgtatgagaaaacatcaaacaacaatccccatatacatgtacaggattgacctacatgaccttaagtcaccttgctaattcaagtaaataattaagagtaaagttaatgtcagtgcacatctaaccagattgctatataaatgcaatgccatacagctatgagaatttcatgattgatgcatcactactattgtttactttataactctgtaaatagagcacaaatgttgagcgcaatgcactgtttcggtgtatattgccattatcagatccttactatcctcccaacaaatgaaaatattgtacccaacaaagatccgaggcggcggcggggtagggtgagcggcgtggccgcgtggggatggcggagggcggaggttagatgcgctttttttttttggcgttctttttttttatcggcgtttttttttgtgcgtgacgtggtccgcgcggatggtgcggtttgttttgagccggatgacaggtgggtcccacgcgactgtagatccgaaagattgtaggattgtggatgaactcgtactttttatattatagataaatatatatatatgtgacatcgatcgtatcagattgctgggcatgcagaaacacatttaactttcattcaccttagtttgctaagaggagaggatcaaacgaacgttggtctcatatataggaataggacgcatcatgacacaagccatagctcgatctgatggtcaggcacaatatatgtgtgcttcctacgctaggatgaacgctgatgcagcaagttcattcgcttccggttcctagactgaaaggtgagagagagttaactgaaaaagtgtggcctcttcgttgggccaaacgagaaaagaagaagctagcaaccggaaggggagctgccaacctgtatcaccgacctcactaaccaattaacctggtctattttgttcttgcgttgtcaacaaattttattgccagaattttggtaaccaaaaacccaaccagcaaagccaaactggagatttcagttgcatgtcaactacaaacatatactccctccgttcctaaataattgacgtcgttgacttttttaaacatgtttgaccgttcgtcttattcaaaaaattttgtggaatatgtaaaactatatgtatacataaaagtatatttaacaatgaatcatatgataggaaaagaattaataattacttaaattttttgaataagatgaacagtcaaacatgtttaaaaaaagttaacagcgtcaaatattcagagatggagggagtaatagctaccttattaaaaaagttgtatttctacctatgcacctacctagacaacagtgataaaataaagaatcagttatgcacacgcttcttctatttggttagaaataagccgtgttcatcatagtgccatcagcaacgccatgtaactcagctatgccaaaaatatcctttgatatgctttgctttgccattggcattctcatgtgcagcactggatcaggatcctctacagtcaactgtacataccgtgctattgtcactgacatgtaggtccgatgatccctggacccacatattagtaacaaaggcacgatgcattaactgcagaggatctcaattcgtatagcactacctagtgcatcatccgctgggtagcaatagcatacatatttttaagttgttttaattaggctttattaattataatactactattacgtaataattagagtatacataaaaaaatattatatttgctatggttgcctggtatacactatttttaactgtggcgaattttttcattaattagtaaataatctgccttcctcttcaaaaatccacagtgcatcacaacatgcacaaattggctcttaatatatccgtttaacaatatagtcagtggggttttttaaaagcttttaatcagtgtagttgttaatcaaaaccacaagtagataagtactaaacgacatagcactcacttgatgctaagtaattaacctgcaatagaggttggtgtagcactaaatttttagccatcactacgtgcacctatatatatacatcttgccttgacacaacgcataaatacgcgacttcatgaggtttgggggaagaaccaacttctccatcccttcacttcagtttcctaagagaagagagtactgtgtgcaaggaggaagccagtgagaggggtcggattcacgccatgtgtgatctcatcggaataggacgcatcaggaacttgagcaaaagacggtgacaaccccaaagtacgaatagtgaatcgcccgctaagatgaaagctagcgaggacggcttgtctgttctgttccggttcctgttaagtgtgcaagcttgcatggttgagtggggaagccgtgttctctccagtgcatcaaagcgaggaaaacaacaacgagaaaggagaatgaaaaatcgtacagcaacttaccagacatcatcaccttgattacgatggagctcttgaaggcccctctcctttcttatttaagcatagatttattgtcttaggcttcatgtacttggatcgtcagctcgtcgccattgttcgcgaggacgttacaaatccgcgaaaggaagtaccatgctattctcctcttcatcttatcgatgtttggtggaacacgccccaatcagtacttaatccttatctgcgcttccttctaggtatgcgtgtgttgcgtatcgatcaggtgcccgtgtgctagcttcggtgcagcattccagcttactccttctgttccaaaaagattctaagggtttgttttgttcccaaacaaaaacttttcactatgtcacatcgaatgtttagaaacatgcagagtattaaatatagacaaaaaaataataattacacagattgcgtgtaaattacgagacgaatattttaagcctaattgctccatgatttgacaatgtggtgctacagtaaacatttactaatgacatattaattaggcttaataaatccgtctcgtagttttcaggcggaatctgtaatttgttttgctattagtctacgtttaatactttaaatatgtattcaaatatgtgacatgctaaaaattttcgttcgcgaactaaaacatgcctaatcttaggtttaaatctaggcatatacaccgtgtccagattcaaattcagattaagtatttctttaatagagggagtacggatgactggatttttcacattgtgatccttttaaaaaatttatttcgtaaatagacctctagaaaaacttatctcagaaatggtcctttttggggcgccagagtggctagcgccgtcgtccaacgagacggcgtcagcctatttggcgccgtcctccttccatcgtggcacacgcaaaccgatgtggcaggaggagggcgccaacatggctggcaccgccctagggaggagggcaccagcatggctggcgccgcccccctccccccacccctcgcctccattcctatttctctatatagagttgcaacctttttatttttgttttattttttcggatgttttttcgcacttaggatcatgatacaaccaaccactagagaaacaaaaaaaatttaaactcaaacggaatataccacttagctagatatccgaaaatagcataccacttagcctactttgcaccttcatcaaaattagaccataactcctttagtaaaaccctttgatcagcatataaacataatgcactctaccactatatgaaattacttaatctctaattcaaaatataaccacatgaaatgatagccataagttaaacagtacagagagatacagtttttttatttttttgatatttttttcacagttaggagaataaatgaaccaaccatagaaaaaataaactcaaatggacaaaatatgtgacttgtaaaattttccaaagctctaccgaaaagtcattcaggtgtcatttattaaaataggcgtaactttctcatacagactcggaatcaggcaaataatatatccacggacatctacagaaaaagttacatccgattctctcccgctttgccgggttcggcaatattaaaacctccaaattccgcttgcaagattgtgttttcgatgagagaagttt

SEQ ID NO: 12837 - DNA, 4649 bp, Oryza sativa
ggcgccgccagccactctggcatgctccccctagccacctcagcatcgccccgccatgtcggcagggggagggcgccagagtggctggtggcgccgtccaagcctctctggcgccctaaaaaggatcatttctggaataagtttttccatgtgactatttgcgaaataagtttttcaaaaggaccaaaatatgaaaaatccaggtacggatgatatgaccggccaactgtgccgcttctctcagtaacctggtttttgcattgtgaaccaatatgatcatgtatgggctctttttggtactgtagttcatgtgttggtattaccaaaattttggcatctaaatacacagatttttagaatggcaacgaagcgaataggcaaacgttacagatttattttggcaaattgcaaatctaaaaaatcagttattcacgcacttcttatgtttgttgagaaataagaaatatttctccccctttttttccccttctatttgctgctgatcaaggagaaaaaccagcaatgccaggccggagctttcaattgcacgacagtattactgtaaattaaaaaatcagttgcgaacacagttattctatttggtgggaaataaacggtcttatctatacttctttaaaaaaaaaagtagcagtggtgatgtgcggtgagtttgtcacttctatcaccaactccctaccttttcggaaagttaaaaaaaaaagagtatatatatgagatcaattatgaatacccacatcttgcctagagggcagaaccacccagttcaccattcgttcgcttcagtttcctaacatgaaagtatgcaaggaggaagctgatcgatataagaattcacaagaagtacatgatctcatcgatcggatcggaatgggacgcatcaggaagtcgagctgaaccacatcgcaatcacaaggtccaaacagtcaatcatctgcaaagatgaatgctaaattggacggcctgtatgttcagttccggttcccatcccgtgcaaacttgcagttcttgtggccgagcgaggaaggcgtgttctcttcagttcgtccgggcgaagaaacaggcagcagggagggatatgccagcagcaatatatcggagtgaactgtcatctgtggatgcagcatccacaaggtgcttccacaagttccacagcttttccttctcgcgtagtgggggtttggagttagtgagcacttcttttttccaatccctcgagaggacactgctggcgagctgtaccgaccataccagacctcaatccaaattaactcttaagtatgtgacagctcggatcaatatatcaattagaacacctgatacgaacgtcctaacgggtgattgatcgctgggcagaatcggtccccctcccccacatgatttccttgttaacatcattactttcctgttttagtaaatttatacatctaaattttatacacattaagtttacatatctaaagtttatatattaaattttgtacacttaaaaatttatagacctaaaagtttatatatccgatttaaatttgtatttagattcaaatatttttatatagaatatttatatacataaagtttatatgtgggaatttacggtacatatataagtataaagtctatgcacatgaataaaagatattagatttattttctatttttttaatttgttttttttaaagaattatagtgcaataagtagagaataaggggaggagccgtgttaatctagataatctagataataattgctagtatagtatatttacatgtaaagttttaggagttagtgatagcaactttatagcaagataggataatgtcaactactggaccatagcgaatctgcgaaccactggccggtcaattcaatcatctattattgcccatcgagtatgcaacgtttatctgccgcagcttctgcagttctgccggatggccgaagaaagaagttatccaaatattatcgatatagagataaaaaaagggaaatgctgcgcgtcgggcgaccgagcggccgaaaaaaaaaattggacgcctggaaccacgtgttgagtattttaaataactttaaaatgatttttctcctaaactaattatccaatctacgatccgatcatgccgttgtattcgttgaaattaaatctttataacaagaccacacatgattatattttgataaaaaaatattttagcttttttattgatatttttctaaaatgctgcatctggttctttagatgtttcaaccagtagttttacgttgtttcagctagtgtactcgtgatatttcactatatacggatcaaatgttgcagtggattttgatattatagaacgcgtcattgcaacaaatcactcacatattttggaaatcctctattaaggaaatttatttcttttttttgttccatcaaaaatgtttcacctaatgtactcacaatgtttcactatatatagatctaatgttgcaatgaactaaaacattccattgcaacaaaaaacccacatattttagaaaccccctattaagagaattcgtttcattttttgttccacagaaaaatgttgcacctagtgtacttataatgtttcactatgtatcaaatgttgcagtgaactgaaacattctttcgctatttgctgaaacattgtttttatataaggtgaaacaacacccgatttaaacgagtgaaacattttcgatatatttagtgcaacaattccgatatacctggtggaacatcgtgtaacatttaaaaataattcaataattaggtaaaaaaatttcgtcagaatatatcaatgtgtggtcttgttttgaagatttaattgcaacgaatttaatggtgcaatcggatcatgatttagataagtaatttaagagaaaaatcagttaaaaataagtttacacgtaaatcgggcgcaccccctcccgatcgggcgcccgacggggagtcgtgtccagataaaaaggtttcaagaaacattattgtcgctaaaattggttgtgcaatggagcgtacatccaaacaccacgcactataaccacacgaacacagaggacgttgagagtgcagactacaccaaaaatgaccgtcgctatgcgagtccgatcgacgatcgtcaccggttgatttgtccctctcagttgctagtgcgcacgttagttaggagacatgccaattgccaaagttgatgtcccttagccggacggctgctggtttttgcgttcttaagcaatgatcatgtatgcaaattggtatggccaaacttctatgggcatcaaaataatttcatcccgatcttaattttcgctgcaacttattagaaatacttatatttatatagacggatgaagtagccctcactacttaatcctgttgtgcaagtaactaaaatgattaactctacggttcaaaaatttattgtaaaatttagtactatgtatcaagaggtaccaaatttacagtagaaaaggtggtacatcatggtacctcctcaagaaccgtaaaattactcaactaaaataggacaaagtataatagtcctgaatttttcagcccccattttgtgtgcctgctcggccaccgcacacataaatacacgtgcgatgagaactgagtatagctcaagtggcgtgggagcgagggtattcgcgcagcccatctgagttcaaatcctgaacacagcgtgtttctcatagggttccttacaccctcttcctctctatacaaaagaatcaaagatagccagctccttccggttattcccatttttttttctttcaaaaaaactaaatacacgtgtgatagtgatatatatcttgcccagtcacgcccaccgcgtacgtaaatacgtgactgtcgtgtgggattggaggggcaagagctaaaacaagagcgtatatatgatcccttcagtttgctaggagaagagcgtgcgagaggaagccgcgagaatcgtgcaatctcacatcggaataggaagcatcatgaattcgagccgaaacgtgcatcgaatatcctgcacaatcaggtggtatgtacgttctcttctgctccccactccgtgcaaatgttcgaggcgtgttcttttcagttaagaaaagaaaatgaaaacgcaacaggaaagggagacccagcaacaacttgcaggagcaaacctgtctgtcctcccaactctgaggaatgaacatggaagctgtcacgctctgataaatccatcctaaattaaaaatcattctctaaaaggaataataaaattaattaaaattcgaagttaaattggtaaacattaaaatgcgtataagaaaaattttaatgtggcttggagtatttttcttaaattctccatgctctaaattggtccctcaatttttatttgaatattcagagcacaagaaataatttaaatgcaacaaaaaccaagtgcagagttaattaaaaatgaaaagctaaaaataattctctccttctctttgggccattttcggaccaaagtcctcctctccctcagcccgtgggcgaccctctctccctccttcctctcgggccgacctcctcccctcccttgctcggcccaactctctttcctctccctcggacaaagtccattcctagtccccctgc

SEQ ID NO: 12838 - DNA, 2740 bp, Oryza sativa
cagcgacatcctcttccccggcctcctctccgtttcgcccagaaggctgccgggagtgcatcctcatcggcaaccagtgcgccaccaccgtcgttctcctccagtcggccctcaccatcgaatcgagggacgccgcagcgcgccactgcctccaccggcgtcgcagccgcctcctcttcctcggcccaacctctatttctcctggagactgccggaaattcgtcctcaatggtgagcagtgatgacgtcgctttcatcctcgtcctccggcagccctccctcgtcgctagagtgccggctcgctgcaccgtcgctgccgtcggcttcatctcgtcgtcttcgtcgtcggccgcgcctcctcgctgcccgaagacccgtggaacgtcgccacgtcgcagtcgccttcctctggtcgccgttcccgccaagactaagtgctgcccgtcatcatcgtcgtcaagtccgcagcgccaagcccctcgtcgtccgcctcttcgtcaagcccgaggattgccagagccatcccctcgtcttcgacccgttcgtctccgtcgccttcctccgttcgtcgttgctgtgccaaggtcttcgccggtcgccatcgttgttcccttgccgcgtcgtgcccgtggtgagaaccctccccttcctgccctctcctcgtcctccccttgtggtcgccgcgtggattgcccatgtgtgcagctcacgtggtagtcccggctgccagtcgctctatcctttctctctcgagtgatgttacattgcacataatttaatggtataataataataattaaacaactcggaaatatccactttaattgcacttaaaattcggatggtcgtttctcggccatacaagctcctaattcactcgttaaattgtttaatttctgttataacttaaagaacccgtgtttattgtttttatgtgttgttattgtttctttcttagatttgtagccctgttttgttgttcgtgtagctgccgtcgtttcggaagttcccaaagtgcagatcaagtcgtctgaagactttctcttcgagcaaggcaagtcataccatatttcttgaacatattgaatcccattattgcaaaaactatgttgtttcacttctatatgcatcgcttttataaattatatgacgctcaccattgtttatttaatagttaatattccaatgttccttgttatatagccatgttgttgaattgctacccatgctcttgacaaccctagtaaaatgataaaatgactagtatgactccgtatatgatggacttactagttgcactaggttgagcttatctatgcttagatccaacatggaaaccctttttataaattagactgtgggtaataactaaaatattcaagattgatgatcaggtggctagctgagcctggacatgttggaatctcattcaaaactcccaaaacctgtttttggtggggcgcgaggtgcatggttttgttagaagcacctcggccactataaggaccagtcttcgggcctctgttgcgaagcataacagtgcaaccacaagtctaatgggtaaggcctgactagaagtctagatcatctcaaaacaaaggccatcggtatgataggtctggggctaggggaggccgactttgacctggcgcaagagggggcctgtctcgtcccgggggatccggcaacctttaccttatcgaggaccggcgggcggcgaaaccttagcgggtccttctgttttgggttgagctaggtggatagtcttgtcacgatcttgacttttcgggtacctttgaggtatcgcgatgcatggctgacatgaagtcaagtgtgtcttgtgggtaaaaatgtacacctctgatcggagtaaaactattcgaatagccgcgccctcggttatgggcaagcctagcaatgtacccaagttagtgtttttcttctgagtgatggttggaattcatggcactttggacaggtggttaacctggggtttaaggccggtttgcgtggtttcgcaatcgtgataatattggaccgagtttaaactatgctttaaaaacattaaaatattgcaactctggctttacgcaaaaatgaaccctattatgccaactctttgttcccctttgcactataattcatttcccggcatggcttgctgagtacgatggttgtactcattcttgctcaatctttcccccttcagtcagcgaaactatttgaagaatatgtcttaggtggagtcctggcttataccccagttaagtgcctgtgaagatggagccgtaggcccgctagtctgctgctgtttttcttttgttgtcgggcctaatgtgcctttgtaataatgtaaatattatcgtgataattaataaagatgtgtcttttgtatcaagtttgttgtggtgtacccctgcatttcctgcgacggggattaatacattagcgtttgggaaaggtattttccgggcgtgacaagttggtatcagagccatctcgactgtaggataagccaaacgaacaaaccctaaggacttatttgccaaacgaaaactatttgtcaaatttccattttccttcttccctatgctatttacaaagtgttcatctccccctcccttgcttggattcaacacataatagttgtgaagaaggaacctgcctccgaagttccccctctaagcaccaaggagtgaagatcctgaagaatcctataattgaacctaagctaccaaga

SEQ ID NO: 12839 - DNA, 6043 bp, Oryza sativa
gtcggtttcggtttcggggttgtttgtttggatatccgtgattatttcatgattatggcttctagatggatactatacgtatgtaatactgttgtttgctactaatgtgtcaagttggaattagcttggtctcggaatatggtttctttgtttatttcatgtgtaggtgactcgatgcctcgggagagtatttgcggtgatggaccgggagtcggcttggggataagacaacgtctgtggtggtcagagatcatgcgggatacttaggctagagttgatgcacgtggttgatggagattccatatggcatacgatggaggtattgtgtgcatatgggatgcggagtcaaatttggaaggagtccaaatttgatatgattggttatgaaaagtttgtttcttgtactagagagttttctaaggtgtttaggacttctagtatgagtttggttcgtggctttaggctacctacctcgggtataaatagagggggagcgtgaggcttcccggtatcgctttagagagcaattgagttgagttttgagttagggtttcgagtttagtcaaaatttttgtaaggagtgctattggtgcactttgtaaacacagagagaatcaataaagtcgtcatctactttaatagttcttcgatttgtgtttcaccaggtttcggcggtctaaccggcggctcaccggcggtcagaccggtggcatcgcggcggtcagaccggcggcgacaggagtcggcagcagatcatctcggcggttcaaccggagttcgatcgctgtcagatcaacgttcattaggcggtcagaccggcgcattcacttcggtcagaccgcgatccatcgaattcgaggtttacttttttttccgctaaaagttttcagtttttgggtataccaaccattcaccccccctggttggcttagttcttgtgattcgatcctacatatggtactgaattaattaagtcaccattctgggtactacccagcagagtttcccgtacctttggaataggggttgccttcaccctaacaataagcacggttaccgcgctaaccatggcaaacagtaagacaccgtataaaacttatcaaaaattcaaattatttttcaaaatttatttgaatttaatggagttatctcagttttaccttttatcgtacccggcaataaatgtgataaccacgataaccctgcagttatcgccggttttgtaaaccctgcctacccagccgcaacacataaatacgcgcgcgatatatatgtcgcccatgagccatgcccacgcacacataatctcgtgtgggatgattggagaggcagatcaaagagcgtaggatcacttcagtttgctaaattcgatcatgcacatcggaataggacgcatcatgaatccaagccgaagcatcccctttgtatccttcacaagcagcgatcgagaaccacggtaagatgaacgccaacgcaggtggcatatgtatgctggctcatgcttccctgtcagtgcaaacgtgcgaggcgtacgtgctcccttcagttcagcagaatgcagggaaactgcagagcgatggggagagcccagcagcagaaacagcagctagcgtgcctgagcaacctctcctccggacacaataacggcgtgaacgtggactacatcccctgtctactctctctgttttttaaaaaaaatcaatctgaactaatacttgtcccgactctagattctagattcatttttagaattgagtttctttttagactgagagtagcccgcaaggctgtatagtagcaaaagagctgtagcaaccacatctcaacccaaaactagcatgagtggagcgagcttagttccaaaactctatgtaaatccattaaaaattgtatacaaaattttaaaatatactctctccgtcctaaaatataagcatttttagactaatactgtggagattatgggtatcctatatctacacggcgatggtatttgaactgggtacaggatacttaatgtagatagaatatcttatctgtatctcgggtttgtttcttaacttgtgtatcaaggaaacaccctgagaattagtcggttacgactgtattttacctgtatcttcatattccgttaggaatatagattatcttttgtaacccggactccttcccatatataaggggggtccgggcgcctctaggggcatatgttgatttttcccgaatcatacaatcaataatacactcggcggattcatccccggacaggagtagggtattacttctttcataagaaggcctgaacctgtataaatcctttgtctccaaacccatacacttttctagcttgatagccaccccctttattattgccgaaatctagtttcgacagttggcgcgccaggtaggggtagcgtcaagcttttcgccgatcagtgcaatgggtcccttttccggcatcgacgacctcgtcttcccacccgggcaggcgtttcggttcggcagcctcgacttcatcaccaacaacttcggcaagatttctctcctcgactcggaatcagaccagtcgggagagaaccggctttcggtcccgtttggattcccgaacgcggctgaaagctatttcaagaccatctcagccgagtcggcttcaaaccactcggccgagatcgcatcttctccaacgacaccagatcaagatgacggggcttacccaccagtcctgatgaagctccccgacgatttagcggccatcttcaccacgacagcatcttcatcccgtaggcctaggcggaagtcggcttcaacaccgatttcgcctagcttcagggaagtcggcgtcatcctccaaccactcggcacggtttcgacggaccagctggaagactacaacagctctcccaccgtcgactcacgtcctactgacatcgtggagtacgacgagtttagttctcgctacaacgacttcgacgacttcgacgacttcgacggaagcctagatgacaattacacccctctctactttggcgttttcatggccaataatgagacggaggagcagcgccaagcccgggagaccgaagaacgtcgccgactggaggaggagcatcaagcacaagaacaagaacggctacggcgcgagcagcaggaccgtgagcggactgcgaaggaggctgaggatcgacgtcagcgagctttggaagcagggcgccgagcacgtgatctcatcggtcagcaagatgtcgaggggacaccggttttccgcacccctcaacagaatgcggttgccgcgatcacccttctcgacaccctcctcaaccaaaacgagctcaatcgttccgaccacgtcgtcaacatcttgaaccagacgaagaccatgattgcggcgacggtcccagttaactccgaaagcgtccacacgccgactggcagccgggtccctcacttccgatctcatgactaccgtcatccaagcctcagcatcactggagcaggatccaatcgcaggagcaggggccacgacgagcggtctgttcactcgcctcccgaacttcatagggagcgccgagtggaacggcctcgctcaccacctcgtcgccgccccatcgatcttcgcgacacaatcacacagcgccgagcagctcgaggctaccatcactcgccggatcgccgcgacgacgaccttgacggagttgctgccttcaccgacgacctgcgtcgagtggattggccagccggcttcaaaccgactggaatagagaagtacgacggtaccactaatccagaatcgtggcttaccgtctacggtctcgcaatccgcgcagcaggaggtgataacaaggctatggcgaactatctaccagtggctttagcggattccgcccgatcttggctccatggattgccccgtggtaccattggatcttgggccgaactacgcgaccacttcatcgccaacttccaaggcaccttcgagcgtcccggcacacaatatgatctttacaacgtcattcagaagtccggagaatcccttcgagattacatccggcgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagccgaaaaacacgccggctacgggaggaggtggaagtaacaatcataaggaccgcaagcgtaagcctgaggaacttgttgcaaccgctgctcactcttctcgacagcgttcgcgcgtcaacaccttcgacaagatcatgaactcccaatgcccgcatcatccaaactccaaccacgtggccaaagaatgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatatcttcggcggccccctggcttatgagtctaaacggaagcagaagttgactgaacgggagatcaatgctgttcagcccgacacgccccagtatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagactttggatgatatgcagatccctcgctccgagttaaaaccaagcaatgcgccttttcacggagtaattccaggattatccgcaactccactcggccagatcactctcccggtcacttttggcactcgggaaaacttccgcacagagaatatcagctttgaagttgccgatttcgagacagcataccatgccatactcggacgcccggcgttagccaagttcatggccgtcccgcactacacttacatgatgatgaagatgcctggtccccgtggagtcctatccctacggagcgatatcaagcaagctgtcacatgcgacaaggagagttgcgacatggcccaaacccgcgagatggcgtctgcccgagaggaaatctgactggctgcaaccacggtgagcgaaggagaagtgcccgctgccaagatttcaaaaagtggggaaaccgaagcccagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggcaaacccggttctagttcggaagaaaacagggcaatggcgcatgtgtgttgattataccgacctcaacaaatcttgccctaaagatcctttcgggttgcctcgcattgactaggtagttgattcaaccgccggctgcgagcttctcagttttttggattgctactcggggtatcatcagatccgactgaaggaatccgactgcttgaagacttcattcatcacgccctttggggcatattgctacgtcaccatgccgttcggactaaaaaacgcaggagcaacttatcaacgcatgattcagagatgcttctcaacacagatcggccgcaacgttgaagcctatgtggatgatgtagtcgtcaagaccaagcaaaagaatgatttaattttggattcggaagaacccttcgcgagcatccgcgcttac

SEQ ID NO: 12840 - DNA, 3520 bp, Oryza sativa
aggtcgtgagcacagtcttggttgtcgagcgtgaggaagaaggccatgtccagaaagttcagcgaccaatttacttcgtcagcgaggtcctggccgactccaaaacgaggtaccctcaggttcagaagctgttatatggtattttaattactaccaggaagctgtctcattactttcaaggtcactcggtaacggtggtcacatcattcccactcggtgatgtactacacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcgggcactggagctggagtggttttaatttccccgactggagaaagactaagttatgtgctttggatacacttttcggcgtctcacaacgtcgccgagtatgaagcgctccttcatgggctacggattgcaatttccctagggataaagcgtctaattgttcgaggtgattcacagctggttgtcaaccaagttatgaaagagtggtcctgcattgacgacaacatgatggcatatcgacaagaagtacgcaagctggaggataagttcgatggacttgagctcagccatgttcttcgacacaacaatgaagctgccgatagacttgcgaactttggatccaagcgcgaagcagcgccctctgatgtttttgtcgaacacctttatacgccgacggtacctcacaaagatgccactcaagttacgggtacccatgacgtcgctatggttgaagccgactggcgagagcccttcatacgatttttaacttctcaagagctccctcaagataaagatgaagccgagcggatttcaaggcggagcaaactttatgttatgcatgaatctgagttatacaagaaaagcccttcaggaattttgcaacgctgcgtatctttagaggaagggagacaattgctgaaagatatacattctgggatatgcggaaaccatgctgcagcgcgcaccattgttggcaaagcttaccggcagggttttttctggcctactgcagtgtccgacgccgacaaaattgtgcgcacatgtgaaggttgccaattttttgccagacaaattcatctaccagctcaagagttgcagactatcccgctgtcttggccgtttgcggtttgggggctcgacatggttggcccgtttaaaaaggcagtcggcggttacacgcacctcttcgtggccattgacaaattctccaagtggatcgaagctaagcctgttgtcacgattacagcagataatgctcgcgatttcttcatcaccattgtgcacagattcggagtacccaatcggatcatcactgataatggcacacaattcaccggcggagttttcaaagacttttgtgaagactttggaatcaagatttgctatgcctcagtagcacacccaatgagcaatggacaggtggagagggccaacggcatgatacttcaagggattaaagctcgagtttttgaccggctaaaaccctatgccggcaaatgggtgcaacagctgccatcagtactttggtctttgcgaactacacccagtcgggccacaggccagtcacattttttccttgtctacggggcagaagcaatgttgccgagtgaagtcgagttcgaattctttggcttccgtaatttccgtgaagaacgctatgaagaagaccgagtggacgacttgcatcgactggaagaggtccgcgaagcagctttgattcagtcagctcggtacttacaagggttgcggcgttatcataatcgcaatgttcgatctcgtgcctttctagtcggcgacctggttttacggaaaattcaaaccacacgagatcggcacaagttatctcctctatgggaagggccatttattatctctgaggttacccggccaggttcataccgactcaagcgcgaagacggcactctcgtcgacaattcttggaacattgaacatcttcgtcgtttctacgcttaactttatcattgtatttccctattttgactgtcaaacatcaagttttctccttgaagttgtcagtcgggggctatcatcataataatggagtgtgattttttatcaattcagtttgcttacttggtttatcattgccttgtttggtttttctacttagtttgagaggactgaaagtttttaatagcttctttgggttttaggctcaacaaagcttagcaaaaacttttaagaaatcaaaaactttgcaagaatcatcaagcacagcataaatacaccagtattgtacaaattgagcctccatgtattacatctacactcagtcagagtcagtcctttcatcatcagagtcatcattactcggctggaggtcgttgttgcgaaattgctccacaacatcactcgctattttgtcagccgcagtttgcgcactactgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgagtgtactcggaccaccattattgaggaacatggcttggataattggtgcagcggcattggcgacatcatctcttgctccttctagcctcttgatcttaccaaccaggacgtcgaattgagcttgagacttgatcttgcggtctacaaaacatatttatggtgagaatctgctgcattgaaaagagacaagttcaggccaatagctggcagtaccttcaacttccttcaaggccgagtccctctgcgcagccagttctacattgtctctctccagggcttcaacttgctttttcatttgttccattctggcggcttgcgctgtttgaaatccagttggttgaggatacagttatgttggcctaaatcaatggaacatatctggatgattaccttttgatgaaccacttagttcgaagtttgcatcctggagctgggcgattcggtcccttaactctttctctgtctttttggcgcactccttggcctcatgcagctggtccctaactgcttctcgagttcccaaatgaggaaccagcttttccaaagttgtggtcttggcttcattgcgaagatggattctctgcatgatggatcatagttcagttctgctaaaaagaaaaacaaagttacaggaggccgtcacttggaagacttacgtttacaatacgagtggcttctccgagcgctttcttcagctggcacacttcttcatcttctttttgacggattatgactatgccggcggcttgtgagttctcgtcccaccatttgatcaa

SEQ ID NO: 12841 - DNA, 11186 bp, Oryza sativa
tgaggttattgaaatcaccgttgtatgagaagacaactaacctgaagatgtacttagctgagcgtgaggtgatctttgttccttgcctggagatccagctatcgagtcattaccagcttctggcccttgggaagctgtcgtctgcgcttctacttcagggatttcttgatcagggcctgcgtccgactggtttccagtcgggggctcttgagttgttgctgcttcagttgttgccgactggtttccagtcggcggctggtcactcggattggcctggtcacccgaagcatgggcgccggtcggctggcttttggcagtcggctggctttcggcagtgggctcggggtctttggatatattttgctctgccatggctggatcggggtcttttccagatggatctatatcagatggtttcctgcaaagtattctttcagaatttagcatcattttcatgagagagcttaccaaagtgaaatcataccgagaggtcttatacctggaagatgttctaatttttagcattgcgcggccggccagtttttttctgggcatggtgcgctttgggggtttattaggcgagcccttatccccagatttatcatcgtcgccttcatcgtcatcaagcaccagtttcctcttgcgaggacccgtctgaccagttgatttggaggtctgaggctgcggatctggtctgatcgttggccctccacctccctgagcagtgtgttggcgaggagaccggcgctgagtgactggtggatctgacttcatcagtgcatattcctgaacaagatgcttccatagttagtcaattcagcatgaagacgaaattatgttctgatcatagtttgaagatttccgatacatacctgcggaggcggattgaatgcattatatggcacgactggcagctggtgtgagtagctgacgacgattgcatttgagaagattttatacatcctctccttcatgattctgaaatccagagagtctgattcttcacggttaggatcatacttgccgtcgaactcgaatgccgtgcgagatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttggtacactggaggaagacaagagtacccgggaagagcaggctcgggattctggacatagaaccagtttgcatgccatcctttgttcgaagtcttgaagggcatcgagaaatatttttgactcagagttccccttagttggaatcctgcccccccgactacacacggtttgttcttgtttggttggggcttgaggaagaagatccggcggaatagggcaaagtgaggtttgatccccaaaaaggcttcacaagcatggacaaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaggcctcaccgtgcgctggtcgccacccgatgatctccttggcagggagaacgccgtgcgccaccatctccttaagattctcctccgttacatcggatgacgcccattggccttcgaagctttctctctcttccgccatcaatttcactcaaatgtgctgatttgatttgagggatggcttgggagaggtgagggattgaggcagtggatcacgggaaggattttgatgcacttttcggaggtggatttggccggagttgtgaaccctagttcgccggcgcagctttgcactgtagcaaggaatggggaaaatggcgagcgttccggcggggaagacgaggcgtcgcttggatttcgggttttattgttaagggtatcggaagtgctaatgggcctaggcctgaacagtacttcagcccaatacttttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgttatgctgtttttgcaagctcttttaggctacaaaagctgtttgggttaactagggatgacttgtttttattatagtcatttccttggcatgttatatgcctgttttcatggtaaatagtcatggcctaggctattcgacttatttattaccataatctttataatacttgatgggtaatctttagagtttttatattcggatgcctgtcgagtgtgttcattcgtgaaccttttagagtgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtacttggattatcatctttgagaaggctatgatggtcgactgcaaaggactcgggggctactgtggagattatgggtatcctatatctacacggcgatggtatttgaactgggtacaggatacttaatgtagatagaatatcttatctgtatctcgggtttgtttcttaacttgtgtatcaaggaaacaccctgagaattagtcggttacgactgtattttacctgtatcttcatattccgttaggaatatagattatcttttgtaacccggactccttcccatatataaggggggtccgggcgcctctaggggcatatgttgatttttcccgaatcatacaatcaataatacactcggcggattcatccccggacaggagtagggtattacttctttcataagaaggcctgaacctgtataaatcctttgtctccaaacccatacacttttctagcttgatagccaccccctttattattgccgaaatctagtttcgacaaataccaagtcaatttttttaaattttaactactgatagcaaaaaatttaaaaaatcaatcatgtaatttgatgtactagttttatcattaaacaaactatcataacatatcatttaactatttttattaaaacatcttacttttgctgatattattggtcaaagtagtatctcgaaaaccgtcttgaagtctaaaaatacttatattttgggacggaggaagtactttagtttctaactagaatcaccaaattcagtcctagacttataatttactacctccgtcccaaaatatagcaacgtctagatacattgtcttaggatggatcttattccatactagactgctatattctgagacggagggagtatgtttttctccgccgctgcacactgggaagtaatcatgtggtagatcatcggttgatcctcctcaaaccgtacattctagagaacgtctcgaatatgtgaaagcaagaactgtcatcctcctctttgattggtcactcacggcaggtcaattcaatcatctttcgttcggaattcggaattgatcccgtactccctccgttccaaaaaaaaaacttaatctagtacacgttccaaccaatactagattaagtttttttttggacggagagagtatgcaactcttatcaaaaatatatactctaaacagcaaatttcagaatggcaaccaaatgaacagcaaaattttagcaaacattgtttcttttcttgaggaatattgtaatcacatatttgtagtcgaataaagtactagcagtgttcaccctcaaaattttagcaaattactacaagtctgaaaaaaaaatatcaatttttcacacttcttatgtttgttgagaaattagcaacattttcccttttcttctgtgcctgctgatcaataagcaatgctaagctggcttcttcacacttcactcatacagcaacatgtttcttttcttttgtattctttttcttgctgctcctcggttacttcaaaaaaatagcacccctgcaacaaaagaagtaaaaaaaggaaaagcaccacgcagagacacacacaaacacaagccgaccatacttctcccagttagctttagtttccctgcttctctcatttcctgctcctcttttgctttcccctatcgcttcagatgattcatgcgtcataccatgcagtgcagatttttttttctcttttttttttgttgaggaatttcacttttgatgaatagtaacatttgatgcagtgaaattgcaaaacaacaatgaattgttcacacacacacacacacgaactgagttgaatatacatcatcgaacagcttgtcaggttggccgctctgaagtctgaacctatactgacaataagaacagaagggactcttggcaagagaatgatggccaattcggcatctctggcttcttaattacacacaagaaaaaagggaaagaaagaaagaaaaaagaggaatcaccatagattcaaatcaaatcatggaagaatatgcgaaagattggtcaaaaaaatggcagatttcttgagagggaagattgcaacttttgtacatacccccactaccaaaatcctcttcagtaaaggagaagctagctacctctttgcacaaagccaatgatcctccatcttatgcattgccggtagagctggctagtgcacatcatatagctccttcagtctcatccagatgctcactggaagaagggctttcttcttcttctccggctagtctctccgccgcggcgcaaccgtcgtcttcccggcacgcctgaaaagccacatttctgtcagccatggagctttggtaaccaacctagcagaaggtgagttgaaagcttttcatgtaagtttgaacctaatgtgcttaatatttgaaaattttaattgttgatgttcagaaccatggccctcttacttactgacctgtgagacccactgacaaatgctgatatgctgttcttttgttttgttatatatgtggtgacaatagtactgtgttgccaatcatttgtctgagatgcttatcttagttggtttcagataaactaaacaaaagcagggagcagagatgatgaggacatattgttccagtagtggaagcttagatgcctcaaatactaataacataaatgggctgctattgattatgtgtaaataaataaatcatcaccctacttgctaaaactaatatttgttatttattataggtgtaaatcattttgtgttttactttgatttcttatgcattttgttagtttgtttctgaacaaacatatgcaatgtacattgcatgcctgaactgacaacgagcagagcagagtagtcgtcagacagcatgagcagagtatcaaggaatgttcatgcatggcacagtcgtccattccaagccattttggtccatgtttctactcgaatttagtactcgaaatgccataaaatttctgaagaaaaaagaaaatgcagggtatgagtcgtatgactgaacagcaatgcatgcatgatgcatcaacgaacctgttgtgaatagggtcaggccccttggggatcctcctcttgctgcctctgaactcgtctgcaccggccgagtacctcgccggcgaccccgccgtcaactccgtccacctcccgccgccgccgccgccagcggccgcagcactcgtacccttcacagcatccatcgtcgttgtcgtcgccaccaagacgcagacgcagaagaagaagaagaagaagaagaagacaagaactatcctgcagcacgccattgcccttagcaacctctctgaccgccgcctgattcccatatagaaacaagaggagacaagacccttcttcttcttcttcttatcgacttatctcaattctctcctcgatctcaaggaagaaggaatggcatgtcgtgtcgttgagctgtaggagaagcagagagccaagagccaagccaaggtgtatgaagctaccagacagtgttcagagaagagaagagaagttcagagagaggatgtatgatgatgatgacaacgacaatgacaacaacactgacaaatgccaaggaatgtaaggaagcatgacacgatcttaattaggagaggagtacagtgcaacactgataaattgctcagctaatgcggcttttcatgggggtggatttgaggtgatgggaatctgtgattcttatcccctctcctgctgcaacgcatggatggatgcttgcttcggtttttcttcgcttctttcttttttttctctcttctcattcgctttgcgtctctttgcgtgatatgctttgctttgggtggtgatggttgctttctttctctcgctgctgctgctgctgctgctgctgctcgcgtcttccccagctagctatagctttgctctttgttctttgcctttgcgagagagggggttcaaagcaaatctgccgcgcttttgtaggaccaagcatgggggatagtgagctgagcaacgtgagttgagtgagtgtttgaatctcctgaagatgaagataaagatgaagattaagattaagattaagtgttttacgcaaaacaaggtgataataacgtgtgattaattgagtttcaattattacaaacttgaaaaatggattagtatagaaagttttcgcacgaaacgcaccgtttagcagtttgaaaagcgtgccacgagtatccaaaatttaatcttgcttgcagaagaaacgaacagggctgagtgttgcttcagttttgagctctcctctctttggaactttgtgggtcctctctccatctttttgcattgctagcttcttcttcttcttccggcctcctttcacactctctgcccacacacccacggaatctctcctaagcttcttgatttcctttcttttctttgtttctttctttctagttcgagattttttcttgagcaattttacggtccttgaggaggtactatgaggtaccactttttctattgtaaatttaatatctcttagtacctaggtactatgaggtaccaaattttacactaaatttttggtacctcatggtacctcgtaaaggaccgtagaattgctcttttttctttatacggacggactttgtttatggatggttcttgcttgtggccatggatcccacatgtcgtggtttcttggtgccatcggcttggatgtgcgtcgatattcgtgcgcaatttcgaatgaggtcattaattgatactccctccatcccataatacgagataattttagagggatatgacacatgacaatactcggtagaatatatcgcatcccttcaaaatctcttatatatgggacgtagagagtagattattgttgtctatataatcttctctttcatctttctcttcccttcccttccaccataaaattctactagtatatatgacacctgctcttagatgtaacattacaatattattgatgccctgatatggtaggattaaaatggccgaaaatgatattatttttacggaaatggtatagctaggattatttttatatttttaaatgtaactcgatattttttttcttttttattaatgtaggattttcaacttttgataggacgttgtggctaccttttctattaatttaagataatgatgtatagataaattttgattgtgcctcccaactcatcatgtgctagttcttacaaccggatatattacccatataaaatgccggaaatttggccatgttgttttctatctctaaataaattaacagagttgttgtaggatccatgttctatctgaaaaatataatatgaagtattcctacgacctctcacaaaacacgcgaacgggtccttgtaaaatttgagcataatttatttaaggggcaagtgagactaacatcaattttgtcagtgacccactaactgcagaacacaagacaaggacaaggagcacaagctctgtagaggaacactaaaaaaacgagatttctccaaacatttttttctaaattgtgagtatgttgagaattgaacacggtatttttgaggttgaaaccacacgctccatatcactgtactaaggatatctctgaaagggaaacacttaaaaaaaataagcattaatatggcccatatatatgaagtgtccaaagaaggaagaacaaagcagttagcagataacaggtaggcccaagtacatgagttcaaaacaaggtattgtccaaaatttgaaggaataattgtacttgcacacaatcatttcgcttcttccgctcacttttactttcttttttttattcccctttcgacagtcacctctttggcttactgacaaaggatcgaattatgagagagattatgccaaattaagaataaatgcctttttaatccaaaactggtagaaaagagattgcccacttcactggcattttgtccttaaatggctcatcaaccaaaccaaatcaataaagtacaagaacattcaattgacagagcttgagaggttgtaaaaaaacaattcatttcaagtcactcagcttgtaacagtcctcatcaaatcaacctttcttacgacataaagactctcattgccaaaaattccttccaactattgtatatgagttagacaaagttctaaactaactattatctctgttctcaaattaattatgttttgcatatttgtaataaaaaattaataagatttattatggaaaactggcataaaaaaatttccatggaaaatactactatacgttacattgattaaaaaattgttacagtcaaagatgaagatgcaggaacgtggaagtaaataaaacaaaaaagttagaatcacggccaatctattccggcctcatctttttcgcttatgcttatactctctccgtacttataaaggaagtcgtttaggacaatgtttaagtcaaaccttgggaatataaatcatgaataactctcaagttattgagtttgaaaatgtaaaaattatatgaatagattggtcttgaaaaatattttcataaaagtatacacacatcactttttaataaatatttttatataaataagaagtcaaaattatgttttggagaccgtgtcgctgtcctaaacgatttcctttacgagtacggagggagtacttatcagacaaaatttaaattttcaaccttaaatttggagttgtttttgactttttcatcgaagtttatttttcagcctttgtttttagaacgctaagaacatgtgtataaaagttttattcacaaattacttttcgtttgtaaatatgccgtttgacttattccacaaataagcgaaacgatgaagccgttcatatcttttacacttttactgagattttgagattttgtgtgatcacatagatgagcgtgcgtatgtatgaacaccagtatttgtacagtattcaaaataaacctacatcaaaacactttatatatagtgcatttaagcatgcatccacccactttaattagcctttagctaagccatcaaacgtgcaggttggcagcagagagggcttttttatttttttctcttgctccgagagatttttccgaaagagcccctgcactttcctcctttcccagacgacgacggaaagtccccagtcaaatacggccgtctttagcttcactcaactcgatcgctacctcgtgtaatctactcattgctaccattcatccatgtttttttgttgagatagatttagagatcctttagtaaaaagagcgtatatcctgcaggcagatgcatgtgatccatctatacgaatcaggtgtctttttttttctttcaatctacgtactttgagatgaagacgatgatgatgatgaatgaatgaatctagcctggttattccaatcttttgttaaaagagtagatggccgtatatacccttgatctggcatctctgcacgtatgtgtacctcgatccgggagcgtatagatgctctgtaaaaacatgcccttttttcttgatgcaaagtttatgacagattatgggatggaattaattaatttctttgaagtatatgagagcaaattttatagaagattaggtggtcgtcgcctctaattttatccatctaaacttgtgcattaatacattatctctaaattagctctaccacgccaatctcaatagtttattttatttgtttgcctaattcactcttcatttttctccttttttttcgagtttgtgcagaggcttgcattctctttttttttctctccttcactttattatattagtttatgtgatattttagggcaagtgtacagtaggttatacacttgtggtacttgctctgagattcgccgtttgatcttcggcacaacttcttcaaagtgcaaagcattgttgaacgatgtgcgtttgcgtgattggttggttaggaattttgtgtcgtgtctcaaagtgagagacgaatgatcaggtcacaggctcaagcacagtagtccaccttggtgtcttcgcatccggtttttgtaccgtccatccaatttgcttcagcctgattcatagtagtactcctaaccaaaacccagctacttatgctatactgatcagtgattggattaagttatcaccgagtggagaacattgtagcacaatacaaaattacagttaatactgctagtgcatgttcagatttatagtcaagaccccttacatttaaggacaaagggagtagtaatgtgatggaatcaaaccactctatagaaatgtttatgaaaaaatctgtatatatttagatgagatcgcattgacagaagatttatcctactcaaacgagcatatgaagatggcaactataaatctggaaaaaaaaattgaaagattgttataaaattattataagagttcaagattagagaaatgaaacaaactaatctcctgaaacagattttctatggatattaaggagagttgaaattcaatgaaagact

SEQ ID NO: 12842 - DNA, 1761 bp, Oryza sativa
tcgcttatcatgggtgcaaattgctaggactcataaccttcctgacgagcaactattttctagtggatggatatgtgtgccgccaactgttctatgagaagccaattctcgttatcgaagccatggtcggctagaaatgctctaccttagcggcaaaggcaattgtttccaatgaaggtgactagctgctgagaggaaattgcagatgaaacaacaaaggacaaggggatactcgcaaaggagacatgatgtctatgaccaaatccgaccctagcctgcacgaaggagggagacaaggtagggggagatagggaagagaacgaatgtcggacgagataaatgatgataggagataatgatgtggagcacagagccgtagaccggctagaactcatcgggtgtcatcggcaagctacgtcgcctaagcaccttcaagccctctcctagcaccagttttaaggtccaggtgatagcaaatgtgaaaaaatgttaaggcaaggaagaaagagaaagggagaaagaggactaagaagatggatagagaggaccttacaggaggtggggctgccgtcagctatggcaaagggtaggtattagggttaagactcaggagggtcctcgcttctcaggtcattcggaggagcaagataccatgaacaattgctatgattggttgatataaataaatatgcaaaatctaaatcgagagcactctcgatttagtcataacgagcgacccccatcagcattatctagatatgtgttaacttaaagaatcttactttactatagtactaatccattaagtaagtagggaaaatattcctatcatctatgcttcaaataaattttctcttaaattactcatccgatttacaatccaattacaccgttgtgttcgtaacaattaaatctttacaacaagatcttacatgattatattttgataaaaaatcacaaattacttttatgatatgtctaaattacttttagacttcactaagttacttcttaaacatataaaagtaaattcagtaaaatctaaaagtaatttacatatattatagaagtaacttagaacaaaaaaaagtaactttggcatgtcatttgaaataaatccgttgtagagataaaaatatgactctatctagaaattaatttaatcagcacaaattatgaaattaagtaaaaacaataataaaaataatcacctcagagcattatgaatgtataggaagtattttaataaaatctaaaagtaacttttatatatatatatatatatgataattcgtttaatgaaaaagacattaattaaagttaccttcgttttgttctaagttacttatataatatatgtaaattatttttactctttattgaatttacttttatatgtctaataagtaatttagtgaaatctaaaagtaatttagatatattataaagtaaattattatttttcataaaaatataatcatgtgagatcttgttataaagatttaattgttacgaacacaacggcgtaatcggatcgtagatcagataagtagtttaagagaaaattgtattcgaagtatatgtagatagtgtctctcatggatggagtggtagctaccgccagtgtgtagtcatgtccaaataaatatggtaaaccgtgaaaatttactataatataaaatcttaaatgttagaattaccaaagttttacaaaagaaagcaatattacctctaaactaatgcacgtcaagggctgcagga

SEQ ID NO: 12843 - DNA, 2106 bp, Oryza sativa
  unsure (1)..(2106): unsure at all n locations
aaaacaacttcgtttcgatgaatcagcttgtcgataaggatccggagaacagccatcgtgtggttctggaaggcgatcaactccagggacaaggtggatagtgccctgaaggacatggctgtggtgatgaagcagcaggatcgcgccaaggaggcgatagaagccatcagatcattcaggcacctctgctcaaggcaggctcaggagtcccttgacaaccttctgatcgacctctacaaggtgtgtttcgttctagttctacctgcatatctcacaaaattactaacaaaatgattgctgcggtgtactgacaatatgcgggatttcattttcagaaatgtggcaaagtcgatgaacagatcgatctactgaaacagaagctgaagatgatataccttggagaggccttcaacgggaaggcgaccaagacagcacgttcccatgggaaaaagttccaggtctctatccagcaggagacttctcgcattctggtacagattaccgctccccctgttactcctactgattggtaatttggcatgtcaatgctgcattcagttacactcgaagttactgaaaccttcttgtgtgcatattacagggcaatcttggctgggcttacatgcagcagagcaactattcagccgctgaattggtgtatcgcaaggcgcaaagcattgagcctgatgccaatagggcatgcaaccttgggctgtgcctaattaagcagagcaggcatgatgaagcaagacaagtacttcatgatgttgtgcnnnnnnnnnnnnnnnnnnnnnaagatgacaaggtggtagcccgagctaagcagcttctccatgaacttgagccggtgacgcatgttacgtcgccaaataatgctgggctgagtgtcagtgaagagatcatggagagactagaccttgtgttgaacgaatggacgccgttcaggtcaaggaggctgccggtatttgaggagatagctaccttaagggaccaaattgcttgttgatccctttattcgcaaggtttttgttcttttgcttaatgtgcatacgggtgcgttgccttagaaattcatgtgcatatgtagaggctgttgtgggcttgtggcagtgcgagtaatggagtaaaggttgtgatgttcagatagatatcatatagctagagatcatgcaaagcatccaaggaatagtgtattttgtcttcatgttctatgatgcttataatgtgttgtaaacattctacagactacaagaaatccaagtgtacacttcacttggcttgttggaatcaaaaactggaagactgaaatggtttggtttcaagtttgcagcacaaaatgtctctttctctgaagtaaaaatgaaaatcttcgctatggaatgcagagttggtcctagagatgtatacttccgttatcctttttttaaaaatactaatacaaagttgaaaggaaacaaaatgatggggaaaacaaaaatcagtcagatcatatcagacaagcatttccagttcgaactggcctgtttagttccaaagtttttttctaaactaccaactttccatcgcatcaaacctttcatacacacataactattctatcacatcgtaccaatttcaatcaaacttccaaacttcagtgtgaactaaacacatcagtgtgaattactaacaacagagagcagcatacatcaaagtatcaaacagccaaacaccatctatattccgtgacagaaaggcacccaagaattggatgactaaaagaaattgcagtattattcatgaacaaactccaacattaatattcacaaattgagtatttgctttctttctgatgtttctgtcactacaccatttcttttcaagctaatagtaactgtacaaatctacttccccatgtcagagaacagagcaaaagtaagttccatcctagatgagtgaaaactcacaacaggtacaagaatgtgttaagttctgaacccagaaaattcgcgtgtcagagcactgaactactttccatttcttcaaacactgatgcgtgccgaatgcccatttccaaatggaaaattaaagagccctcgccactgcagatacagaatttacacaagg

SEQ ID NO: 12844 - DNA, 3273 bp, Oryza sativa
aaaaagttcataaaacttgcacctctggaggagtgcaagaccaggactaactccatgtctctgttgccgggggggaggtcgaggcgaccgggaacagccccggcggcggcgcggcgcacctcctgcggcagacgacgaagtcctcccggcgcgcctcctcctccagccgccggcgcagcgccgcgaggctctgctccttgaacgtgaagtacctccacgtcccctggtcgaagtcgtccacgcggccgtcgtctctcgccgtgttgtagaagatcgtccgcgccaccagcgcgcccggcgccgcctcgctcggcggctcctcctcctcctccccctcctccggcggcggcggcggcttcaccaccttcaattcctagagaaagagagatcccatttgcaattcaattattcaagaattcaagattatgcacatctcagcttaagaattcaagatggaagaaagccaagcaccttggcggaatagaatctgacgaaagcagtagtgaacgccgtgtcgggctccgacgtggcggcctcgaggcgggcgtcgcaggacagggcgcggcagcgcggcggcggcgcctccgattccgggacgacctcgacgacccaggagctctcctcgggggcggcgtcgcggtcgacggtgacggcgttctcccgcggcgtgagcccgaacctggcgcggaggaggcggccgtagagccccgtgagcgtgaggtgttccccctcgcggcgcggcgtccacaggaaggcgccgtcgttggggctgggcggcgagcccgcctggatgacccagcagcacgccgcggagccgcggcagccgccgtcgagcgcggcggggagctcggtggcgcagaggtagaggccccggtgtccctgcagcctgacgtagtcgtcgccggaggtctccacggcccagacggtgccccggcagttgcggcggtagccgtgggtgacggcctccccgccgccgccgccgccgtcgtccgccgcgcagaggtacgtgcccaggtggctcctgagccgcaccgacctcgcgttctcgaagacctccattgctgccgcggggccaagaaaccaagaaccgcttcttgatttggagagacgggtttgggcgggaggaggaagacgaggctagttgggggggtattattgtccttggcaattccaaccttaacggcttccgattgtggtaaaccgactacgtggcactttatggggcgttgggatctaggatcaacggctcagattcggcacaatttaggtatctcacgcttcagtgcttcaccgccatcatcatttatcagcaagtacatgagaccatttcctgttacttgtgactgcacgctaaggttttgttcggtttggaaggggttaaaggggattgaaggggtttaagggaaaataattccacaccacaatagatgtggaataaatcccctacaatccctctctcttgggattaaccgaatatagcctaaggaggattactcgtgccactttgttttcgaactctccattcctacatttcaggggaaatttgccaaatacttcgatattaaatttatttatttatagtaagtactcaaagtgctcaatttctcttcgtgtttggggtgtattttaggcccatttatagcagtggagtaagttccactttaactccctcaaatatacatctaatctaattcatatccatcaatagtaatactagatatcttgaactcctaacaaataaaatcggtacaaaatgatttcctcggtggttttaagggtggtttccactagcgtggctcgtttactagtccaaacatcgagtcagcatgtgatgcccgtcaatgggctgtaaccaaataggatatttgtagagtatgagaatcattggtgccagggtatacgcgagtttgaggtaaaagagataggaggcatggatttttatacatgttcaacctccttacctgatagacaatagccctactcccgttggctaaatctagtgttttatatatcagtaccatatatagtacaatatctgggatgacctaatctagtcgctgctgacctaaatagtccttgtagcatccgagtagaactatatttctcctttcttatccggaatatcttccgtatacgaggcatgattccgtataagactataatagttggtgtatggtgagcctcactttgcttaatacaaaagtattgggtatgccttatctataacactgacaacgcccacctgtcatcatctctctcttattcccttcctcctccctctctctctcccattccctttctccttctcgacagtggcggtaggatgagaggagcgccagaggagttgttttacaccagttttaatagttagagaatgtcaagatacccggttttatgaatcagattcgacctatacattaagggactcatagtggaccttttcctctagcaagcttccttccagcacttgatcggcccaacccaatcacacgtgggccccacccccgcagctgcccttgcgccgcttaccagtcccactcattcacatccctacccaaactgtaattacagacaactcgaggggggcatctgcaaaataccactactctccgtctcctccttggtccaagggttaaaaatccctcgtcctcgaggtagtcgcgacctctctctcctccgtctctccattccccactcgctctcgcctctcccccctcctccccaccatggcggtgaaggggaagggcaaggcggtggcctccgcgtccgcatccggcggcggggtcaagcggcggaagggccccggcgacgcggcggggccctcttcctcctcctcggcggccgcggaggccgccaagcgccgccgccggtctggggtcctccagttcttcgacgacgccgccttcgtcggggacgaggaggaggatgaggatgaggaggaggaggaggaggaggagatgttcgcgtccgacggcgacgacgacggtacggatcgcctcccggttccctggacgacgacgagttggggctgctctcgcgggcgggttgggttggtttggggtttggggggtatatgagcaatgcggcttctattgggtcagtcgcttgttggggatttgatttactacatgtgttgttgtattggttggttggatttgtggtgcttgggggtttcagtgctgtgtcccaaaatctcgcatgttgaaactagggtttggatgagcacttaagaggttgagaggtgttgatgcatatggaagtgtttgggtgagg

SEQ ID NO: 12845 - DNA, 3210 bp, Oryza sativa
gttttgaatggagacacagcttacaggtttcttagtaagtggctcggtgagtgagccactttctctggagcgattcgatggtcagtggtagagtagagtctgggaggacttcgtcctgttgcttctcctttcgtttgaatccatcttgttagaagtttttgttggccttagaccagacagaatattgggcaaaaaacaatttgtttgtgcctgtgaacttgccattgttctactgtaagagcaaatgttttttttttatctgaaggattaaagaaccaaggaatctataatgtccacaattgttttcattttttgccattttggtgcatggtgaggtaagttaatgcttcccttttctgttctttttttttccttcaatcattggtatggtgctgcattttcatacttaggatgacagtgtcaatctttaattttttaccatttgatcttttgcctatgttaggactgattattctggctacttggctagaagatattgctgtattttacacttaatgttcatagtaattaccaggacgatgcatgttattgcacttgaaatggcactagtgagcaatttatcctgcagcttttggccattggcatcttaaaatgttattattgcctgattattctttgaatcttctgttgatgcaatcttgttcattaactgcaggtttcttcaccgagggaaaggcagaaaatgttaacttaaaaagaactgaaaggtccaccctcttccgtttcttgggatagttaaggaagaggagctgagtggtgatgaacttgaagaatttatcaaggatcgttattcaagtcgagtgaaacacaccccttttgatggctccaccaatgtacaggatgacgagtttaccgaggatggtctattgaaagagccagtaatttggaggatcaaatgcatggtttgtgatttactagtctttgaccttacattgttaatctagtatttggctgcaaggttctgatttgtttggctgcatttcaggttgggcgtgagcgccaaattgctttctgcctcatgcaaaagtatgttgatctgcaaaagtttggtaccaaagttccaattatctcagcatttgcacttgatcatgtgagaggatttgtttttgttgaagctgagaaggcctgtgatgttacagaggtacatgatttgtggcttccattgtaaaaagatacccacattgaggagagcaagtcaaatacagtagatgtaatcatttattcattgcattatgtggtttgatatcatgctctgtgaagggttgagaacttattcttttatctgctactcctacttaaattagcactgtcttctttttgccatttctcacacacttcaattcaattcactcttttgtgtaacataataatttgaggtttggaactgaaataggctttacatgtgtagttctgttactaaaatcatagtttctatgataatctaggaaaaagttgtttgctcaaagatttcttcctgtcctgcttgtaatctgacctactgaacatttgcatttcttactacaggcatgcaaaggattttgcagtgtttacataagcagaattaattctgttcctgtagctgaagttcctagcttgctatcaagccgcgcaaaaccatttgcaatatctccaggtacatgggtgcgcatgaagactggaatttataaaggagatctagcacaggtatgtttaactcagcttcttacttttctgggcccccaacccttttacatatcgtcacatttttttgttcttacatcactacacccctgtgaatttgtaggttgttagtgcagatgaggggcgaaaacgggtgatgatcaagcttatacccagagttgatctccgggctatttcaaaaaaaattgtaattctcttatgccctctttctgtattatatttatttttggcagtaaatgatgcctctcatttttagttggtttcatttaagttgtactgacttatctatatcaatgtataataccccaagtagctttgtgaaagtcttgtgaaactctaactaagctaattacattatatattgcctgtacctgttgaaattcttacatttccaatgatgggtatgtacctcgtcctttttccccctggtggtggggtggttaggttggagcttcatctttgtcagagaaacttcacatgtcattgttgttttttggtacactggataatgtgacattccagtgaaaccatgtggtgtctattgcgtatttccattttgctcaactgtagtatcatggcttgggtggcttatattatactgttgtttttatctttgattgtactattgtcttgttcatctgtttttcttgttaacaaccatttctttttatttttttcttccattggtcttgtccttctaatagtttgagtttgctaccacattatttatattagccttcaccttgcagggtggtgctattccactaaaagaagctgcaattcctgctccacgtctaatcagttcacaagaattagagtaaatacttcctttctgtttccagtgtctctcttcatgcactcagtatccttctcatatcatttgtttctacctaggcttttgacactgttgccacgatctcattgatattaggttcttcggatctcatattgaaaggaaacatgatcgccagacaaatgatttttatgaagtgcttgatggtctcatgttcaaagatggtttcctgtataaaagggttgcacttagttctttgatttactgggggatacaaccaacagaaactgaacttctcaagttctcttccactccaactattacaagttcaactgatgacttggattgggtctccagcatgtatggtcctaagaaaagaaacgttccaaaagaaccggatatggagccttcctcttcgaaagcttcatcttctaaaggaaaatactccaaggcatcttctaaggcatccacttctactgaagattacgaggataaaggatttaatctccatgatcttgtactctttgggtcagtctctgttatgcaatccttactaattgtcacaaaagtttagcagatgtcatccttatttttgtttcatataaacaggcgaagagattttggtgtggtcattgcttttgagaaaaaaggtcttagggtaagattttttatagcacactattgtaccacatccatgatttttgtctgagaatata

SEQ ID NO: 12846 - DNA, 3716 bp, Oryza sativa
  unsure (1)..(3716): unsure at all n locations
ttccctttagcaagaattggtgtaaagttctttttgcccgtaatccgggaaaatatgcatcttttttcgttcttttcaagaaaacattcacctgaaagaattctaaaggcaaaattggttccattccacttgaaaggtcactagtttagatatataccattgaaagattgtggtgcactttaataccatcgaaaggtacatctgttttaatttttctttttaccattccatcctttgccagtttggttttttgctatttttccttttatttccacaccaaaagggtgtgcgtcagtacatgtttgccctctactgcagtgctgtttggtttcagccaagcacgaagcagtttaatcaaccaagcaaactgacccccaaattcatgagaaaaccatccatgcctacctcagtaaccttgctagttgatatacctccatcccaacaaaatcccctgctctatgccctctgttgcaccatcctttgatatcaatcaaacacagcagcacacagaagtgacaagtggtgactggtgaggtggtggggccatgtgtggaggttgttgtttacgaggatgagtagctggacacctcatccttgctgggaagcgagacggtgccatggggaagcagccagggatggctttggagaatcttcacaggagcaaaagggatgtgagaagaggattgagggagagatggggtgatggaatggaaattgaagtgagcagagtgccaaaatcgtcaacagtaacagttttaaggacagggcatgatggagaagtaagaaaactgaagatcttaaagtgtgcccatgaacttcgatggtatagacctaaaacagtgatatttcaatgccacgaaaccaatatttccaattctaaccccggtcaaaaaaaatatttccaattctaacataccaaatactaacatacctgatatggttattgtcttctctcaacttctggtaaagtcgtaatttaccatattttaggaaatattttggactccctcttcttattaactgttagttagaacatcaacatagtttgtgtatgcacttgttttatcattacattttctaatcacatactatatttatgaaaaatacttaactacatccaagaatatttcatgacaaatatactaatatcatttttacatattatctattaattttggtatatatttgtgatttaagatttcttggtttgactgcacgcatcttaaaatgacgtctatctgtgaactgagggtgccttttaaaatgaatgtaacgcattattctcataataaaatgatttacagcactagtctatgcttctacatttctttaattatgagaatttgattcctcccatttggcacccttactgattcatttaatatttttacagggtaagcaaggagttgttaaacacttgtacatgggcatactgtttatccataatgaaagtgaaagtgagaacagcggatttttctgcgcccagtgcagttcatgtgaaaatgtcaagaagcggaaggaactggcaagtttcacttttggaaattcggtatgtagaattgcagatacaatgcatgcactgttctacttcctctattccatattgtaagacggtttaattttgtcctaagtcaaacttctctaacttcgaccaagtttattgtaaaatgtaccatatctacaacatcaaattagtttcattaaatccaccataaaatgtcttgattgtgtatttatttggtactataggtaattatttttctataaacttggtcaaagctaaaatttgacttataggacataactaagataccttacaatatggaacggagggagtacttactaaagaaggtttgatattttctgtgacactttgtttttgatgtaccaggacgataatcctattcccatgttttcatatgaacaaaatgagcaacgggacagtaagtgttcctggagattgatgattttgtcagcataaaatagtttttttccctgattcccttgatcctacagatgaaaggccttacaggagcactagagaacaacttttctcaattggggagatgctgcgtattcgaaagggtcctatgaagggctatctctgtcgagtagttcgaatatttcgcaatgatgtaactgttaagctagattcactgctgaagattgtcacaggttggttacttgagtatccttgcagctgttttttgacagtgattgactacttctgtgtaatgtttgcagtgcaagctgagtttctttcagtcccagctaaaagagggtaagcagcttaccatgcttctcttctcttttcattttggggcctgctttagtaacgctgatttttgtaaccatcatattgttgcttaatgccacttacatctgtgcaccttattgcattaccagggataactcttctggtgctccatctggtccttttggtaagtgcaagtttcatgcacactgcaactattgccaatntactcgctgctggcttgctgccatggagtttgttacctatgctgattgtaatgtaggttcagaagccgataaaccctcatgggacaatggattaccatcttttggaaggttctttcttgctttccagcttcctactttgtgaatgttttaataaattgttggacttcagatttcctaatcaaccacctttatccgaccccttcccaccaatcaaaatgaacctatgcggttgacttggtgtatatcattggttggttaaataaaaatcctcgactgttatttatatttgcactattcactgaattgttcaatcttgtgcagtgattcctggcaacccttttcaagtgctgcattaccagttcagaatgcaggtatattcagtcgtaggcctttctatttggtggtatagtttggctttgttaatttttagtattgtgaagtcatgatgttgcaacatttaacctgttcaaaattgcttgctcaagtataactaggggtggaaacgagcctggctcggctcggcttgcaatggctcgcaacaagctagggttggcttggctcggctcggttagagaaatgagctaaaacatgagctcggctcggctcgtttcctggctcgagccagctcgagctggcttgcgagccttccgttgaagctatataatttgtaatcattaagaaaagcaataacaaatcatcaacatgtaaaattaaaataactttatatattcaattcatcaaaatctagacgataaattacatattgacaaataataactccactaaaaaataaagtcatccatacaaatacatgatggcttaggctcgcgagccaaatcaggcggctcgcgagctagctcgggctcggctcgtttcagaaacgagctgaaaatgaggcttgggcttggctcgtttggcattcaagccgagccgagctaagcgagctcgagccaagcctgagctgagctcacgagcccaagctttttttccacccctaagtataacacactcaaccagttatccattccatgtctcatagaagtccttgaatttttgtaagaataggcgcaacaggggatcaagtgggctctctaggattggtagagcagataactcaaatccgtttaatttggtgtgggggtgaagtcacaggtggaatggttttttattgggttaatgggacaactttttctacaaaattgacaagtcttaaacgtgaacagaaaggggtgcag

SEQ ID NO: 12847 - DNA, 2518 bp, Oryza sativa
gatccatggtgtaagaaaacttcatcttctgccaatgattctgatccatggggtacgaaaacaaaatctgcatctgttgatgtatggaacaccagtaccacacaagtagagaactccagtgacaatgcatgggataaacaacctggaggtagtggacctaatattggtggaagctcttgggacagaccagcaactgataaggaaagtgaaaaaagtgacaactggggtgaggcatgcaaggagacagagaaaactggtagtgatacagatccctggggaagcaaggtcaaagagatagatctgaaagaaacggatagctggggaaaggcttcaatgcaaccagagaagaagttggaggatgatagtcaaggatggggccaacctgttggcaagtcaaaccaagaccaagaaaaaggtgcagacaaatgtggggcttgggatactgttattgctgggtcatcttcgtctgttcctggcagaggggatgatgactcctggattaaaactgatactttgcctgttgctcaagatgatgcctggggcaactcaaaagattgtagtgatggggcagctgggtggaatgaaactagaacatctaaacaaagccacagcactggaggatgggatgctgctgctgccaacctgaatgaatcatctgatgtggatgcacataaggactcatggggcaaagcaaaagatacaacagctaatgctgaagaaaaaaataatgaaagtggaaactggaacaaagctggaccactagacaaagtttgtggcagtgattggggtagtccaaagttttccagtggtgatggtccatccagctggaacaagggagacaaaattggaggagattctcaaaacggcagctggagcagacctggtggaaactttgaaggtggtcgtgggtttgggcgaggacggggcagaggcaggggccgagaatctggggatttcggtggcagaaatgaccaaggaagctggaagaactcagggactagtgacagttctggaaggccctcttggaggtctgatagtcaagttgagaaggaagtgggagattctggtggatatcgggggagaggaagaggaagaggccagtatggaggacagggaagaggagacaatggttggagaaatggaggtcaaagcaattttgagtttggaaggagtgatgctgatgcaccaaactggggaaataaaggtgtatccaataaaggttcttgggatagtggtgacaattggaatgccccaaagtcatctgatgaaaatcaaacttccgcttggaacagttcagaagataaaaggccatctggaggtgagcggtctgtttgaaattgataccttgtattagatttgcatggtcaatatacttttgtctacatgtgcatgtgttttcttctttatgttttggatcccatatttatttgaatagtgctattgagatttgaataaacttttttttaacttcaacaggagcatgctacttgaatttcttgctttgattgctattgtggttacttaggtttagtaatatggtttctacttagatttaaacttgataatgctctttttgggtattggtaaacaaaatgatccttaggtttagcaagatggtgctactctgggtgctggagggtatcaaaactatttgctcgaagttttatcaatacaagctaatgcacgcgctttgctacgggtaaaggaaaaaaatatcataatattgtctaaaattgataaaatcatacttcccatgtgatagggaagactcaccttaatttaattttatatgttgctatccatttagacttagtagttatgtaatattaagaagttcaaaatatgtaaaaaaaactgcaatgagagtaggtagggtggctgattcactgcaaccaccatgaaattctttttaaaggagtatagatgttgaagggctttatttctgttctgttgcataggtcataggtgaacaaagtgattgttgataagttctaaaggtgaagataattaaatttagccatatctattattctacttgatgttttaagctatagttgtgcgctgacttgtatatcttgtaggccaagagcaacaaagtggtgcttgggctagcaagatgacttctactgctggcgctgaggataaaagtgatgcctggggcaccaaggcggaaggcaattctggtagcactgggggaaagtgggagaatgcttcatctggtaattctgatgccaagtaaatttcttgttctgttcaatggtggatatactacagagcttatggtttcctatcatgttcaggggaagagcagcaaagcgacccttggggaagcaagatctgttctaatgaaggtgcttagaggatattaaattgtctctctttgttgtatgcttgatttttgagctaaataattgattttgtccatgtatttacatgttgccttgcaatgcttatattatactactaacttgtaggcaaagaacaagaaactgacccttggacaagcaaggtgacatcc

SEQ ID NO: 12848 - DNA, 1185 bp, Oryza sativa
gaaggtcgcgtcctaaaacctcatctatttaagcacacagagggaatgaacccttgtgatctttgtcaacgccatttatatatttattttccagatggattgcaaactgtattgactattgagcaagcaacaacttagccacctcgttgacaaagggtagttaaggagtactccctccgttacaaaatataaggcacaaccactcttaacccaaagatcaagaaataattattattatctcatagtttggatcaccttaataaatataatgcatgcatccaatagaattagagatcttgagggtggaggacttaaaaaagcaataatctaatggagaagaggtcctaattaattgtgtgcatgtatacatgccttatattatggaacataaaaaaaagtagttgtgccttatattatggaatggaggaagtactaatttaagtattaaacaatgggttatttttcatctgtcatgtcttacggttataaatagctagaaggtcctctctacttgtgctgtgtctttgtttttctttcacatttctagcaggcagagagagcatcatggagctcaaacttgtattcccattgccttcctcttctgtctctctcgtgtgagctctacctcgcagtttttcacctcgatgttttctcttggagactcgtacatcgacaccggcaacttcgtcatcatggccagtccggttgtgcccgtgtggaatgacaagcttccttacggcatgaccttctttgaccatcctacagccgcatgagtgatgggagagtcatcatcgatttcattggtaagttaagcaacaccctaaataggtattcccttcgtcccaaaataaaccaatctcgtactaggatgtgatacattctagtacaacgaatctggtattttaccgtgagaattaaaaaataggatttccactatgaacttgcatgatcagtttggtactatagttctaactttgtgttgacatggtttctagccgaggaatttgggctcctttccttccagcctccctggcgaatagctcaagtgtctcccatggcgtaaacttcgcagtcggcggcgcgccggcgactggcgttgaatacttcgagaataacaatattgtgccgtttaagcttctgaacaattctttggacgtgcagttgggttggtttgaggagctcaag

SEQ ID NO: 12849 - DNA, 4367 bp, Oryza sativa
gtcctccagaatcccagccatttcggtatgtaatgttattggcttattgagttatctgcactaactagtttataatttttattttattttttccacacaatcttacggtgtggaaatacttcccatcataacttgtgaattattaaattatttgcgcgttggtatcgaatataactattatgctactctctctgtcccaaagtatattaagttttagcctttagcacaggtattaagaagagggtacaaaagacctagttgacttcttgggataagtgaaatatactccctccataaaaaaattattggattatttttagggatagagggagtaggatcggactagttatgggttataataaagtcaagggcagagataatacaggtagtttagtggtaaagtcatattttatactgtaagcattatgtttctatattttatgatggagaaatagtatattcggaaacactacatataaattgttacattttgaacggagggagcattgctcaataacacagtgacttttgtctgacatttgctgtacttatgcaggagtcgccgccgatggcgttctcaaggcttgctgcggcaccggcggcgcctacaactggaacgccagtgccatctgcgccatgcccggagtggtcgcctgtcaggatccatctgccgccgtctcctgggacggtgtccactacacggaggccatcaacagctacatcgcccaggggtggctccatggcccttacgctgatcccccaattttggctgctatcccccactgatttgctgaaaggattgatcaaaaccatggaagaataataatccaggcagattgtgtggcaagtctgtataccgtgtgcaatcgatcgatctgtggtttgacaattgacattcagattatgctcaagaaataaataagtgtaatacagtgtgtgcacaccacagtttgtaaaagagaagaaaatcattttctaattaaccatcctggttctgagtgctatcctgatcctctgttggaaccttaactgattgtgagaggatgtatttccatgctaaactgtctcactgttactagtagattttaactctttcgtgtgatttgtcaacttggaattccaagaagctatctgtagttctgtacaacctgataattaacaagaaagttgtttcaataaattgttgtcatctatatagaaccatcaagcagtaatcttcacgtgttactatcattaaggatcaactcgtagtacggtttttttctttctaaagagccgtctatcaaattgcgaaaccagataaaacgtgtaagctttgatatccacggcgccccccgtgggcggccatggtggatttcggactaaatattgacttagactgcaagttgtaatcgttatcacatttcttatgtcctgcaatcataaccttaacctttctcaacctttatgctctttatcaatacagatctacattttcaaacctttgactgcaagctctaccgaacaagcaactgcttatctcactttttggcacatatttaaagttttaaacaatctactattttacacttcatctgatcataaatatttcacataatggactttgaaatgaaatttaccattcatattattcaaatttagtgtaaatttttttaaaaaatataagtcatgttttaaatacctttgataataaaacaagttaaatacctttgataataaaacaagtcataataaaataaatagtaattaaaattctttaaaaaaagacatatagtcagaagtcatttccaaagtcacctgcaacaaaaacttatgaccggagggagtagtattgaattgtacctccatataacccaagcagttagctagcactcagctctgctcttcacatttctagtaggttaggtagcatcatggagctcaaacttgtattttctatcaccttcctctactgtctctctggtgtgagctcaacctcacactatttcacctcgatgttttcctttggaaactcctacatcgacaccggtaacttcgttatcatggcaactccggttatgcccgtgtggatcgacaagcctccttacggcatgacattctttggccaccccacgggccgtgtctgcaatgggagagtcatcgtcgatttcatcggtaagttcagcaatatttcgattcggagaacaatacaaatagttcaatttcctgaaaattacaatgacactggaagaataatcggtttgtttgtagccgaggagtttggtctccctttccttccagccttcatggcgaacagctcaagcatctctcatggcgtgaacttccccgtcggcaccgcgccggcgatcgactctgcattcttcaagagaaatacattgcagataagcttctgaacaattcgctggatgtgcagcttggttggctcgagcatctcaagccgtcgatttgcaacagcacagatgaagccaatggtgcgtcggctggaattggtaacaattctctgaatcgaagacagcatcgtactgcactcttctccacgagcctaaattgacttcaagagaccgattggtctctacagggttcaagaactatttcagcaaatccctcttcatcgttggagagttcggggtgaatgactacaacttcatgtggacggccaagaagaccgaaaaagaggtcaaatcgttggtgcctcaagtcgtggaaaaaatcaccacggccgtggaggtaaacttcgatctgcattagtatcaatttgcagttttactttgttactatattcgttccaaaatataagggattttggttcccatcctagtactacgaaatctgaatagacgtagcactatatacatatattttagaacgaagagagtactatatacatattaattcacttgtattcttgtttacattgcttcaactttgggtattgcagaggctgatcaaccaaggcgcggtttactaggtcgtgccgggaaacccgccaatgggggtgctcgccaattgtcctcacgctcttcatgagcccgaacacgacagactacgatggcctcggttgcctgcgtgctgtcaaccgcatgtccaagcgccacaacgcaatgctccgtgcggctctcgacgggctcaggggcaagtaccctcatgccaagatcatcttcgccgacttctaccgacccatcatccaagttctctaagaccccgtccgttttggtatgtatattttctagtctcaaaaacgagtctcctctaacgtactactctttgatatacgtcactaacatgtgagcttattgactgtgggatccacatgtcagccactcaaaattagagggcagtatattagacgatccgtttgcctagctgcttactaatcaagtacagtgtcccgttgcaagatttggttcgttcagttttccataaggaaaaaagaaagcaatgaccagtactacgaaatctgaatagacgtagtattaagatgtgtcacatccagtacatggtatatccatctacaatatatggttaagtgatttgtacatttgtgatgtgcaggattcgccgccggtggcatcctcaaggcttgctgcggcggcggcgggccgtacaactggaacggcaacgccatctgcggcatggcgggcgcggtcgcgtgcgaggacccgtcggcgtccgtgcactgggacggtggtcactacacggaggccatctaccgctacatcgccaaggggtggctctctacggcccttacgctgatccgccaattttgacagctattcgatcgatcgctactgatctgattgcaaaggaaaccatggatgggagcaaagcttgctaatgtgcaaattatcctgtactgcaatgaatgaattttgagatggttcgcgcttgttaggaaaggttctctgtcttgtctccgtccgaacaggagtagaagtataatggttgggtttattcttacatcggtaattgatgatatgtgagcatgacttaaaagatagggacagttctcacccttcagactagtcttttgaattgtctatacttataatctaaagttggatctgtggtggagcagacccaattaatctggatggaccgggctgcacactcgcagtaggactgtacaagaaggatttgttcttcctgtctatcaggtggttcaggtcaagcagttgcttttgcaatctacctgctcggctaaaactctttctctctttttttccccttctaaaactcgtatggacgacaggacgatgacgatgccttgggtggtgggtatgcttctttgttctgaaagatggttattttggtaacagaatttctcattgtatccttgcacattaattatggctctttcccttagctta

SEQ ID NO: 12850 - DNA, 1910 bp, Oryza sativa
taattgttaattaagtaattaatcactgatcaaatggagcgacagtgtcgatgatcgcttgagcggtctagctctttcataccgcggccgctttcattgcatgcgcgagaccgcgcggtcttttactgtgtgataccgcccgcgacgtcattcccacgtcattttcgtgcaacggttatacgagaccgacggtatatttctgtaaaaaaaatttgcatcccaaatattcctgaaaaaaattgaatgaatagtatattttcaaatttaattcaaataccatctaccacgggagtagaacatacatagcgaggatttgtgagctagtctctgacgaatgggcccgctcgtaaaagaagcacaacttcgacttccagttcggctcagacacggatagttcgccggccttcgtcgattccgatcccaacttcaacttatataataattctataagctgagctagacatcagacgacctcgattgattagctaggttaggtctaaccatggcggtggcggccgaggaggcttgccacggcggcggcgccggttttgacctcgccgagcacctgcagtaacagccgctactgaccagtgacgatcgccccaaggcgccgacgatgatcgacgacgacgacgatggttggtgtggcctatctacttcatcatttctgtttcttctcttgattcttatcaaactttgcggcttttttttttcaaaaagcacttaacctcctaaacaatttctcggttcattttagacctcaaatggttggaaatggttcaacttactctcctacggtgtttgtcttttttgtttccctcttggttggttatatttttgcaatgaaattttgtgggattgatatatgcattataacttatctctaaacttttttggaattttttaatcgttgtttacataggtttggaagcgcttggactaatttaaacatagaggcttcaaatttcaagtgaatagtcatgaaaattttttaaactattttagaactttgataatagtatcatatacggctttaaaatattgactcgaataaatagaaacaatgaagagaaatgtaatttaccaattaagtgaagcatttttaatagtttaggaaataaaatgaatcgaaaaatatttaggggctaagtgcttcaatgaaatagtacgggacagtaaattgaacttttttttttctcttcacgatcgaactacagaaatcaatgcaaaatacgacgagtgcaacgcggaagttgaggaatgcatgagaaaaactgaagagctgaactctgcactgcccgaggaggaacactactactgtgtccagttcctacctcgctctcttccggaaccactcttctataccgttcaccgcatgtactttatgcatgacaccaatccaagtaagatttttttttctttttcatgggtatttaaattatttttgttcagagttcaattataacaactgtagttttaattgttcatctatttttcctttttgcaaaaaccaccaccccgtttctagcttacatacttcctccgtccaaaaaaaaacttaatatcatactagaataatactagaatatgacatattctagtacaacaaatccaaacatatatactctatgtccagattcgttatactagaatatgtaacaaatccgaacatatatactctatgtacagattcgttatactagaatgtgtagtatgaggttagtttttttttaacggaggtagtagcattattcatgagatgatgatgatgatcgaaaccatgatgaatacttgggttcaattttgttttctcagcttctctaggtaacaaattatacacgaaccttgaggacagagactacccgatcactatgatccagattttttcaatgcggtttgccggcgacggg

SEQ ID NO: 12851 - DNA, 2179 bp, Oryza sativa
ccgccatcaccgggtcacgggcgccgtcgtctcaacgccgccgcgctgacgagcgggtacgaggacgagatcgtcctcttcgatggaccactctcctcctccccttcttcttcgtcgtcgtcgtcgttgtcgtcgccggcgaaactggcattctctgccgtggtggccgtcgctcaggatgacgagttgagccttcgtctcgaagctgtcaccggcggcgagggtggcctatccatggccgtttctcggagctatctgtcgtttgaagcgcagaagcatgggagcagcctagccgagctggtgatggcgaaagacttggagctagttgtacgtgtcacctggtcaacaatgggcttataaattttgatgacaattaattacacaagttttagcgcgatgggtaggctaataatacagccgatttattggctataaggttctttgtagcattctcttagcccacatatataatactccctccgtattttaatgtatgacgtcgttgattttttaataaatgtttgacctttcgtcttattaaaaaaagttatgtaattatcatttattttattgtgacttgatttatcatcaaatgttctttaagcatgacataagtatttttgtatttgcataaaaaatttgaataaaacgaatagtcaaacgttggttaaaaagtcaacggcggcatacattaaaatacggagggagtagttagcaatttaacaattaatacatggtccacttatctctctcataaaatttttttcttcttacatccaaaccggctaagagtttacaacacacttctcctctcttctctcctctgcctcaacctttagccgacttacggcctcctattatacttgctcttactgtgctatgagaagagtaattaataatagtaaatttgactttgaaccaccttttaattaattactattgcatcgccctttaatgaatattttcacttttgaatcgtgtaaatttatctttgtgatattttagaccacccttaattatttattccatatgcattaacttaatcatatgtcaaagcaatagtctaaatatagttgctggcgttcaactgtgagtagaagctggcttatttgaaattgtttatatacttgataagagagcaggtcagcaggggtgatctaaagtgaaacaaaggtaagattacatggctcaaagtaaatgaaaaatattagttaaaaagtgattcaaagtgaaacgtaagtaataaaatgtgtctcaaattgaaatttaccctagttcatggcatataacaatataccataattgatccaaagctatcaaaacggacgccaaaaccataattgctccataactataagtttccatttctttattatgtaataatgtttttcgtgctagtgcgctcaacccgttacttgtggggcactagatacttttgtaggcatatacgtgcctacctaagaaggacaaggataatagagtatacatttattggtctcatacgccgtttcccgaacccacagtaatgcgagtcaggataagccacatacggaaaggaataagcccactgtaactcccttaactagtagctgaatctaattcgtatccctcaaccacaaaattagatatgacaagtcccccaactattacaaccgtctaaaacgactccaccgtcaattttgaaggcagtttcactgacgtgacatgcatgtgccaacctagtcattaaataaataaataaataaataaataaataaataaataaataaataaataaataaataaataaataaataaataaataaataaataaataagtagaacccacttgtcatcccctctctctctcccctttcttcttcttggctcaacggtgcaagaaggcggctgacagcagcagggtgtcgggacaacaacagggagtggtgaaggcggtggcaggatgacgacggggctttcctctctctctctctctcatcctggcccattcagcaccggtgctggcagtggagtggccagttgagcggggatacgaggcgacggtgtggcgcgggaggagggacgatagacgagagaagagatatagaagtgaaacggtggctgtgaccgtggtgacaccgctgactagctgttgatcgcagtagcagcaacaacatgtccttaatgtgggcttcttctt

SEQ ID NO: 12852 - DNA, 1278 bp, Oryza sativa
agggtccaataagagcagactatagattttggtgataattaattacattaattataagagcaggtataatagcatactataaaccatgtataaacacatattgaggagataaataaggagagataaaagcagcggactacatatttaaagccagctgcagcagactacaaaacataatgtgtatgtgactagagataatttagagctagtagttggctatactattaaactcactctaaaacttactctaagccttagcgatgtgtttactgtgctatggcatataataatataatataccataattgatccaaaattatcaaaacggatgctaaaaccataacaggggattatcaacgttacaggaacaaagcaggggtctgcggataacaaagtaattgcattgttattgtcctatgtatatcctacagcagtaacataagttacataacccttgtgaagcgcacgcaaccatggagaaacggtgtttgagagcttcatcattatgcccagaggcgcatccatcaaactaacacaaaatatcacatcgtcaaaacaaaaggagcataaaaacacctgggaatcgtagagatggtgatacaaagctaccttaataaccgtcagcaatagataatgttctgctggaattaaggtaagttcgtagtttagagtagcatggcgacgttattactaataatagcgttctaagtctagaaagagtagaaatatacagcaagttcaagctgcatggcaaccattatatacatgcactaatggattgcagctgatcctggatcgagcttaccacccaccattgccggagctcccacccttgctgctgctgttccatccgccatctgccttgtcccaggagctgccgccaccacctccttgggtgcccttgttactgttcccgccatccgccttgtcccaggagctaccgccgccacctccttgggtgccctcgcacttgctgctgttccatcctccatccggcttgtcccaggagctgcctccaccgacttgtctcccgctcccctcgcttttcccccatgatccttctttcttttggccatcttctgatccaccccaagaagattttcctggggtcgtacctgaatcccttgttcctccagacgaattccaggtatcctcagtcttatttttccaagaccctcctccaccggatccaccaccagtcatgctgtcagcaggagcaccccacggattgtttccattgtgtttttcctgcctggtcatctccaccagaaggttttg

SEQ ID NO: 12853 - DNA, 717 bp, Oryza sativa
  unsure (1)..(717): unsure at all n locations
tgccacatagaaggatcaaatcctcacgtaagtataggccattttaggcatttacaaatcaactccaaccaccttgatcggtaagtgagcaagcttctcgtccttgccttaccaggaacccggtttgtccgagcccgccccggcgttcccaactattggcatgcgaggtttccctgaaccgactagttacttagccagggtgtcccattccaccttgtggttgcactttgattaggttcgatgagtttcccacaggaatcggtccttatatgtgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcatgcaaaccgaggccaagcaagttaagtgtgtgattctaataatgcaagttgcaaacaaaataataatgacttttcaattataggagcaattgatcaaagggtgatttgccttgctcaaggtcttcacgnnnnnnnnnnnnnnnnnnnnnnnnnnnnnnnnnnnnnnnnn

SEQ ID NO: 12854 - DNA, 978 bp, Oryza sativa
ctgcaccccccacgcaatcgacgtgatgcacctcactaaaaacctttgggttaacctttttgggtttcttaggggtttccggaaggtcaaaaaatacactggaagcacctaatgatctgaaccatatggaacaaccggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaaccgagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacgacatcacattgatactttcccc

SEQ ID NO: 12855 - DNA, 1193 bp, Oryza sativa
tattaccaaccgggactaaagatcccggtgatctttagccccggttggtggtaccaaccgggactaaagatcttaactttatgccccggtggtgattcccacccggacttatggtccccgggatcctttgcccacgatggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcaca

SEQ ID NO: 12856 - DNA, 1625 bp, Oryza sativa
ctagtcttttaaacaactaataatagaaatacaaactttttactcataatttatttaatggcttcattcatttttccatgacttatcaaccatacctcaatagatcataggaaaatgaccaaaatggtttaatgaggttctgtttgacatgctctaactccatgagcgtggtagaattaaaccaagctgactgttgaacacatcgtggcagaccactatttctttttttccttaacgagcaaaaaaatcagaccgaaatacgttgcatataaggtgggtcttctaattcttttggctagataacagataaaatctgatcttttcttcaatagaagctaccacaccacttattacgtaattcttggctcgaaaccaagtatagcggtgtctaacaaaggataaaaagatgacacattcaaaaacacaaacatcaatgaagagatacaacttattcaaagagcacgatcctattgataatatcttcatccaaagttgataaaaatttacatgacagttgtctccaactttcgaatacattgtaagtacgcagccttcaaatttgcttgatggtaatcactaattaacttccgaatgcagtgtaaatagtctccatgacaacatggattcactacttatacaacctagttttgtttggctacgataggagtaccaaccatgacaataatgctcgccaaattaaattcctaatgcatctcattcttaggacatcttaatcatcatgtatcgaaccgccaatatatatgctcaactgttgtcaacccctgcattcacccatcaaacaattaaaggagatacatgatcaaggttcagatctttgtagcattggttatttgtgggcatacactaaacaaggtgtagccatgttggtatacatggagcatttcagtgagacactagtcagttgaactggatgcaaatgatgaaaattttgggctgcccctggaaggctagaacgacaagagttgggctccgccttggtcctcatcgcaggcagcgaggggcaagaggtacctgggccggcccatgagccgagccgatttattgatctttatttgggccaacatgtgggccaacccgtcagatctagtactaccatacaccgaccaattcataacttgtgtcaactgaaactgcatgcaacatatacaaccttgtttgtagatttctttgctgcatagggaaacgacaccgacaccagactccatgtacttagaaaatatatccgtgccttgctataaaaaattaaaattattataaataattgagcagagttcaactttaatgattcaagcgctttaagaaagggcaaattagatccgtgccattgaaaatgtgtctacttagatatatatgttattacaattcgtatattcgtagtcgtatcattgaaattttacaaaatggaaccgtgccactgccatcacgattttcatcctcgatgaatagatgttcgaccagctagtgtctttgacttggattcgatgttcaagtcttggcttcaagtcttctggatcctctcaatctgcctcgacttgagctcctgatgcatccaattcccaggagatcccctttaggtctcatgagtcgtgatcctcaaccggttg

SEQ ID NO: 12857 - DNA, 2484 bp, Oryza sativa
agatcttgtctttgccacgttggttaaaaagttaacggcgtcatacattaaaatacggagggagtagaataagtagatcttggctttgccaccatcgttgaactataaatattacattcaactcttgtttcctcttctgttcacatacatcttatgctaacaaacaaattgtatattttaaaatagacgaagtattaactagcagcatttcagtgtacaccaaccaattacaatggatatttatctcgtggagacaaacaaccaatgcacggagcagtggacgatcggttaattttgggctatccactaaaaggttggaacaataagttgttgctgggctaggtcgactcagcaagcttgaccgactgcaaactgcagagttagcccactgcaatggaaaagccggaaggcccgatgcatccgattcccaggagtggtaggccattttaattattcgtcttatttaaaaaaataagttaatatctttttttcatcattatttattactaaaagaactttagcattacttatatttttaagatttgcaaaaaaaatgaatatgacgaatagttaaagattgtaaccaaagtcaacgctgaagtatattaaaaaacggagggagccgtgatcttttgctctgtcgcgatacgatattcacctcagaaatgtcctagaagcccttatgttaacgcacaaggcacaacattgctcctgcgctaccctgccagctgatttgcttcccacttgtattgagtacagagtactcattgttagaaataaaatatgtgtggttagagttaatagtcaaatgcaaccatagagataacatacaaatatacaatcctaaagttaaaatataattctagatatagaatcttaaatataaatctgctataacttcttaggtagtctagtggttgtagtgacctgagtagtaccccaaggttttgagttcaaatctctttaggaacgaattttagattgggttgttcgcggggctaagttccctatttcatatatatccaataggatgtagaggccgggtaaaaaaatacccttctctaaaaaaaaataaaaaataatctgctataacttgtctaacttgttttgtacttcaactattttacctcatctgtactatacatatatacctcacgctcgtgatgtaaagttggaagcgttctcacctcccggaggaggccgcgtgattgtatttatattgtcaagaacagcccttgacgtggcacttacagagaatatgatcaagttgttacaacggatgttatccatctcaactaccctattatctagccagcaactcaactaactagaagataaaacgtacattgttttacactcctcctcaatcataacttggacaagttaagattgtacatgaaatatctaagactctgtatagacaaagcctttgtaaacccatcggctatttgatcttttgatccaataaacctaatatcaagcatcttatttgctactctttctcttacaaagtgataatcaatctcaatgtgctttgttcgtgcatgaaagactggatttgaggacaaatatgttgctcctaaattgtcacaccataacacaggtggttgagcaatctttactcccaattcttcaagaactgactgaacccaaattaactcagcagtagcattggccatagctttatattctgcttcggtactagacctaaacactgttggttgtttcctagcactccatgacacaatattaggtccaaagtaaattacaaaacctccagtagaccttctgtcatttagactaccagcccaatcagcatcagaaaggcactgactagagtagaactagacctcttaaagtgcaaaccaacatcaacagttcctttgatatatctcagtatacgtttcacagccaaccaatgttttgaagtaggagcatgaagatattgacataccttattaacagcaaaagccaaatccggtttggtgagtgttaagtattgtagtcctcctacaatactcctgtactgagtgctatcctcagtaccaagaggatttcctttgtgtgccatcaacttctctgtcacagctagcggcgtggaagctgatttgcaatctttcataccaactttagttagaaagtccaaggcatactttgcttgattcaatagtatatcatcagatactttcttcacctctattccgagaaaataatgtagctcacccaagtcctttaaggcaaaatcagaccttaggttcttaagcaaggctgcgactgcatcactagaggaacttgtgacaataatgtcatccacataaattaacatatacatggttattccatttttattataaatgaacagggaagtatccgcctttgacgaggtaaaacctagttcaaataacttgtgactcaacctagagtaccatgctctaggtgcttgttttaatccatagatagccttatcaagtttacaaactaggg

SEQ ID NO: 12858 - DNA, 2056 bp, Oryza sativa
tttagatatccgctaaactctaactggtccagccttggaggaagtaaaacagctcttttacttagagactggagaagcaaaattgtataatgtacctatgtcatggacggaataaagttagaactccacttgtaagttgtaactagcaaaaatgcttgatatgtaacatatgaataaataaactgcataaacatcagatgatgtgctaacagccacaaactgttatggcaagaccagaatcacatatggtaatttaaatgtgtgtgctgaattgctgataaatgaaaaacaaaaggaaagctaaagtttattttctgctgcatttcattattttagaaacatgtctataagtaaaaacagttggtatttggaaccaaactgagttatttgctgctatattcatataaaatattccctttttttacctttgttgttttacttggattccatggggctaggtatcaatatagaacttactgtgatgcaactgtagaaattgcagctccagttatgccaagccgaaagacgtaaataagtaaaggaagaagcactacagctgaaagatttcccaaacctacatgttttaaaagaacatggtacagacatcatatagtgtaatatgagagatatttgatatcagagaagagtctggaatcaaatgaaactggacgtaaagtatgccctttattgtggaaaatggaaaaaaaagatattggaaacattattgtgattccacaaaatatttgctaggactgctaaaaggaatataactaatgcaaaccaatgtaatcatgtggttgatgaagagtagttcttggaagttacctataaaaaatacaggagtcttagtatccttgaatccacgaaatattccctgaactgctaacataatcacatttgcaggtgctcccaaagctctcaatgaaaggaaaagttttgcaggtttatgcattggtgaggcctgcaaaagcactaagttgagatatcctgacaattccaacaattgaaaactaattgttgaatcaaattagtgacccattgtccaaaagtgcacataaaaacgacagtattccctacaaaacaaagatcgcagacaagaataggcatcgtaatccaaaacatacaggtgacacgcccattagtttaagaaacaatcctgatcctaggaacaatgccaatgcttcaattgtaccgattccagcagctaagaccaatgcagaagatacagatgacagctccaatttgcctgcaacataaccacaagtcaggttttattgcttgaatgttgaagcaagtgcacaaaaaaaatttataaatatgtgagaaatggaatatttatttaatatatgctgctgctacctgaacttgaatgcttgctagcattcttggaaatgtcttctgccacaaatgaggttgcaatgctcaacagtggaatgttgaaaatcttagacacgatattaaaaaccgacacaccaataccagctgatgctagctccagagccccttcagaatatatgaaaaagaaggatgaatggcaaaagaagggacagcttgctttcatgcagtaaggatggctataattcagcactcccaagagctactttatgaagggcaagcgccataatacctagaacatcatttttggtgctgtttgaattagttacataatataaaagaaacaaacagcatgaattatagagtattagtgtagacaatgatggtgcaggtatctacctatttgccgattgataaaccattaagaaaagaacacttaaaaatataggatatagcaggtccagtaggtacctacctaatctaccaatatatgcagtctccatcaattgcgccaatggatcaatagcttggccaagaactgctggtagagctagaagaattagctcatttctgacacccccgggacgcaagtcactggttgtttattcgttggatggttatgaaagggtaaaatatgtcatgcacctccgaaatgtaaagattatagtaaatgtagacagcaaatgcaaagggcgcaagcatgtgggtaggcaagtaaata

SEQ ID NO: 12859 - DNA, 11326 bp, Oryza sativa
ccacccggcaggaaaggacagcagtttgcggtgccggtggacgttggtagtgggaggatcaaactcgaggggagaaaggagaaatcagaaatggatgaggcagcgcatagagccgggagggaccaacaaaaggcaagcctttttttttaattgggttaattgttgtcaacttggcattggcatatgtactgtatgtctgcatctgtatggtggtgcttcatgtggcggtgcaggaggtgcatcatggcgtacacctccgctcgccgtgggtgcgctccgtcccaccatacgaaccgctcgcttccgccggcgtgctgcaccacgctgtggccgctctccaccttcactcccttctccctcatcgcccaccgcatccctgccgcccaccccttgcctaaacccatacccatggacatgagataccccgccgacttgcccggctccagctccagcacgcgggccgccgcgcttcgccccacctcgccgccgccgccatccccgcgcctcctgcacgcgctaagcagcgcgctccacgccgccgggctgccaccgccactgctcctcctcacaatctccgccgcgccgtccaggtcccccgcgcgcgccagcatgtccaccacgcacgacacgtgctccacccgaggctgcagcgactgccgcgccatgctttccaagcacccaatcccctcctcaaccagccctccatgagcgcatgcccacagagcggccagcatcgtgacgccgtttggcctcacctcatcaccttccgcttccatcctgtgcaggagcgcaagggcgtcccgtgcgcgcccgttcatccccagcgccccgatcatggagttccaggtgagcacgtccttgacgggcatcgtgtcgaacaccctcgccgacgcgcccagctcgccgcacttcccgtacatgtggaccagcgcgttgcccactgccagctcaaaccccaatccgctcctgacggccacgccgtgggcgcgtctcgacgcccacatctccgcgcagctgccgcaggcctccacaaggctcagcaccgtgatcgagttggggcgctccccagtcaccagcatcgccacgaagcatgccatcgcggcgtgtggccgggcgttgtgagcgcaggcggcgatgactgtgctccaggttatcacgttcctctcgcgcatcccttggaagagcctcagcacgtcctccacgaggccgcacttgccgtaggcatccagcaacgcgttcagcagagccatcgacaagagccgcctcctgatggccgcgccatggaccgacctggctgcctgaccccctagcctcttcttcttgcacagctgcagcagcaccgcaagcgtcgtctcgtcgcccaccaccccaatctgcaaggccagcagatggagcgcctcggggtagctgccagcgtgcacgaggcctgagagcatggtgttccaggacaccacgttcttgacggcgataaggtcgaacaccttcctcgcggaccgcagatcgagacatttggcgtacatgtcaacgagcgagttgtccacgaagagatccccttgcaagccccggcgcgtggcgacggcatgcacggaggctccggccctgacatcctccagcatggcgcacgcgcgcagaaccacgacggccacgacaccgtccggctgcagcgcgccgtcagcgagcatctccctgaagaggcgtagggcttgatcggcgtagccggatcccaggcaggccccgatcatggaggtccaggacgcaacgtctcggtcgggcatttcgccgaacagaatcgcggcggaggcgaaatcccccaaagtggcgtagagggagagcagggagttggcgacaggcgtgtgaatggaggcgggcgtcttgagaagataggcgtggatcatgtggaggaagtggtcggaataggaggaggaggcgcggaggagggagaggagggaagcgatgttggggtggaaggcagcgtgggcgtggcgcatggcgaagcggaagaggcggaaggtggtggaggaggaggaggaggcagggaggtggttgaggagggtattgtaggttagagaatccctgggcgtggagcggcagcgcaggtggtggagcgcgagatcgaggcgcgaggagcggaggtagtagcagaggagggagttggaggcggcggcggagagaggccgcttggcgacgtcggcgtggagctgtgaggccagagcgcgagcccagcctgatgatggctgctgcctggacaggagccccaacaacgccgggaggagcgccgccggctttccgcccggggtccggcggaccgcctcctccaccaccacggccgccgtcgccatatttttcgtttccactcctctttttacttgttacactacatgggcagcatatcttggtaccaaatacaacttaaattaaattaattttgatccctgtcaaatttattcgattggagcattggagggagtactaaaaagcaatgtataatagtttgttaacattggagggagttctaaattgaaaattaatgtttttgtttttgtacctaaaaatgtgtacaagcgagttgttaaaggttaatatatatacatgaagagcaactaagaaaatgatgaaaatcaatcagtgaaatcacccatggccttccaaattaagggggaacataacatgggaatccaaccaagagagagagagagagagagagctaggcaactagtagctagaatgagcagatggaggaattaaggttgggagttgggaggaggcgtggtggtggtggctctttgcttgtcttcccatggctgggactgggaggcgacgtggtcgagggctcgggtgacgtctgtcatggaggggcggaggttggggttgtcgcggaggcagagcgaggcgacgacggcgagctggtagaaggcgcggcgggggtagcggccctgcaacgccgggtcggccagggcgaagcacctcttgcggtcgccggcgaggtaggggcgcgcccagtcccggaggaggaggaagcgctggtggtcctccgactccgagtcggaggaggcggcgtcgaaggccctgcgtccagtgatgagctcgaggagcacgacgccgaagctgtagacgtcggacttgacgttgagcttgccgctcatggcgtagtcgggcgcgcagtacccgtaggtgcccatgacgcgcgtggacacgtgggtgtcgtcgccgacggggcccagcttggcgaggccaaagtccgacagcctggggttgaggtcgtcgtcgagcaggatgttggacgccttgaggtcgcggtagatcaccggcggcgtcaccacctcgtgcaggtagcgaagccccctggccgcgccgaccgcgatcctgacgcgcgccgcccaccccagcgccagcgggggctcctgcggcctcctgccgaagaggtgcgcgtcgaggctgccgcgtggcaggaactcgtagacgaggaggcgctcgccggcgtcggcgcagtagccgacgagggagacgaggttggggtggtgcagcatcatgagcatcatgcattccaccaggaactcgcgggttccctgcgcgccaccgtggcagagctgcttcacggccacgagcccttggccgccttcctcgagacgccccctgtacaccctgccgaacccgccctcgccgacaacgttggactcgtggaacccgtccgtggccgccgacagctgcgccagcgtgaacttcttcgcaccgcccgcccccgccgacgccgcctgcgcggcctggctgcacgggctgccgccgtcattgctgccatgccagcaccgcaggctggggttccacgagaagcagctcatcccttccttcattcatctatcctatccattcatgtcatcaacacaaaagctttcatcctcgactcgacaaaaccaaaaatttggaggacacacgagggttttcttaattaagcaaccagacagcttaatcgatcgatcgatgcttaaactacatctatatttagatacagcccaggacgcgcaattcatccaggacagagcacagggcattcttctgagtgttgttagctggcatatgtacatatatagatacataaatttcacaagaacattattatgtgttcacggcagaatagatcagattatttttgtaagctatatatcagtataacaataacaaacttttggaacagagttataaagtggaggcgagcttcatcccctgcttcaccaaaaagaacatctgtcgcaaactcacaaggaaacacagtgatcatggggaaactgttttaatccctcgaggagatattccctcgttctttgtatgtcacttaaatggttataaaaaaatttaaaaaaaatgggaaggtgtattaacatgtgatataacactccataaacatacaggttcaaattcaacttctacatctcgtaacgaaaaaaacaaattgaataacagctagttaacgtatattcagagttaaatttatttttttcgttgcgagatgtagaagttgaatttttacttgcatgttttgtggagtgatatatcacatattaatacattttcttaattttttttcaaattttttataaccatttgagtgacatgcaaacaacgagaggatatcccctcgagagggatcaaaatcctcttccgtgatcatgccattgccatacaaaatgcatccaacaaggcgcaactgctgttacaagcgcaggcatcttataatacaccacttcttttaaaaaatgtaattcggtttcttataaagtcaccacaccaacggtttgtggcagggtagcaacacgatgcatacttattaaacacacacaaacctaaaggcgagggatatagtttaagggcagtccaaaccctccacctaatatggtgtctatagcgttaactacattgtcatgtaggacttttaacttatgtggcactatattaattaagagagagagagtgaagagtggaagaaactgggtctcatgcaagacacagcttcaacacgagaacctatgcactagacactatcaagttttgcattgggagagaataatgtcttcataataggcgaagaataaatatgattggcagagaagagagatgatgtatttattaatggcccactctaagaaatcatgggttgtggggtgtagtttctattgtgatgtcttattgacatggcactatagacattacttatagacattatgggttgggactgccctaagcatgcaaagtgaaagctaaactggaacacagctgctcaaggccagggcaaagtagatgcctggatcaaatagttcattgcctggctcgtgaatcgtgattttgtcctgctggcctcctctggggttgatgggaacagctccatgtaccttgtcccaatggtcatcttgtccttgcatatggctgtcttcgcaacccctgttgttgagaactccatagagggccttcccatctagacggtacgcggtgtgcacattttcctccgtcaactcatactctacaaagaacttgatgatgtcttcagcggtagtaaagtagggcaggccacggagcttgagcacatcaggtggtgttcttttctcttgaagatgaagattaagttttttacgtaaaacgaggtggtattaacgtatgattgattgagttttaattattataaacttgaaaaatagattaatataatattttagagcaactttcatatagaaagttttcgcacgaaacacaccgtttagcagtttgaaaagcctaccacaaaaatcttaatcttcatccgacttttgttggagaaaagaatgggacctcaatatattccatgttgctcgtcttcagctggtttcttgggccgtggaggaggtggggagtgacgatactttgagtcgaaaaagccgtcttggttcacctcagcagctattgagctgtaatactcttgcttcttgcatctaaacacctcaacatacctcctgcccatgttctaccggttgcggtgcagtgcaaactctccttgcatggctgatgggaagacgacaaaagcctcgtcggtgaagcagccattcttgtgaaccaagaggcagtccactatgtccagcccaacaaagaacttgcaaatgtcaagatcgccgcagtcaaaggggagccctagtagacggacccctgaaaagttctggatggcactattagctcctgcactaggtaagttggcctggtagggctagtagaaggcattggtgccatcagcagcactgttgcccatggctccaaaaatagagaggggttggttccatcatcctggccctctttgatacatccaagggactgcctgcggtcactgcgaagtatggattggattccatcattcgtagcctctttgatccctcctacccatccaaacccccctccccccctcccatcattgcccatcattgcccttcagataatccagagtcccaaaaagagaaaagaaaaaaaaagagaggagaagatccccccatctctcaatccccatttcatataaaataacccaaacataaagaaaaccgcgcagataagaaataccagtaatctaaacaggacttaaggctaaaaaaggtgaatggagtcgaaatgcgaacgcattagtggtcataaacaaaaactaattaaatgttgacagcttatgaaatgctcaaactactagataacacatatcattagaaaataatcttacaaaccacattggtgcagttatcaatttggatgtaagtcagctattactgcctctgatttatttattttttgggggaggggtttggttttgtagggagggggggacgtacatgtatcctaaatactaggcatatgatatcatatcatatcatattatgatagcaaagcaaagtgacctacttttagatggggactaagaaattgtccctaaaagaatcgagaaattgatgagatcgcataagcaagcaagtaagcgtggattcgtagtattgtagaaaaaaaaagaaagcaatggatgaatcggcgggatggaattgcagggataagagagaaggaagaggaggaggaggtgaccgtacatggcgaagcccgctggaggagggggtggggtggcggttcacgatagggaggggaggaaaccctagagcgagagggagtcgtcaagtcgccgcctctgcgattgtgttgcaatgcgcctcgcatcgcccaagtagtcgtctctaaattctaaatacaacctatacgctatatgcataggacgaggaggaagagctcatgaccgaactgcatttcttgttgctgggtctggattaggcctattacttctattttatttttttctctagaccaaaataaccctgcctaattctctcctttctcccacgcccaaatcgcgcacttcccctgttgaggagggaggcgacgtcgcccgtctctccgcgtcggctccggcgccgacccactcccctcctccgccgccatccatctattcgcgccgcaccgcccgctcaactcttccttcgcgcaggcggcggcggtggcgcaggcggcgtcttcctccacctgatccacctccacttcctccggaccgcacaagaataagaagaagaagaagtgcaggtacggtgcaggtgcagatccaattgcgagctcacctgctctgccctgcccactaccaagtagtagcctcctcctcctcccctttctccccaacatcccatcccaaatcaaaggctactagactagtgttgggggagatccaagagatggcgcggagcccctgcgacctccgcatcctcctcgtcgccgccgctgcagccttcatctacatccaagtatgcctatgcctatcacaatctgattcttcttcttcaacttcagatcaggatcccccctctcctaaccaccactctactactctctcactacacataatggcttctttctccttgtttcaggtccgccttttttctactcagtcccactacgccgaccgcctcgcacaagcagtcagtctctctacccccccccatctcaatatactccctccgtttcaaaatgtctgacaccgttgactttttagtatgtgtttgaccattcgtcttattcaaaaaatttgagtaattatttattcttttcatatcatttgattcattgttaaatatactttcatgtacacttatagttttacatatttcacatttttttaataagacgaacggtcaaacatgtgctaaaaagtcaactgtgtcaaacattttgaaacggagggagtatatatttttggtctgctcaaactcactaattgcaatttaggaaaaatccgaaaaccaatgcaccagtcaactccgctccttgatcgatcaagtcagctctcagcaggagaagattgtcgcgttggaaggtaccacacatttatcacactaatttaagccttgcctctactattcgcgacctataaatgttgtgtctctcatgttttggtaacaacagagatgaagatacgccaagacgaagaacgtgtacacctcaagattttaatccaagatctcgaaagtatgaaaatgacctttcttatctttcacctatggatttcagccacaactgttcctgctaccaagtgtttgctacgttacttgatttttctcgcgcctcctaatgtttccattaaaacctaaccttgtgatactcatactggagcctcatgcacatcgacctccatgtgacatgcatggttgacaacacaacaacatatgacccgatgtttcttcttgaaattcacatgttttttttcctataaccaatagaactgaaaattagtatgtcttctggaaatatttttacaactacttattttttttaaaaaaaaatggaactacgaaaatgatgtcaatccatcagttagtcagttgtttagttaaacaatcattcataaatgcccaaaatataatagtggaacatcaggaccgtacatatcattctagttgtcatcttcacgttgaatacaaaataatagtttcataatcctcccatctaccccaaatatagaggttatgtttctcattaccatttgacatgtcactggcgtgtggctctgggtcccacatgccattctcatatgtggtagtgcctttcagtttacacccattcgcaacgtgctgaactaattttctcaaacataaagatgacccatcgtatgatctcaatcctcccagctgccatctacatatttaacccgtcattgtgattttactttaccacatgctactttttgtttctaactatttcttcaacatttcttttggatgcagaaaggagcgtgcagaccttagtaaacaacaatgtggtttgtacagtgctaatattgctagcattcctctgctatatttgactaatatgatctgtttctataagcaggctcctgttgctgctgttgttgtaatggcttgcaatcgaccagactatttgcaaaggacagttgaatctatcctgaagtatgctttgtgccttcattcctttattttcagaatccagattttttttggtctgttattgttttttctaactcctaagttggtgccaaaacccactcagtcgatatcacctgtgaaagttatgcatggaatcatgctgcattgtaattgccacgctgctcatggtgcatgaatgcataatgtctttttctcagaaattgtccatgcgatgtcacaaggaaaattacacattttacttcctaatccatatatgaatcccattgtgagctccatgtagcttaagttcgtataatacccttctgacctaatgattcttaataatttttccaggtatcagacatcagtggcttcaaagtttccactatttatatctcaggtactggtcttagcaatttcagttcttgctctcagtctctctaagtttgtggatttttttccattgctcattgtaattgcaggatggaataaatggagaagtgaagaaaaaagctttgagttataatgaaataacatatatgcaggtgtggaactctttcttcctctacacttatttgcctaaaaataagaagaaatatacttctgtaatattgcaagcatagctggagtattgtctgaggaccttttccaagtaactacataagatgatatgttgcaaaagaggggttaaaaagaaaggaagaaactgtagcctgccaagaggttttaagtggacctagattgaggttgcccttgaactttaagatccatgagtcatatcagggaaactctaggtccaatggatataaactgagcagtgagaagcaaggccataatcataccccaaacttgtggatgtattgtttgaaagggaagcttgatgccactgtactgtagtgagtagtgaccctatgctgttctggaatggggcagtggaattggtccaatatgaaatagtatggcaaaggtaataaaatccatatatagagaatcaacgggaagggatggcagctcactgaggtgactgctcagttgacagtactgaacttgtatttagttgacaaattatcattacaatttagtttagataaaataacgggtatgctagctcctgaaaaaccaaatggccatatgtagagtaacaaccatgtcatggagtggaagtggtaggataatcatcagtgtatgctgtcataaagtgccagagtgcagattgaagtctagcaatgaagtgttattgcaaaaaagagaaaatcttgttctctgccttcagcgctaatagagaatgaaaccacgaatacaatatttcctgctgttatgaaatgattgtaaacatattatcacatgtgtacttttatagtgattttgaatgattgtagcttcccccctccacataacataggcatgcagcagtccgatatttgtaagaaacatgggaaatatttttcagctaagactctcagtggtatgtgttgcagcatttagatcttgaacctgtgcgcactgaaaggccaggagagttgatagcatattacaagatagccagtaggtggtcctccttgattgatgtatgctgattgaagatagtgatgataccactgatccttgtcctgataactttcttatttcagaacattacaaatgggccttggatgagctattcatcaaacacaactttgcgcgagtaataattctggaaggtgttacaccttggatgctcttataactattttgttctttgatctgtcttctttccatcccatttatggttaataatttgctaatagatgatatggagatcgcccctgatttttttgactacttcgaggctgcagctaaattacttgataacgataagt

SEQ ID NO: 12860 - DNA, 909 bp, Oryza sativa
ttcctgcagcccgaagaaaaaggcgcagaaaggatgtgccatcttgtaattaaatggtagacagtgcagtgcaaatcgatgtatcccttcatttgtagcctctggcttcaatcgtcgctggtttgtataattacgctagatgccaccggcagaagatataatatagtcctcctgcctttgtggtgttggtctctaaggtcgtccagactccagagtccagacgcatttggtttcttttgttctatctataatcaatctatctatatctgctagtgttgtgcttctgctagttatgcggatgagaaagggaatttaccttccctgtttctgggcttctggcttgcacgggaaaggtcggtttgtttgcaatatactactaccactccagcttgctaggttgattaaaataagctaccagtaagaatcgatatgacgtatcagcattttattaaatcagtgattaattttatcataaccttatattctactctccgatcgttctccatctctttccctagcggtcttgcaatgcttggtgccgtgtcctcgatgggaggatcattttggcatcgccattatgtctccctctttgtttttcacagtgagttgcatggccatatgtaagttgtgtttagttaagcgtaaagtttggataaagtttagattttgattgaaattaaagataatgtgactgaaaagttgtgtgtatatgacatattgatataatggaaaagaactgaagtttggatccaaactttatatctaaacaagaccgtaatatcgaaatccagaacagtactgaagttaaaagcgcaaaagcagttgaccttggcatgattacacacgggatctgggactggctacatcaaacgatcggtatatataggcatccgttgatcttgttattgg

SEQ ID NO: 12861 - DNA, 1962 bp, Oryza sativa
ttggtctggagagaggatttagaaccgcattgagcgactttgtactgatgcagctgcagttagcatctgttttctttacattctctctcgggaccaaaactcactactatggaacaacgctgctccatggaggagccgagtatagagctactgggcgtggatttgtggtgttccatgccaaatttgcggagaactatcgactatactcacgcagccattttgtcaagggtattgagttgctgattttgctaattgtgtatgaaatctttgggcaatcatatcgaggagctatcgcgtacatcttcattacattttcgatgtggtttatggttgtaacctggctctttgcaccattcctatttaatccttctgggttcgagtggcaaaagattgtggatgattggactgattggaataagtggatcagcaaccgtggtggtattggtgtaccaccggagaaaagttgggagtcatggtgggagaaagagcaggagcctataaaatattctgggaagcgtggaattgttctcgaaatagtgcttgcattgcgcttctttatctaccaatatggtcttgtttatcacttgaacataaccaaacacacaaagagtgtcctggtaatttgctatcttcatttaatatttcttggtgttttcctggtctatgcttattagcacaagctattgaaccaacttttgaatgttatttaatggtctttccaggtctattgcctgtcatgggttgtcatctttgtaattctgcttgtgatgaaggtaatccctagcattcatattttttcttcagtgtttcatcgcggtgctcatgagcaacattgtggttagaacacagggggtacccttttttctgtatgacaattataattttagctgcacagagtatggtagttttcttgctatattcctatggcagtaaatgctagagatatgcctttgcaatacctgaggaccattgcggtcaagttgctttgctgatgataccagttgttagaaacctgttgtgttgtgcacacagactgaaccttggtttactcatgtttgcagaccgtgtcagttgggaggcggaaattcagcgcggacttccaacttgtgttccggttgattaaggggttgatatttataacatttatctccatcattataatcttgatagcaatccctcatatgacagtccaggacatctttgtttgcattcttgccttcatgccaactggctggggtctgctgttggtaagtggatatcaattgtttttggcctgtaagcggctggtttggcttgcttgagctgatgatggttgttgggttcaggttgcgcaagctatcaagccagtaattgtgcgcatcgggttgtggggatcgatcaaggcgcttgcgaggggatatgagatcatcatggggctcctgctcttcaccccgatcgcgttcctcgcttggttcccgtttgtatccgagttccagaccagaatgctcttcaaccaggccttcagcagaggtctgcagatctcgcgaatccttggcggccacaagaaagaccgagctacacggaacaaggagtagtagcctgtctgccattcactggacatgtattctgttgtgtcttcttccctcctgttgctgctgtaatttgttactcctattctactactccacttatcttgattgagagacccaaaaaaaaagaaaaagaaagaaagcgtgcattttggtagttgctaatcgccgcgctgctgaggccgcttattgtgcggcccagggagcgatgtgttgtagaatagtacagtagaatgtgtaaagttgctgtttggtagtgatgtgatgtgtgtgtatgaaaacaaacttgggaagagaaatgcaattgtaagacaaaataccttgcctgatgtgatgaatgtttttttttttgacatgtgtgatgaatgttttaattcttcttcttcttgagatg

SEQ ID NO: 12862 - DNA, 5207 bp, Oryza sativa
ccccaaatttagtggtcatcttcttcttcttccgccctctcaccttttcaatccaatctaacaaccaacgaaacgaaggagtctttctctagctctagggttagggtttgcggtcggaacggaagttagtcgaatcggcgcaaatcgatccgatccgatccgccgtcgattcgaccactccgccctccttccttccttccgacgcagacgcaatccataatactactactctagatcggatcccctcctctccctccctccctccctgcatacgaacaacaagagactactccattactatattagattgattgattaggggaggggattgctgattaatttcatctctctaaccctagcagcagatccctctctcccctagcaactagcaagcagagagaagcagccgcctccatggatcctaatcagatgatgggccgaagcttccccatgtgggccgccgccgacgacccttccgcccagccaccgccgttcctccctccgcccaaccgcggctggaagcgtaagaaccctagcaccgccgccggtggctaccagccccccgccctcggcgacctccaggtgcagaaccgcgccaaggctcgccgctggttcaagaaccaaagcggaggcggaggcggaggcggtgggccccgcaagcacttcttcccccggcccaaggccgccgccccacgcaacaccacctccttcatcatccgtgccaagcgcgccggtggcatcgcctccctcgtctccccctcccctgttacccccgccgttctccccaccccacgcctctccccctcccgcgagggcctctccgacatggctcaggcgcagtggggcgtcgatggctatggctccatgaagggcctcatccgcctccgcacctcccctcaccccgccaacccctccgatgacgacgatgatgccaactccagcggcagtgacgtcgaggagcatgtcgaggtggagcgccgcctcgaccacgatctcagcaggtttgagatggtctaccctgccaggggtgacggtgtcttcttcgaggaggaggatgactatgagtatgaccaggaagcccatgtggctcgcctcgaggaggagaacctcaccttgaaggagaggctctttttgatggagcaggagcttggcgacatgaggcgccgcctggaggcactcgagtcgcgttttgcagggactgatggtatgcctattgagaattcagatgcagttgcagttgaccatgacaaggagatggctcatcccatacttgttcagagggatgatcttaggactgagattgctgctgatgcagcagggtcagacaaggctagtgcacaagacaatgcagaggaggttgctgatgcagcagtgtcagagaagatcgtgcaagacaatgcagatgttgtagttgcagggtcagagaggactggcgaagagatcggggttgatgcttcggagatggattgatgggagatggacactggaatgcaatagcggttatcagtactgtacatacataattgtcgatgacagattgaggccgcgtgatgtggacttgttttgggaggcttacaattgtatgttgtcgcataacaagtggatcatcgtatttacaatgtaatatgtttctaccattctgtgctatctttggtgtttctttgcgtatttgttatgatgataccacacagcacaacttgtagtagttcttaccttctgctgctgctgctgaaagaggtagaagcgactagatgaatttgttactacatcaactattaatgtcattataatggtatcagatggtgtcatgaacctgttacttaattatagatagcactcatgaagctattccttatttgcagatagcatagcactctcatcctggtcacttgtagttatggattctggtcggggttaaactatcttttttgtcaatgggggtggtcagttatgcttgttgggatgatggtttttttgatggtatcatgtgagcactcagcactgtatctgtatgttgttttgtcgtggtgaaattgttgttagtatgttgctgctggctccatggatagagagatcattatgtattaatccaatttattggtatttggctgtgtgctttcttctttgggctcagtggatcggtaaaatggcatttggctgtgtgctttcttcagtcggtaaagcgaaaactagtcgtaaggacatttcaggcgggagggagggaccatccgatccgattcgaaactgaactgacagacagtcccctccattagatggagggagaatattgttgggcctttgggcttcgtgtgacaggcccattagattagacctagatctgtctcgtgacgagggagaagactagaggagggaggaagatggcgatggatgagccgcccaagggttggaatcccaactatggcgtcgtcggcagcggcgaccggcgactggccttctcccgccagctctcctcctccatgcctcgcctcgcccgctccgactcttccatctccatgccccccccgtccctcgcccccaccggagccatcaccttccgctggctcgccacccgccccatgcgccgcctcgccctcctcatcgctctcaacgtcgcctactccgccaccgagctcgccatcggcctcctcactgcccgcgtaggtcggtaatactaatactactgctactgctactgctactcattactcatctcaatcacactcttctccattcgtttcaggcctagtctccgatgctttccatctcacctttggttgtggaatcctcactttctccttgtttgccatggctgccttcagaaccaaacctgatcacctctacacctacgggtgcctccctccctcaatttactcctcttttctttaatcttccactcccactgattcattgctgcctttatcaagctataaaggattggaggtccttgctgcctttacaaatgccgtaagcttttcaacatgtcattgccatgcccatccttatacatttctctaggactaaatagaagttaatggtgttttcccccatgcatataaacgggggcatagaaatcggaattttaatatgcggcatatctctcccattacactacctatgtaaaagaccccccaatcgtaccaaatatacaatttgtcatagcttgataaatgtttggaaccctcaagcaccagatgaatgcctatttgacattcaaataactcgtgtaaagtttctaattagaaaaattgagtccccaatatacgttataaggtccttggtcacctggtaatgaatgtcagtatatgcctattccccaagtgacttgttgacattgctgtccagtatggacatcttgaaaaacgccaatccattgggagagaaagcaaaaagaataatggccagaaagtattggccatctctatcactataataaaaaaacattatattctttctagaatgatgcatttaacataattaattactaatattttctggggaacacacaaattaaactgaagagcaataatcatatagcaccaaacctgtcagatcagttgtatataatctataccacaagatttcaacattatcttgctagtgacatttttaattttgatgctaaatctacacaaataaacataataaattgactttaaggaaaccaacctacaataaagctgacccatagaagccacacaaatgctatgtaaaaagagattctgaatatttcttgtatttttttctctcaagatagtgctctatacctgcgctaaaaggttttttcctttctgaacatttatgaacatttatagtttcagcaacatcgtcttggataggaaaatgtcttgcacgtgtatatacagggcttcataattcaggataaaaagagcgtgggatgtaaatatttgagaatagattctcactatttatcatgggttatattttaattcagatggcagagttctcagctgctaacatgagcaacattattattccctcacaataatatatatctccagaagcttctaaaacttgggaaagatatattggtttgcataaatgaccaatgagaaatgaaaatgctttgcagagctcctgccaagaaaaaaaattgtgccatcagcaaattaagaaacaagagctttatttgatgaaaagcaaatacatccagcgccaatagtccatcaaaggcaaaatctgtagcaccatttactaatgctgaaaattttacatctacacaaattgtggttccatgttatttccaatattcagatggtgcttaaacatatatgcgtattgagctgcagttagcaacaaaattgaaaattaatgcagtagttatgggtaaggtaattgacatggaggattatatgacactccaaggaaaattgacaaagtatgttgtaggaagaagttttgtacaatgagcagattgcgtatttcaggaagcttggtaatcagcacaattcaagggagctcaatggtgtacctgacctgaaaactcaatcatgcgtcaaattggtaggaaaacaatgtaggcccaatctgaataaaccttccaatataaattgatccattaatgtacatctatgtactttcaaagggcaagtcacaaaggcaacacgatacatccaaaaccctattacagcttacataacatttcagcaacagacatgtaatcacaacatttaatgggctggaaaaaaatgctaatgaccttgaagcaaagagcaacatggaattgaatctcagcacatctccttttataaaatataagtaaaatgaagcaccacagattcaaagagaagctcactccacctatagacaaagagagagagagaggacatgatctttgtacatccaagccagagagatatattcatgtatggattaatggacattgctgctgattttaattatacatgcggtaagtttgtagctatatataagttcacaatgtgtacacaaactcaggaagacaatgtgctaggcatattatctttccaaggatcaaaacaaattcgatagagaacatcagtattgatagaccacacaactgagctctgtatatcagataccttcagatgcttgttggctgcttgaatgccaatttacagaatatgcaagcataaaaaaatcagaacagattgttccccatgcaaactaagaaaatacataagccggaaagaagcagtttgacatttaat

SEQ ID NO: 12863 - DNA, 1257 bp, Oryza sativa
ggtcacaataaaattgacttatcggacctttttctttgtacaaagctatttccaatttgccatatttggtttctatctacaaagtagttaggtggatcttaatggagtccaggctccaatgctgatgatgttcctggccataataacattgacttacctgacaatatatgagagttgcacacagctattgccatacacaaagaatcacattctgctcacgttgataatatgaggaagcatatcttggatggaattcatctttccccatcatgtcaattatgatgggatatttctgtatttgtaactcttgtgatgagattattttggtgagtgctgactgtgtaatattgttttctcatagatggcttttgaactatacggtatgttggctggaaatgtgagtccaacgacaggtgaaaatgttaaaccggcttacggtggtgatgaagaagcctttttgaagaaagttgtgactccaatatacaaagtcatcgagaaggtaccccccacccccccaaaaaaagtatatctctgtttccagctccatcaacttatacactcaagccttttacataggaagctgaaaggagtgaaagtagtgaaaggagcgaaaggagcaagacaacaaaatttaagcactcacattggagaaattatgatgatctaaatgagtacttttggtaagcactagcctaatttattctgagctacttttatgagttttagtttgttgtttcaaatttatgagctacttttctaaggaaacctgtgtgattatttctgcatttattctcaggtcaagagattgtttcagattaggatggcctatgagagctgatgcagatttttttaagaccccagattatgcttatcatgatgaagtgagcggagtaagtcccttatgatacatacctacctatattactttcatgaagaaccttcagcttagtaatacttctgttagtattccattcatgaatcacataggtggtaaaacaggtctatattattttttataacaaaccaaaacaattttgtagtatacgtcttcatagggtattcttggcagtgattttttttaaaaaacttgtggtccaggagaacagaagagttggtagtggccagtggatgggaaaagtaaattttgttgagataagtctcctttgggcacattttcgcagcttttgacaggatgggagcctcttaattttatctttacaggttaattgccaatccatgccttctattgctcatgtt

SEQ ID NO: 12864 - DNA, 1173 bp, Oryza sativa
  unsure (1)..(1173): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaaactgctgccgtcctgtttgaggtcctcaaagccgtcaatgtctcccagaaaattgaagttgatcaagcggtaatcttcttaactataacttgattatgcatttcttcattttcttcttctactaacttgtaataaataacctctcttgcagattttggagacacacaaccaagtcgaggaaaagaaaaaactttatctcccttacaacatcctcccgcttgaccctgacagcgctaatcaggctatcatgcgatatcctgaggttcccattcttctcaaaccctacctatcttaatcttacgtatcttttccaactcattctgcattttttattctcctcattttacagattcaagctgcttttcacgctcttcgtaatacaagaggactaccgtggcccaaggatcatgaaaaaaagcctgatgctgatcttcttggttggcttcaggcgatgtttggatttcaggtaatcacaccgccctcaggctcacccactaacttaaccattattttccttctcttcacctatctgtcacttatttgcaattcaactatcactctgcagaaagataacgtgtccaaccaaagggaacacctcatactcttacttgccaacgtccatataaggcagattcccaagcccgaccaacaacccaaggtctcactcttactcaacgtccatatcggtgcttgtgtcattctggtggtgcttgtgtcattctggtgtttactcttttctttttcctcacattttcagttggatgaccgagcactggacacagtcatgaagaagctatttaagaactacaagagatggtgcaagtaccttggccgcaaaagcagcttatggtacgatatttaatctaaaaatacgaatatgcacaaggtctctcaagcttgcttgatgtatcactatcagatggtcatttcctttccaggttgccaactattcaacaagaagtgcagcagcgtaagctcctctatatgggtctttatcttctcatctggggtgaggcggctaacctgagatttatgccgga

SEQ ID NO: 12865 - DNA, 772 bp, Oryza sativa
ttcctgcagccctgtcagctacaccactccgccagaacacttttcgagttagcttccgcacttcggaaaattttcccaggaaaaaaggttggtttcaaagtccttgatttcaaaacagcttatatggctttactcggacaaccggttttacccaagtcatggccgtcccgcactacacctacttgatgataaaaatgcctggtcctcaagggatcttataattccggaccgacttcaaccaacccgtaccttgtaacaaaaaaggtggcaaaatggttaaaaccacaaaacccttttgcccaccaagaaaatccactggcttgcaacaccgcaagccaaggaaaagtggctggcacccaagctgacaaagaccgaaaaaagtgatgcccagacgaaaaagattcccttagatcccttcgatcctgacaagactactgtaataggcgctgagttagattgtaaataggaaagcgcgctcatcacctttcttcaaaataataaagatatttttgcgtggaaaccatccgatatgcctggtatccccagagaagggattgagcactctttacatgttaaggaagacgccaaacccatcaagcaacgacttcgccgttttgcacaagacatgaaggatgcaattaaggaggaattaaccagctattagcagcaggcttcattaaggaagtccttcatcccgactggctgggctaacccagtcctgggtcggaaaaagaccgggcaatggcgcatgtgtgtcgattataccgacctc

SEQ ID NO: 12866 - DNA, 11921 bp, Oryza sativa
  unsure (1)..(11921): unsure at all n locations
tcctgcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaaggaagagcgcgcctcgccttcatgagcagctaaagttctcccttcaaaggttaccgggagctctcccttaagacgttgcacaagtgcccccaagtaagacatcaacttctccaagtctgcggggcgtccaagctcgtaactattttcccatgcagcggtggcagcaccaatgtactctatggtgccctccttgttcaggggtttctccatcaaacaatcttggatgctaaatagatcctcctccaccatgtgggcgttgcgacgttcagtaagcgtggactttggaagctccagcgtcggcaattcgtcagtcgccgaactcacagagttaagttggagatagcgaccgcacgtcccgaactcagcaaggtaacgggacgtcttctccatcaactcgttcatctggcaagctgtgtcggatggattgcctgaagtttctacaatgggtatagtacacttttctcagaaaaagcaaagaaagaagaaaatacatcaaaagaaagcaaaggagaatatgacctctattaggagtctaatcatccttaccttcctgatgcttttgagtcgagggtcccggagctgaagcggcatcagccgccggcatcaccggagaagagcggacaggagcattagcagccggcacaactgaaggtacatcgtcaataggtaccggagcaacatcggaagaggcagtagctttaagtccacccaaagcagttgcatgctctatcgtatcctgagttgcaagtatattctaagagacaggttatcaaaccactatgacatagaattttaagagaaaaaaaaagaattggggaaacacggataccttgccagtgccatcagaagaagaagaagaggaggaggaggagtcgctcaactggacagcatcaagctccgtgtcgggaaccacagagcggcggcggcggcggcgatcatcgcttgaagactccgtggatgacaccctctcataaactacggggttttttcctcgcttctcacgcatggtgcggtctagctcggggtgtggagaatcttcaatacgcagaccctttttagaagatttcggcaatggaagtctgtcaggacgagcagttctctccttcttatgacgccagtcacgcaggaatttgattgactcgccgtggcatttgtatcctcctcgatcatctctacggaccgggatcttcgcgatatgctgggaagggtcgtcacccttggtctccatctattgcttgccgccggatcctcccgggagcttatcttcgacagtgtgtctatctcctgccgagcgcctgtcccatgttactcgcctgtcccccgttctctgcccgtctcgcgggacacgctctccgccgccccggtcgctggcgccacgctcgcctgcacccctggatgctccgtcttccctggccatctcaagatggttgcctaataaaaaagtacaggatgatcaagaagcgtcctaattccagcggctaaagaatcgacaatggatatatacctgtgatggagttaaacacctgaggcgccatattgcataatcgatgcacaggcatgaccagcaatatataggcttcatccaaattactcgtaactgccaaggatttggagtcctggccgatgacggtctagctttgtttttctttcgccgcacggccggagataagcttcagcatgggagtcctttcgtcgcatgactaaactctaccggacatgtattgcatgagccaacacgacaccaagttaatttcgctcgctccacgatcaaaatttacttggtggggggcatctgtttgatggtattttggcgattatatgtgtacacaagacttactcatgatggacaaagcaaacaagcagtttgtaagttggctagcttatcatttctatgcaatgctcggccatgtatatacacgcaaatacatgcatgcacaggcagctgggaatatatatacttggattagtatatgtgcatgtataattaaccaataactagccgtgtgaagattggctagtgaggcaatcacgtgcatgcatgcatgtactatagtagacggtcgtatgtgtgtgcatgcctgggtgattaagcaacctatgcatatccaagtgattaatcatgggctcggcccatggccgaagacggtagctgcctacgcaccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagcagagaaacaaagcgaattacaaatcagatatttgacgccaggagaagctaagagataaaatcaaagaaggatatgaacaaataacaaactgatcgatcaagccttatctgcaacgaacttgacgcggaggaaacggcgcgcgaacgcggcgagcaccgaccccagacccctatataaggcgtcgacccctcggcagccaggggcattggcgaactcatccacacattcattcaccaacgcatctagcatccacaagccacccatcatcaacgcatctacccatccagcatcaacacatccatccatcaactctcatcggcgatctatccatcaactctcatcggtgatccatccatcgacgacacgcaccggcggcggcgagcgacttcggccggagtcccggtgtccggtaggagagggcgcgcgcggtgatccgatcatcagcaagcgcaggagaggagcttgatggctagtccaggtaaaagctagcaagattgtttcgttttctttcatctacaacacgcacacatccatgcatagggatccatctgcacgtatcgtcgtcgctggggaagttgcggtggccgattcatctacgcgtcacagaagcctcatcgatgccggtgtctgttcaagctgacgcagtgctacttgtccctggactcgacgctgctaattcaagccgctggtgatgcatctacccgaagctgcgacctcgtcgagataccagacattcttgatttgcaagcttcaccgcactggagcgggctaaccatggaggaggtcgtcgggaagccgccctgccggagcgcgccgaggatcgccggagctgccgccgactgccaagacttctatcagttctcatgccggaggtcaagcatcacgcatggcgtcaaaaccagcggatgatgatggaggcaagtatggctgcagtacagaggaaggacgacgggaggacggcgagccagtgctgttggatggcaacaagctaggtaatgcatgttgattaagttaattattgtggcaacgtggccaaccaatcggaggacgacatgtcatcgctgctacagtgccatgcacaaaccaatgcgtgggctgaagaagtcctgttggtttttcttatttgtcccaaatgagatgccgagctttgattaaatccggccgccgtctacatcaaccatcttcaataattcctccctgattcttctctaatctaatctcgacgcaacagctgtgacgtcaagtcgttcaagctacgcaactccatgcatgtcttcaccaacaatctacatcgacacgttgttcaagaccgacgaggctagacaacggagggtgggcaaccaacaccggcgcacggaccgacgaggccatggatcgctgccggcgctcacacacacacacacacatctacatcatcatcacaaccatgcatggagaacgcgaagcgaacacgacgagatgaccacaagcagcttaatcggaggttctcttgcaggcctagacctatggaggtaattaactgggagcttctcgaggccccaggaaccaggagaccacatcgcacaagtcagatctgtccaatgacatattatggagcgcgcatacatatatattacattgggaatttgtatttatgatcttttaagattaataaagagcatgttccctatgttttgtttacattgtgtatttaggtacactggcacgcccgcacatatatgtatctctaaacaaatgagatctcagatgttattttccaccctaaacagttatatcctaacttagagacggatgatatggaatgaattagaggtagcagtcacctctattataaacttgctcttaggtttgtctcgtttgcctaaaatgatttgacactagcaaattgaatagggttgtgctgaaaaaagaacaattgcacatcttaccctattttgaaggcgaactatcaatgtggtcatatttttttaacaactttacttgtttgatcctacttttcaaaaccaaagatatggtatgaccctattctgttaagaccatataacggtgctaactgaagcccaaaataccacttctgtccttgctcatttgaccatattttcccaaagcttttaattagtttgactagttttgtatggtggaaaattaagaaagatttttttataaattgtgcacttagtgtaggggtttacatatatgtgacaaatttgacttagatttgctagatacttcgttggaggcatcatcgtcaatttgtgtcaagcaatagctaagaagcaatccacattggccatcctccccaccccaggatctgaacctgggtcgttgttggcggttgacctcacctctaaaccctatcccacccctgtcgatcgtctccaccgtcggtgaacccctaggccaccaccattagggctcgatgctcttcctgttgcctagcacctctctgcacagattggtaggccgtcctcgcctactatcccaaccttctctgtgctcgcatttgtggatcttcatcaggccacccaccgctggcgctgtcctccacgcccctaggtctccaccgctcaaggacgtcacatgggacctcaccgatgctagcaccgttgggacatctccgtctacgtctccacccgattggctgctagacttcctccccgcgcactgccagggggcactacggctcatcttcgccacaactccgcttccttccgtgccggcgtgcagctcggcccccttcctcgccagcttgctcctcctagatccccgtcgcccgcgctgcacaacacccactatactaccaccagtcggccttgccactcaccgtttttctccaccagccctcatcgtcggccatcatctactggcggctccctctgctcgggagatgtccctctccttgcacctccgctggtggggacatttaactccatgccacttttaagacgtggcaattaattatttgccactcgttgtctgtctatgacatgtgggccctcatgtgtctatgacatgtgggtccagtggcaaataatttaacaccactcgtaagagtggacctaagctaatcgccacaactcggctccaccggccttacaaagcacccacctctttgccaccggccctgtcaccctcagggtttacattaccgtcggtaaccgcgcggggtacggtaatagaaaaaccacggtaacctccttaaattcaaataaatttaaaaagtaatttgaatttttgataaattttgtccggttaccgcgcggtaaccttgcccccagcggtttgggaaaccctggtcgccctactcggggcgcctctccgtgtcgcataggaaccgaacctcaccccgataatcaccatcgttgtctctcatccttctatgttcatgccgcaccgcctgtgctcctctcctctctctggtttagaccagttgagacagggatagggatagatttttgaggttgggttctattcccttcccgcatttcggtctttcttactccctccgtaccaaaatacctatcattttaagtttttgttgtagcgtttgaccattcatcttatttaaaagattatgaaattattatttatttttatttgtgatttgctttattatcaaaagtaagtatgacttaccattttttatatttacactgtttttttaaataagacgagcgatcaaacgatgtaagcaaaatgtcaaaacaacatctaatttgaaatggatgtagtatattctaattgcatctttttaaatttgttgctaacgtcgtggtcagaataaagtcaaataatagctttgatttttaaaaggagagtcaatcaaacaaagttaatagaacaaggtcattaaaataggatcataggcacatttgtcccttagaaaaaagtaaaggcatagtagccagtaatgcgcgttgggcccctagcctagactagtctccatgaatgcggtgccggtgtttttatttttcacgtttggacggcatttgactctagtgtctgccacctacttactccgtttttagaaactaatttagagtattaaatataactacttataaaactaattatataagtgaaagctaatttgtgagacaaattttttaaacctaattaatccataattagagaatgtttacggtagcatcacataggctaatcatgaattaattagtctcaatagattcgtctcgcgaattagtctaagattatggatgtgttttattaatagtctacatttaatatttataattagtgttgtctagatttattgtactataatatatcacatctagttggtttttatgggaagaagggagtacggtacacgcaagcaatgacacaaacacccctgtcctgtctcaggctctccctcgctcctcttgggctcaaacaagaagtggagcagcagagacaagaggactgattgatgaggccgcaaagcctggctgcctgcctgcttctttcccccactccattaatccaccaccattaatatttcttgcgctagctgcttgcgatctgcgagcactcgcactcgcagctgctgcaacaaaagaagaagacggggagggagggaggatgcgggagatctggagcagcttcggcctctggatgctgctgctgatgctggaagctgtttcccctgcaaagatccacggtcggtaaccaaagcttccatgcattctcctccgagtactcttcgatctactactcctatatcaagtagtactagtagtagtagtatgcagtagtggagtagtatgtgatgactaagtgaacgacgacgacattcagggaaccccgcgaacgacctggtggcgctggtgaacgccaaccggacggcgaccaagctgcctcatctgcgcaccagcgctggccttggctgcatggcgctgcagtacatctccgactgcattggcattggcattgggtgcgccggtgacaacacggtggcgtgccagccccccgaggcccacatcaccgaggtgtacgccgccaactgcggcgtcgagctccccacggtggacgtcatcacgggccgcctcctcggctgccaccgccagcgctccgacgcggaggccgcgctggaggccgtgctctccggctccggcaacagcaccgccgctagagcggtcatccgcggcaaggagcacacccaggtgggcgccgggttcgaccgcgcgcaccgccgcgggcccttcttctggtgcctcctcttcagcagcggcagcgccaactccaccttcctgctcgaggccgccggcaagggcgtccaccagtctcacggctgcttcagcgtccctgacaacactagtctctctctctcctgcagcagcgccgccgccgctgctgtgcctttgctcttcttcatcctcctcctcctcccagtactacaagtttattattagtacttaccggtgtatctcagtgcctgccggtctcgttcctttttctgattccgattaagatacatattttattttgatttgtgttagcatttttttaattattaaatgtatgcttagtaagaaaatggtttttttctaaaatatcaaataaacctattttctaattaaataaatcgaatcctgaggggtttgtcaaaaaaaaaccgattctagcaaaaaaaacgagaaactccatccaatcgtttgtgggccatactaatgaatacggagggtagtagcagtggatatagagggcaacgacctcccccgtttacacgcccaaaccttatctcttcccaagcaggggcgggcccagctataattcaagggtattcagatgtataccctaaaccctatacccaagatttttagacaaaaaataggtatatatactctatagttcatatatgtattcaaaaagttaaagaaaaagacttaaactactcatttgggcctcgttttgccatttctttctctattgggtctaaattttccaccttcctccccctttcactcggcccgtagtctacttgggccgcaactaagaccatttcgaagccaaactcacctgccaggcagctaacccaaaatccccaattcccaaattccctaacctaaccctagctttgcaaggagacgggcggcggggggcgctgcgtgcggcgtgcggtgcggcggcgggcgcggtgtacggcggcggcgagccggcgaccgcggggcagccagccaggcaggggcggctgccggctggacgcactggcgcagcatctcctagggtggcggcggagcgggcgcacggccgtggaggcgtcgacgcaggaagaggaccactcggcttggcgccagggcgcggggcagcggctgactcgtgaggcagcggcgcggcgcggcctgcggcgacagcggcattgcggcgcgacgcgcggcctgctgcgacagcggcagtgcggccatggacgacaagctctacccgcctcgaggcccagcgcgaagaaatcaagtcccgagccccgaggtaacgaccgcaccccccggcgatccttcctcctggtttggtttaatccctagctcctgtctcatgtgaatcccctcggtacttaggttttgcatcaagatttcagtttcgcatgattttctatgtttagcatccatgtgttcctgatcctgatgttggatgaactagtaatgggctaacaacctttttttaattgagattactagcgacttagcaaacatatttctgtgcatcatatatgctaatttgtgctttgtatcataatgtatgaacttgagaagcaagatagggcaacaatagttgaatgattgtttagttacattcattgaaagagaatttttcttgcaaattaaagacaaggacatcatcacttatttccaaaatatcaaacaacgaaaagttgatctccaaactgtaagatttcttcccaatttatcattttctaccctttatgtatttcatatgttggcactttgatatgtttactaattagtattctatatgttaaacaatttcaaatgatgatcaattctatcaatgtgtgaatttatgctcaattttatgctatatacgctatatattatataattattagtttgtgatactatacaagccaattagccaattattaggtttttaggtctatgaacaaattttttttacccctttctatttcgaatacacaagtttaaaatcctgggcccgccactgttcccaagcctctcgcatctctctctcgttctctcgcggcggcgtccagatgtggaacctcgccgatcctcctgccccttccacccctctccccctccctcctgcagtcctgctccacccctcactctcctctagccgtgattttctgcgtccgatgcggcggctgggatgtggcggctgaggcaaaggtttgcggggaagcaggtccattgaagccgacggtggcgtcggatggatgcagcggcagcgaagacagtggcatgctgttttcatggagaaggtggaggtgactgctggatgcggtgccgttggggatctgatgcagatttccttttttttctctattcttggttcttctatgttcttggtacttgctagttcatacaggtgaattaaaatcatttatttttttccctgattggagggatgctatcttttctctgacaaatgtaaaaattagttctttcatctgaattgagagcaattcttttttttttcagattgctgagatgtctcttctttcggcagtgcaaatattcgatttattttgccttttttttctgtcatagatgtctcctgtatgtgttttttcatattgctgagatgttcttctttcggcagtgcaaaaattcaatttattttgccccttttttctgtcatagatgtttcctgtacgtgctgtactagtagtattaattaatggatatagatagcggcagtgttgaccttaatgagggtactttggtattttcactttcgtcctacctcgggaatccaggaatcgatattttccgggacggagggagtacgtaatagacttttcactttacatgttcgtacttaatttctatcttcattccatctcaaaacagaccttcgtcagagagattattacccatcttatttatactaccatcttattaaggaatccatttatattaccatcttatttaaatgtagtagaaatattttgaaagtagtataaatatgaagaggtatagttgtaaaagaaatatgaatataaatgggtaaaattgtaatgtaacctagtacagttaaggtaaagtagtagaaatatgaaggggtataattgtaaaagaaatatgaatacggatgggtaaaattgtaacctagcactcaaacaacattcttgtaaaccaatcatcattggaggggccaccaccgccagcggcgacggcttccttttcctccgcaattccatttatttcttcatgaaatatatctgcacaactgccgctttcacgagaattcatttaaataatacattcagatcgacttgaaaggagagctgatagcatctgattagtctattataccatgaatcaaaatttttctactgtattaaccagaaaccatgcaactataaaatcatgaatcattactactcaacacattgtgcagtagaagtaggcgttaagaagccgaaagaagatcggcgacgtagtgcacgtctatgttgaggaagcattgatcgcagcagtccaaccttctccgtctcgtgtgtttgccttgccgtgctctcacgtcgatcagcaccgcaaaccagcggcgtctctaccgatatctacacgtctaaaggcggaatgccacgcgcggatgtgctagcgcccgcgtgtggctagggtttggctcgggagaggacggctagagtttcttgtgggacaccagtcacatcacctcaagaatatataagtaactgggcctggagacacataagaatcatactcggatccctatccgaattaagtacatattggatcttcatccaattctcttatttcggcctattgagtgtgtgactccgtaggttcatgtacactctgctacaacatggaaactccttttcagtccacgtgtcaacagcggctcctagcagaacatacataaagatcatatcgattgaacctttatatacacttgtatgaaccccttcgcctcacgatatcgattaagctcaaggttaaatatgtaccatcctttaatagctcaatcattcattcgatcttttgatagattatttaacatgtaattgactactcaatcactttggcatggctatgtacttctataatctataacattgaggggcccagagatatctctccataggaggggcacatccatcttgattattttatcccactacatgtt

SEQ ID NO: 12867 - DNA, 3436 bp, Oryza sativa
  unsure (1)..(3436): unsure at all n locations
ttttgtttaacccttttattgtattaaaaagatcactgtttgcacaagttgcaagcacctaacactgattaaacatggagatttaaaaccgcatgtcaattgtcatgaaaaaactgtaaacacaggtcctgttgccgtatgtggagaataaaaaagtgaaatggtattagggagtagagtcccttttactagtttaaggggtgaaccataaaaacctaggccctttggcaaaataatttgagggagtaaaatgaaccctttttcaaaaaagaagaataaaatgtagtacttgctgtgtttttgaactgcattcaatgtatgccgctgcaccaatgagtttcctcagctcttcgccctacattgattagcaaaataattttaatgacttgtgtaacaatgctgggaagcaacaaaaatacaagcaaactaagctttgaatacctgagcagtggaaataggtacagcaccagggtgatctacgaaaaattgcttatcatcccgcagatctattaacagtaacttaatggttaagcaccgccggattacatcaagtacgcaagtgattaataaaagcacaatgaacagaaaagcaaaagaatattgcatttacatgctgaggctaggacatgtttctgaaaactatattgtgtatgattgtatcaggagcaaagtacaacttgcaccaccaaagctgctacatcgaacctgatttctaactccagtaatccacttaagaacataatctaacaagagcccattttggtcagtgaggactaagtctctaaccacctaacttgcctctaacgccagtaagttgacaaggctgttagctgacaggctntatctatttataacttgctgttagctgtacaggctttatctatttataacttgctccgctggagcagaaattcaatggtgaacatccattttgagcctttcaaatgttcgctagatgccattttaactgagcatgcagtatgaaaccgtgaataaatagcctacagaggatgtgttcccaggggacaatcctaaaagcccacctgccttgtgagatcaacagaatggaattctcatggtattcaatcatgcagtgtaaggtattggatcgggtcatatgtgcctttttattagcaacttagcatgaaaactagaaatgcagatttatcaacatttagcatttgctgaaggaacaagacaaaatatatttcagaggaattttcttttcttgatcataaatcaataagtgatatgtacaggaccaactggagtataggtcacaggcttaactttggagactagtaaagacccatttgcagggcaggatcgtcaaggtctcaatgaaatacaaacaaaaccattgcatgctcatttgtctctcaaactagctatgatactcaactgtcatagcatgtgaaatgttgctgaggtaatggttaacaatcaagcaaaaaaagaaagcattaatttcaaacattcttagataatggaaatgatttacatctccagctttctaccataagacagccataagtttgttcaaaacaggaaaatgagccataaggtgatgggacaaacccaggcccgtcaacgagggcgtgccaacggagcgtcagcgcagggccccacaaaaatttggggcccccaaatcagagagaccagtacaaccagccagccttagcatatacaactgatgtcatgtgtgtgttcatgtgcatgcatgcgaaccagcttctgaatccttgatcaatggttacgatgcccagagcagctggccgactacctcgtctatcatattagagtttctaatactgaattgttgatactcaattgttgaattgcatgcatgtaatgatcaattgaatatttcagtactcttcttttcaaatcaaattaccatgaatataattacgaatttaaattaaggaccgaatcaaaagtaaatttaggatctcaaattatatttcgctccggggcccccaattcctggagacggccctggacaaacccttaactctcctttattattgactagcattaaaccacatagattttttatccagcaattctaatggaactatgccacccatagtggaataagagactcttagctaccgattccccacaaaatctaaatttgaaaaaaaaaaacattcagcgttagtctaaggatgtcacccaccaaaaaacaaacattcttgatataatgcatgtcctgcaatcctgagggacaccaggtcaccaagcatctacaaatgtcccctgatagcatataacacttcatgtgttacaggtaacatgtttcaaggtataatgccatatattcagtcaaaacactgctgggcagcaatcatgctatcgtcgaattcaaatatcttgtcttccatgaaaccatgttcacatagatttccacatgcaaatattttacatttaaatatgattttcagatatcataagcatatggctttgctgtgaataacagtaaaattgaatttacatatacaaacatgctttcatagagtgttcacagcacacaagcactcaaatgatgagacaatttataggaagacagcaatcaccactcagttaagtgcaacgccaagctgctggtaagtgggagtgaaaatataatagcttaattctacagatatgtgatgctttgcacaaatgctatgcaacaagagttggaagggcataccaagctttgttccaacgagaattattggcacaccaggagcataatgccttaattcaggtatccactgacaacagaaatatatatgtgtcagtgcaagataacaggttgactaagctaaggtacttcatggagagagagcaaagaaagtgggcggcaagattttattgcctttttagaaacattctcatagcttgctttgctgatcagagaaaaggccagcaggaaaacatcagcgccacgatagctcaacgggcgtagcctattgtagtcctcttgtcctgttaaatttgtcaaatttttatttattttgatgaccgtgaaaggtggatgtatataaggaggtttacgcatgcatccattaaaaggaggggaaagtagaacctgctgtatcccacaaccccaagttcacagtgctcccatcgaccacaacatttgcactgaagttatcaaaaacagttggaacatagtcctgtaacatagagatgaagaaatgtcccattaaacatacagtctgccaattaaaaatgcaaagatgcaatacattagatttattttttcgcacaaaacgaaaaggggtagctgagttactgacggtgattgacagaggtcacggttagaatgatacagagctaaaacaaattcaccaacaaagagaaacgtctagaggtcaatggtggcgattagctacggaatgatggagccacggttagtaatagcagacaaaaagtcagacatacc

SEQ ID NO: 12868 - DNA, 12797 bp, Oryza sativa
caaaaaaaaggacccttttaaaaaaataacgttatcataatcatcagtccccaaattttagcaagcaaaaagggaaggaaagctgatctatgtcttctctacacccagtccccagtccccagtcccaagacaagaaaaagaatgtttaccatggagtcgatcagatgcatactcgggcgggcaggaaggatcgagaagaagaaggggggaaagaacggattgcctaccgtggggaaggtgttggaggtgtaggagatgagcatgcaggtcttgcccacggcgccgtcccccacggtgacgcacttgatgaaccgagacgcgctcatctctactctcactcagcacagccagcgcatccggtaccctagatcccgccctcttcttcctcctcagtcctcactccaacgccacggacctcacctcagctgctgcttgctggtgggggtaggaactaggaaggcgaaccagaaccagaagcagaagcagaagcaaaagccgacagacactgagttgcactcaggtccaacaaaaactccactattacattaccttcctttcatccctactagtactagtagaataagataaaacattttgcagagaagcccctattcgatgaacatggtgtgatggcgatcataataacaacaattttcgaccctatttttttattattacatttatactatacgagcctagagaagtaagaatgattgagggattattatttcttcaaaaacatatttttttaataatatatttcattcctaagaaactataaccaattattacagaggtcgtacgatgaatggatatgaattacaaaatcacgggttgattaaaacataagaaagctatttaaaataccaccttaaagattgaggtttttcatctatggttgatgagaatctacataatcattgtttcttcaaaatgacatacattttgtatgattttttttattaggggttacaatctattaacatatcaaaataataaaaaaagagtctccatgttcgctctcacggcctaaaaattctcatattaataaaaaaaataaaaaacgagtccatatagaaatacaatttaaatagctaaaattagaaattaaaaaaatattggaagaagagtccataaaggaatacgatttagacttaattgaaatttaaaatttaaaaaataaaagtatagtcaaagtccatatagaaatacattttagaaataaataaaattaaaaattaaggaatatgggaagaagagtctagagtccatataggaatacaatttagagataattaaaattcataaagtttagagttcataaaggaatttaaaagaattgaaagttggaattaaaaataagaaaaaagtaaaagtagagtttacagtccatgtagaaatacactttagaaagagtttagaaataactgaaatttggaatttaaaaataagaaatattagaagaagagtttagagaccatataggaatacaatttataaataactaaaatttaaaatttaaaataaggcatattgaaacaatattatagagtttatatagaaatataatttacaaataacaaaaatttgaaactaaaaaaatattcaaataggagtaaataatggaacttcgaattaaaaaataaagaatattggaagaggaattcatagtccatatagaaatacaattcaaaataactaaaattcagaattaaaaaaataattgataactatcacgtgtatacaatacaatataaaaattatatattggttagtttgttctacttagtacataatttcaaattatgttgccattctaataataatatatgaaaatatatatgttatttatgtgagaaaatataacagtgctagccgagcaatctgtgcgggccaccatgctagttcagaacaaaatgactatactaacattgttttccaaaaaaacaacatcttgataatcaataggtgatcattatgtcgatcgatgagcatatatctgttaacgtcaaaattggtaaaatccaaagttatcattcgcctagaggaagtatcggcttcatatacctaaaatgggtcgatggatattatcagcctccaatagttggattttttatggattcagttaaggaaattaattaattaaaagaaggttatccagaagaggccgagtttaaggaggatgcggtatgttaatttatctattaattgagcatagtcagttagttttctttttatttcgaggaaagtgtgtttagtatcttttctttatctttaagaaatattgcgtcatgtcaaattaggactcttatcggcctatgggtataactatgtacaccctggatccctgtaatctatctccacaaatattctcagtgcatagctgccctcttttgcaaggttattatcaccaacagaacttggcacctgacgcggggctacatcggcttcgatctctggcgaagaggtaaaccctaagtttcattagccctggtcttgtcttagtcgatatatctctacaatcacaatatgattttaaatagatttgttatatctatcacattagatagattcatcgacttattgagtattaaattatcatgtacaatctcgtgctgcatcggttagttctaacctactagattggtaccgataatctaaatcttgttaagcaaataggtgcatgctaatgtttcatcagaggtttagtcgatcttatctgatgtattaaatttctctttgatggtttttctatcttagttaaatttaatgcatgacaaatttgatcggtatcatctcggcttgtttaaatctattaggcaattatcaatcttatgctgcatcggttaggctcgacctatgaggttgttgttgtaagttatatttatttaagtcagtaggcatcaatcattgtttcatcggggtttcagccgatgagttatttggacattgtttaagtgttctatcggcttatagagattatatacaagttggttttagctgattgcaacaaaagtttcattgattacttaatcatttggatttaatgacatcgggttttcagccgatatatactttaaccatcggattagtatttattcaatcatactattattggtccattggtttttattgaattatattgttgtattattataagttcactgcttgtccaattatctttgtatcatttattcaagtatcagaatctatatcggacatatagctgattgttcaaaactctatcgatatcggctattaccgctacatcggcttattggccaatcgactctttgatcatcgatttatctattttatcatttgcagaatcaaactggctagcacgctcgcatctcatcaataatttaggacctgcactaaaactaagcagatctacatacattaatgttttcagcatcaacaatatcatcggcagtaactaatgtcgaatgaaagcggaagatgacatagaagagtaacttagctataaacagtcatccacccagatttgacataaaacccagtaaaccaatctgataaaaacgcagccaccaagagtatcgcaccaacataaaacctccgatgccattactattccgcccatctgaaactaagttttcaccaggaggatctatcagcatcacctccaagaaggcgtgtggtgcccacggacatcaccgatgtcgatgctcatagcaacgacgacttcagttgcagatttacggtgatttgtgctcgacctcctcctaggctttgagtgacagcagcgacggtgacgggaggtggcttgcaacgggaaggaaggtggcgagttgcgcgcgccggcggcaccttggcccaccatcttcaccagttcgatcggagaggtttacagcagcaatggggtagggcgaatgtgctgattcgaagctcccgtagcccgatggcaactacttgagcaacggtgttgagagcacgccccctagctaggatcgccagaagctggatccggccataaccaggtcgtcgaaaaatacagatagctaagctaattgctatgataagatctttagataggttaccgaacaatatacaaattaatcttgatgcacgcatgtatatatatattgctgttggacacttggtttaattttgaggagcattatattgctggttatagatgctatatatcgtccttgcttagcaatatatcgtgagtaataattgagatgggaaactattaactagtgtttgttggattggttctcgatcgatctgcagagaagcggaggtctattttgatcgatccgagactgagactctgccatgggccatggatattggaaaattaaaattagtaacaaattaaaagatgctatagccattcgacgttatattgttgttgtacataagttgagttgagttgaggccatacatgcagtgcagggatggtgtggtggataagataagatagtgtgatcgatatgatgctagtggaaatagctagctagttgacgcgcctgcagttggctcggacctcgccggcgacgttgttgagggagctcatccgtagcatggagtcgacgaagtcacggaagaaggcgggctgcgacgcggcgtagagcgtgacctgggcgcgcgtcttggggtgggtgagcagcgcctcgtcggaggagagaaggccacggccggagagcagcatccgatagtagaagttgtcgaaggcggaggaggtggggtcgagggaggagccggcagacctggcggtgttgttgggtgggcaggagcggcggagggtggcggcgaaggaggggtgaagcgcggggtcgacgccctgcggctggatgcggttctggaaggaggagcagtgtgcgaagccaagcgtgtgaccccccgacagcaccaccaggtccttggtcgacatcccgcgcccgtggaacgcctgcttcagctggtcgaagctcgccgtcggccccggtagcgccgtcgtcgtctcgctcgccagcgacacgcgcccgtcacgacgacccaccggcacttgccaagaaggaccaccggactgcatgcagtacgtacgtacgtttagtactccatctcatctagctatatattgatatactcctgtatttactacttaatttgattgagggccggccggattaccatggcgactgcgtccctggcggccagcgcgaggatgtcagcgcaggagacgacgccggggcagagggcttcgacggcggccttggcgttgtcgatgacgtagaaggcgtgcagcgacgcgttgggtgggccgtccttctccgccgacatgttccccgacgagtccaaaagcacggaaccgtcgcacccctgcagctagctagcagcttccttcattgatgttaatatatatatattcgaattcgatagagtagctagctagttaccctgacgaagcagtcgtggaaatgcaggcggagcaggccggccggcaccgtgcggtctttggccatggcctgcttcaccgccgccgccaccgccgcctccgccttggggcagctcttggcgtagtagtccaggctcagcgcctcgccgccacccaccagcatcgtcatagtcatcaccacaacgattagcagctgtaccagatccagatgggactgggacgacgccattgctgatgccattgcctgctgctgctctgcatcgatcgatccgtcttagagctaccgtgctgctaattaagctatgtatgtatgtatacctcgttcgtacccactctgctttggctttggagctagctagattattagacaagaataatactatatggtactggaaataataattattaattgtacgtatgtagtatgtatagcaccagcagcatgcggctggtagtggcgatcgagaagagagagctggataatactacattcattcatgactaattctcactgcattgcatgcgctttacaatacagacagagacagacggacggacagacggacagatcatctatctctatacttactcttggcctggcatgctcgcactgcagaatgctcctggcgtagtactactagcttagctgtgttgcattggaaagtgtttgcgatgcacagaaagaaatggagaaattactacccccaccccactcgatattggatccactagagctagaaagaagaaagaaagatgccatacgcacgcatgcatacaaacgcatcgcatgcagccaaggcacgtgccctctgtctctgcgtgctgcacatgctggcatgcactttgctactcctcactctcactcatgggctcatggcagtggcaggcaagcagcatgcagttggtactggaccagtgcaaccatttccaataggattatcatacattaccaaccggctggccatgcatccttgtccaccgtgacccttttttgtgtttcatttgtccatcaattaattcaaacacagcggccgtgcaaatgcaatgcctctctatctgttcgttatatcctagtacattactgtacaatttgttcggtcaaatctacgtcattaaacacatctgtctagatatctgaggcaaccgattccacttgtaccttcgttgctactcgtatctctcttcattcttactctgctagctagctagaaccaattaagcccggattaaccatccattaattctacaggcagcccacctcaaattggcttcgattgaagtcatttctatcaagtgtggctcggcccaattgtccttcatacttgccaagcttagcccactgcgcctttgttacccatccgccgagccaccttataccgaatcaggggtaatttcttattcgacccttttctaaattctatcttaaaattgacgtacactaatttttaaaactcatcaacatacaaatactcccccgtctcatcaacatacaaatgtgtcacatcatcacccattagcaattactcccccgtctcaaaatataacaactttagccctcaagatttgtcccaaaatataacttctctatcaacattctcttcccaaccaatcacaactctctaccatttactttttctacctacctccactactcaacaaatcacaacactgcatcattcacttctacctagtagtactttcttaataaccgtgtccacctctaaaaatatttatattatgggacagatgtagtattatttagaatattttaaatcacatgcaagtgtatcacatcatcacttactagaaattattatctagaatattttaaatatcatgcaaacaaaacataccatttatatttttattgtatttttagaactcaatatgcaaacaaatatcaaatcattatctccacatcattttcacattatttaaatatatacatctaccatttctataatatatacttcatctgtcccaaaatataaactttttgctctcaggatttgtcctaaaatataacaacttctccatcaacattctcttctcaaccaatcacaaccctccaccatttacttttcccacctacctccactacttatccaatcacaacccttcaccatttatttttatctactttcttaataatcacgtccaactctaaaacttcttatattctagaacggagggagtaacatgaattaattcatcacatattccgtagcaaagcgtgtggtatcaactagttttagctaccaatctaaccttactattttgagtttgcttaagactgaccatattccataaaggcaagataacatcgttaactaaaggtaaattgccatttttgctcttagtcatatcaccctgttatatgaaagatttgtttatttggaaacttttgacatatttataacaaatttggcataactttgaaagacttaagacaagtttggcatatttagcttcatttttgtcaaatttgacttcaattgatgcttgcctggccaagccagcaggggttttgcttgtttggtttgccatttccgcccgacaggaaaaggtgttgttgggtttcagattattattgctcacaagtgttaattggcaagcttatacggttgtgctgttgagggctatgtcagggttatgaataccacatacctaatagtagtcgactacatctcggcagggcccaccacataccatgtcctatacgaaaacaacctgcggatatggagagagttccggataaagaaagacaaccagagttctacatggaaacgaccaggactactcggattgtatccatattggtttccctagttctacttggacaaggggacacctataggtataaatacaagaccccctaaaaagagaggggagacaagacaatcgacagacgatcaacacgatcgagacccaccacaatcaacaaccaacacaatacacgagacaacatacaagccaacgtatgccaagacacgccgccggatatcaacttcagggataggcatggctattcccctacggtgtctccggataccgtcaggagagacgaaagcgcttgtggagattatggttaccccatatctacatggcggttatattccagctggatatacggtaccaaatatagatagaatatctttatgaggactcgggttaggttctaaacttgtatgtcaagaaaatacccgggatcctagtcggttacgattgtattttatctgtaattccatattccgttaggatatggattgtactttgtattacggatcccttcccctatataaggagggtccgtgtacctcttggggcacgatttcttttctcccaatcatacaatcaataacacactcggcggaatcatccccggacaggagtagggtattacttcttgaataagaaggcctgaacctgtataaaattccttgtctccaaacccatccacttttctagcttgatagccaccccttttattattgccgaaatcttgtttcgacagttagcgcgccaggtaggggcagcgtcaagttctcgccgactaagtgcgatgggtttcgtttctggcatcgacgacttcgccttccctcccgggcaggcgttcaggttcggcagcctcaacttcatcaccaacgacttcggcaagatctctctccttgactcggattcaaaccagttggggagagaccaggtccccatgcgagagagctcattaggcaacaagacgtcgacgggacagcggtctttcgcacctcccagcagaacgcggttgcagcaatcactctcctcgacaccctcctcaaggaagacgcactcaaccaagccgatcatgttgtcaacatcttgaaccagacgaagaccatgatcgctgccttggttccagccaactccgcaagcacccgcaccccgactggtagccgagtccctcacttccgatcccatgatcatcattagtcaagcctcagaatcaccggtacaggatctactcgcaggagcaggggtcacgacgaacgacctgttcactcgcctcccgaacgtcacagggagcgccgagctgaacggcctcgctctccacctcgccagcgtcccgttgaccttcgcgacacgatcaaccagcaccgtgcagcacgaggtcaccgccattcaccaaatcgctacgacgacgacgtggatggagtagctgccttcactagtgacctgcgtcgagtggattggccagccggctttaagccgactagaatcgagaagtatgacggcaccactaatccagagtcttggctcaccgtctacggactcgcaatccgcgcagcaggaggagacagcaaggccatggcaaactatctacatgtggccctagcggactccgcccgatcctggctccacggactaccccgtggcacgatcggatcatgagcggaacttcgtgatcacttcatcgccaacttccagggcacctttgaacgccccggcacacagtttgacctctacaacgtcgttcagaagtctggagaatcccttcgagattacatccgacgcttctccgaacaacgcaacaaaatctccgacatcaccgacgacgtcatcatcgccgccttcactaaaggcattcgccacgaggatctagtcggcaagttcggacgtaaacctcccaggacggttaagcagatgttcgaaaaagccaacgagtatgccaaagccgaagatgttatcaccgcgtccaaacagtcgggcaccacttggaagccaaagaaggacacgccgaccgcaggggggagtggaagtaacaaccacaaggatcgcaagcgtaagcccgaagaacttgtggcgaccacctctccatcttcccgacaacatccccgcgtcaacaccttcgacaagataatgaactcccaatgtccgcatcatcccaactccaaccacgtggccaaagattgcttcatctacaaacagttcgcagagcaatacgttaaaaacgcacggaaacctgcagacggagatcagggcacatcaaagaagaaagatgatgaaaacgatgccccgactgattttcaagatcatcgcaaagaacttaaccacatcttcggcggacccctggcttatgagtctaagagaaaacagaagctaacagaacgggagatcaatgcggtccagcctaacatgccccaatatcttcggtggtcagagacagcaattaagttcgaccgctcggatcatcccgaccgagtggtccacccggggcggtaccccctggtactagacccagtggttcgcaatgtcaagctccgacggactctcatcgatggtggcagcgctctcaacatcctttttgctaagaccctggacgatatgcagattcctcgcacggaattaaagccgagtaatacacccttccatggtgttattccaggattgtcagctacaccactcggccagatcactcttcgagttaccttcggcactcgggagaattttcgcacagaaaatgtttgtttcgaagtcgctgatttcgagacagcatatcatgctatactcggacgaccggctctagccaagttcatggccgtcccgcactacacctacatgatgatgaagatgcctggtcctcgagggatcatatcactacggagcgacatcaagcaagccgtcacatgtgacaaagaaagttgcgagatggctcaaacccacgagaccactctcgcccacgaagagatccgactggctgcgaccacggcaagcgagggagaagtgcctgcaaccaagctgacaaagaccgaagaaagtgatgccaagacgaaaaagattcccttagatccctccgatcctgacaagactactgtaataggcgctgagttagattgtaaataggaaagcgcgctcatcacctttcttcagaataataaagatatttttgcgtggaaaccatccgatatgcctggtatccccagagaggtgattgagcactctttacatgttaaggaagacgccaaacccatcaagcaacgactccgccgttttgcacaggacatgaaggatgcaattaaggaggaattaaccaagctattagcagcaggcttcattaaggaagtccttcatcccgactggctggctaacccagtcctggttcggaaaaagacggggcaatggcgcatgtgtgtcgattatacggacctcaacaaatcttgtcccaaagacccttttgggttacctcgtattgaccaggtggttgattcaacggccggctgcgagttactcagcttcttggactgttactcgggatatcattagatccgactaaaagaatccgactgcttgaagacctcatttattacgccctttggggcctactactacatcaccatgccctttggattgaagaacgcaggagcaacctatcaacgcataattcaaaggtgtttttcaactcagatcggtcgcaatgtcgaagcatatgtggatgatgtagtcgtcaagaccaagcaaaaggatgacctgattgcggatttggaagaaaattttgcaagcattcgagctttcaagatgaaactaaacccggaaaagtgcatcttcggagtaccgtcagggaagttgcttggatttatcgtatctcagagaggcatacaggccaacccggagaaaatcaacgccatcctcaacatgaaaccgccaaactcccaaaaagacgtccaaaagctgactggttgcatggcggcgctcagccggttcgtctcacgactcggcgagcgggggatgcccttcttcaagctgctaaagaaaactgacaatttccagtggggatccgaagcacaaaaagccttcgaagacttcaagaaatctctcaccactccaccagttttggcctcgccacatccacaagagccgctactgttgtatgtgtcggcgacctcccaagttgtgagtacggtcctggttgtcgagcgtgaagaggaaggccatattcaaaaagtccaacgaccaatttattttgtcagcgaggttttagccgactccaagacaaggtatcctcaggttcaaaagttattatatggtgtcttaattaccgtcaggaaattatctcactattttcaaagtcacccggtcacggtagtcacatcgtttccactcggggatatacttcacaatcgcgaagcaaatggacggattgcgaagtgggccttagaattgatgtctttggacatatctttcaaaccacgaacttcgatcaagtcacaagctttagctgatttccttgctgagtggaccgagtgccaagaagacatgccagaggaaaagatggaatattggaccatgcattttgatgggtcgaagaggcttacaggcactagagctggggtcgtcttaatttccccgactggagaaa

SEQ ID NO: 12869 - DNA, 1216 bp, Oryza sativa
ccaaccgtgcccataaaagaagcaattgaagccatggatactcaaggcgtaagcgtgattgaagccgactggagaaaacctctcataaaatttttaaccaaacaagaactccctcaagacaaaaatgaagccgagcggatttccagacgcagcagactttacattattcatgaagctgaactgtacaagaaaagtccatcaggaatactgcagcgctgcgtatctttggaggaagggagacaattgttgaaggatatacattctggtatttgtggtaatcatgctgctgcacggaccattgtcggcaaagcttaccggcaaggttttttctggcctacagctgtgtccgatgcggacaagattgtgcggacatgcgaaggttgtcaattttttgccagacaaactcatttgccagcccaagagttgcaaaccatcccgttgtcctggccgttcgcggtctgggggcttgacatggtcggcccgtttaaaagggcagttggcggttacacgcatctctttgtggctatcgacaaattctccaaatggattgaggctaaaccggtcatcacgatcacagcagataaagctagagattttttcatcaatattgtgcatcggtttggggtacctaatcggatcatcactgataatggcactcaattcactggcggagcatttaaagacttttgtgaatacttcggcatcaaaatttgttatgcctccgtggcacaacccatgagtaacgaacaagttgagcgcgctaacggcatgatactgcaagggatcaaagcacgagtttttgaccgactacgtccctatgctggcaagtgggtagatcagctgccgtccgtactttggtctttacgcactactcctagtcgggctaccggccagtcgccgttctttttggtttatggtgcagaagcaatgttgctaagtgaagtggaatttgaatcactacgatttcggaacttcaacgaggagagccatgaagagggccgagtagacgacatcaaccgactagaagaagcccgagaagcagctttaattcaatcgactcgatatttgcaagggttgcgtcgttatcataattgaaatgttcgatcacgagcctttttagtcggtgacctggttctgaggaaaattcaaacaacacaggatcggcataaattatctcccttatgggaaggaccgttcataattgctgaagtcactc

SEQ ID NO: 12870 - DNA, 2470 bp, Oryza sativa
cgcaaagccatcaatggcatcaacgtcaactctcggataaagggatttggtcatcgccaacgccatacttgctcccatacttccagcttctttgatgttcttgaaatatgtatccgaagcaactctcagcttgtcgaaaatttcaaaagcatcaagtgcactcgggccgttgttattgaagaacatcgcttgaacaattggggcagcagcgttagcaacctcatcccgggctccttcaagttttttgatcttgccaactaggacatcaaattgagcttgagatttgatcttgcggtttgcatcaacagattcacattaataagtcagcatatggaggataatggctttttgaggtattgattgttgataccttcaacttcctttaaagccaggtctctctgtcttgccagctctgccttgtcattttccagagtttggatctgcttctctagttgagatatcttggcagcttgcactacattaacttcggttaatcaggataacagagataacagcacaaatcagttgggcagagtttgcgcaaaccttttgatgagccacttagttcaaaattggattcctagagctcagcaattcgattcctcatatcatgctcattttttctggcaagctcttttgtctcgtgcagcagactcctggtggcttcgagggtcccgagatgagggactagcctctctaaggttgccgttttagcttcgttcctaagatgaatcctctgcaagacagtttaattagcgcctagattaaatggcaaacgagatggttgagatcaggcgccaaagagcttacatttacaatgcgggtggcttggctgagtgcctttttcagcaagcatacctcctcgtcctctttttgcttatttattacgattccttgaggctgcatgttgtcatcccaccacttgaccagaatcggagggcgtgaatcctcagctgcttgtatgcggggaatttcttcttcgtcactgatcattggccctaatgtatccactgacagaggttagacgattgatcagagttatttgggtcgacatagtctcaaacaaagtgttttacctgtaatgatttctggacgaggatgagtggactcggatgcttttaaaggagatctagatctccggtcattgctggcgtcttgtccgtgagggttgtctgcttgggtttcgacttctggaatctcttcgtttacccctgcatccgactggtttccagtcgggggctcctggccagcaccgacttcagcttcggccggctggttcccagtcgggggctcgttgctgggttctacattgtcggttgctggctgattgtcactcggatgatccttagcagttggtccggtttctttggaagaacttgtgtccatgttagtcgggtcagagtctttcccagacgggtctatatcagatggtttcctgcaaatttgattatcagcattattgccgcaatgggtgtgcatcaatacaagagggatcgttatatgagttgcacctggaagacttcctgatctttggcgcggagcgactggatgttttcttccttggagtagtctgttttggtagtttcttggtcgtctctcggtcttcaggcctcctggtggcatcatctgctttgtcgtcgcttataaccagtttcctctttcgagaatctgactggccgattggatcaaaagcacttggttgagtttcagaccgaattcttggtcctccgctcccttgcgtagtttggtggcggggagatcggcgttgagcgattgggggatccgacttcatcaaagcaaattcctaggtgtaatatcctccattgttaactgattcaacaagaaaacaaaagcatacttttgaggaagattgagatgtttgagtgcataccggtggaggagggttgaatgcattgaatggcacaacgggcagcagatgtgaatagctgacaacaatagcgtttgagaagatcttgtacattctttctttcatgaccttaaagtcaagagaatctggatcttcccgatttggatcatgcttgccatcaaactcaaaagctgtgcgggatctctctttgattggagctagtcgacttttgatgaagtcccgagtgatctgttctccttgcaagccttggtccttcagttttagcatgcgttccatcaattccactgcctgagcagcttcatctcccataggcaatgagttccatgtgtcctggtaaactagaggaagacagcagtactcggggagtgcaggctcaggattctgaacatagaaccagtttgcatgccagcctttgtttgaggtcttgaagggcatggagaagtatttttggctcagtgttcccctgagctggaaaccagcacacccaactacgcatggtttgctcttatttggctggggcttgaggaaaaagatgcggcggaacaaggtgaaatgaggcctaatgcccaaaaaagcttcgca

SEQ ID NO: 12871 - DNA, 21045 bp, Oryza sativa
ggtggacacggggagaaatttcgtgaagtttttgaggatggtttggagcagattgatgaaccctagcttcgtcggcatggttctatactgtagcacggagtgtggaatggcgagagtctcggcggggaagacgaagcgacgtttggacttcggtatttttagggtatcgggagtactaatgggcctaggcctgtacagtacttcagcccaattatgttttcagcgtggcccgttgtgatccctagggacttaggcgctttttgctttggcaatatgtgctcacaatgacacggcccgatgctgttaaaatcctttttaacacgattcaataattctttggaattattatgatgcacatgaaaaggtgcccgacagaaaggtgttataccatttttgtaagcttttttaggctacaagagctgttgggttaatttgagatgactggtttattagtagtcattctcctagcatgttatatgcttattttgattatggtaagggttatagcctaggctaataaacttcttaattaccatgatctttatcatatttgggggatcattttaagagtttcttactcggattcctaccaaatatatctatttttggaccttttgagtgtttatcactcggcccttcttgtatttttttgtccttggtatattcaagttgagaggcagtcggctgggtatcttactaagtaccatgcgtgctccgctataaaaccactcggttcttgactatatgtttagtttttcaactaatcacatagtcgggggctacacctaattaggtgcatctactcgatgcaccatgttttattttcgcccttcacagtcttttagcactcggcaagccggagcaagttgaattgaagcactcggattatttgtttcgagcagactattttggtcaactgcgaaggtcacgggggctactgtggagattatggttaccccatatctacatggcggttatattccagctggatatatggtaccaaatatagatagaatatctttatgaggactcgggttagattctaaacttgtatgttaagaaaatacccgggatcctagtcggttacgattgtattttatctgtaattccatattccgttaggatatggattgtactttgtattacggatcccttcccctatataaggagggtccgtgtgcctcttggggcacgatttcttttctcccaatcatacaatcaataacacactcggcggaatcatccccggacaggagtagggtattacttcttgaataagaaggcctgaacttgtataaaattccttgtctccaaacccatccactttcctagcttgatagccacccccttttattattgccgaaatcttgtttcgacagtgctatctctgatctcgccggacacggattcgaggaggaaggctaccatgttgtcaactacgagtcagacctttagactgtcatgtcgataacagttagataggctaccccacatattgtactggtgtgattatggtgaataaaaagaacctccggctccggccaataggatatagggttattacctaacaactcaggggcccaaacctgtataaaaatccctgtctccgtttcttttacctcagtctcgcgtatatcctagcactgacgatcctcatactatgcaaataccagaattacgacatcaaacgtcgacagtggcgcgccaggtaggggactttggtgcttcagggtttcgacgagatgggtttaagagatggattctccaataacaagctactcgacgacttcggctgtggagatctaacccgaccggaacatgtcttccgacgagatcggaaccatcatcgtcatcgacaacttggtctatcgagatcacccaagcctcaagatacgcggcgtaccaaaagatgtcagatcatatgatgtcgaaggagtacgcaataaggtaattggtagattggtttttcaaattgatctactaatttcgtagatatatccggcatatatctacaaaggtacgcaatattttatatacaatttatcgtacctattcagatctatacagtattgtcaggtctatactttattatgtttacctagaggatgtttcttatacaatatctatcgcgcgagtgtttccgacgttaaccaactacggtctaacgctgggggctcgctctgtttttcttctgtataaatcatgcttgtttacggtttatataatacctgatatttacatctactcgttatatcctgataatactagaagatccatgcagttttttgagtacatactcgatattatctgctatatattttgtcttctagaaaatattttttaggaacaattgagcacacgagtaggttgtcgtcgagtacactccattatcgagaacattctcgacaaatgcggagttatcgcacacaacctgccaacgaagaccgacgacctatctcatagcaccagccatggctggactactcgagaaaaggttgttaacggacaattcctcgcgaacgccgtcggcttgatcacccgacatgattgcgaacggacatccggatatgctacaagttgggtgtgtgattcatgctggccacatgatgtgcacatgtaacaaaccaactttagcgcccctataggtgattaagagactcctactcctagttctcgaaccagtaaaacgtagtgatctctcttgcctcacttcaagtggtcgagttacgactactacctggttctcgaccagcggtgtagcgtttctcccactactcccactttaagtcgtcgagttacgactactgcctggtcctccaccagcgatgtagcgtttctcccactactctcactttaagtggtcgagttacgactactgcctagtcctcgaccagcgatgtagcgtttctcccactactctcactttaagtggtcgagttatgactactgcctggtcctcgaccagcgatgtagcgtttctcccactactcccactttaagtggtcgagttacgactactgcctagtcctcgaccagcgatgtagcgtttctcccactacttccactttaagtagttgagttacgactactgcctagtcctcgaccagcgatgcagcgtttctcccactttttccacttctagtggtcgagttacgactactacctggttctccaccagcggtgtagcaactctcctactacctctatttcaacaaagttgacagcaggtacacagtatcgccaagtgttttacctagagatcccttaccacgacgacacctagcgttgaaacctatcttactgtccctttacgccgtcttgacaaggcctccgaggaacctaagggaacttcggctggggacgcccagagccgataaggctttgtcggatcctgtagagacaaaagaccatgtaagatcttgtcgtataagagttctcgccgtgcgtattaaccaagccatgtaatcggaaattgacttttccaacttcacggctgggggctaggatcagtgcttgttcaaccaaggcaggtcaagggtccaagagccttctcctccgagaacgattctctgatgacaaggctgggggctagggagagtgtatgactctacaaactgactgatcgaagtcggtaagagagaagacgctcgtacacaaaacattggttggtaaatttaattcattttcaattttccatacatattataacatgtcatcctttgagcgttcgctcgggggctatttctatttgatattcttttctgagtattgatttcaggaaaattctattcgacattatggaagactccatgtctctatggttctataccaagatcgactaaggcgagtacgacaaatgttgacaaggctccgtcgcagactctacgccttctcgatcgttcgagaacggttgctggatctcgacaaggaatacggaatgaagagatggtgtacctgccgagataaaatttcttgacttcaattcaaattctcgattacagcaagacggaagacttagtcgtacgctatgtacttccttggttgacatcggatattgactcagacaaaccctttaggtgcccgcacgaggctgacaaaggaagtctaaacgttatctctgaactcaccgagaacggtcacatgagctcgataacagttactccagggtctgcggttgagaatataaatacgttcatttgcattgaagtcgggggctactgtcagggttatggataccacatacctaatagtagtcgactacatctcggcaggacccaccacataccatgtcctatacagaaacaacctacggatatggagggagttccggataaagaaagacaaccagagttctacatggaaacgaccaggactactcggattgtatccatattggtttccctagttctacttggacaaggggacacctataggtataaatacaagaccccctaggaggagaggggagacaagacaatcgacagacgatcgacacgatcaacacggtcgacacgatcaacatgatcgagacccaccacaatcaacaaccaacacaatacacgagacaacatacaagccaacatacgccaagacacgccgccggatatcgacttcagggataggcatggctattcccctacggtgtctccggataccgtcaggagagacgaaagcgctatctctgatctcgccagacacgtattcgaggaggaaggctaccttgttgtcaactacaagtcagaccgtcagaccaccatgtcgacaacagttagataggctaccccacatattgtactggtgtgattatggtgaataaaaagcaactccggctctggccaacaggatgtagggttattacctgacaactcaggggcctgaacctgtataaaaatccctgtctccgtctcttttacctcagtctcgcgtatatcctagcaccgatgatccccataccatgcaaataccagaattgcgacatcaaacgtcgacagactagctagatgttaattggagagacaaatctcagcaaggcaacgtacccaaaatccatcttccgggtttctatatacaaattcccaaatggtatgaaagaaggggaaaaaaggaaaagataatggtatgaaagaaattcccaaatgtccaagcatgcccaaactaaatattagataatttcttccagccatatacagcagtactccaatcaacgattatttctccaagtgaccggctcctgtaaccaccagaagcctgacacacaccatgactggagatggcgcgcaagatgaacaaatggcgatactgctgatcaagacggcgccatggaacctgctgatagccaagatggtgcagtgatcaaggaagcacgtgcacgcgacaagaagaagcgcggcgataggaagaaactagagaagaagaaatggatggactacaacacaagggaggcatcaagacagcgtctcaaccaatagaccgacgtgggctacgagatatggttccaaatccccgagtccacgggccggcctgaatgggccaagtgactaggccttaagcatgccagacacgcgcgcgagagagaggatgcgtccgtagtacaaggataaaaccgtaaaaggttaaaaaggatagaacacagactagaattacgcggaggcattggtggcagtggctcgatcctattggatcgagagaaagttgtatgcatattcatctactcttccagttaattgagcgagtcccaagagatttctaacaatctagaatcagagctcgtcagtgtggaaacactcttggctcggttgtaaaattcatgatcaaggattggagatatgctctttcgagtatattccgcgaaaaggcaaattgccttgatctagttgactgagtccggaatgagggattcaggccttgattcgtcatctgcatctcacaaggaagcgatgatgacgcaggatttgagtctggatagcaagttcgatctgctcctgaaaacaactggggagaatgagaagaaaagggtggaggcagaggagagatcttgagcccacttcctggatatcaagagggtggaagagaagtctcaagttgacttccatgaactcaagaaggcggtcaaagtgaggcttcctcaagtggagaagtaggtgggaagttatgtgttggggggctttgagtaccaaggtcgaacacctagagggcaacatgctttgttaggatcagggagacaaggcgtctgccatggcagtcatgaagaaggagtacgacatggattcagcgttcttatagcccacacctctgatccatggtacgtgcaatctaagtcttaactccttgttccttttggcgtagattttagcagatcgtcaatcaagagtatctggaataccaattgggttggccggaagtgtccctcttatgacatgttcacagttcaacggtgacaacctgtagataggggtggacagaataagaccgagaccgagaaagtcggttagtagttcggtcttagctattgaaagaccgaaatttattcgggcaattcagtcattagcctcggttgaccgaagctcaataggccaagtaaaccaaaccctagaggcactcagccacagaggaaccgcactctccctgtctcccacaggccacaacgccgcgtcgccgcctcgcccatccatcgcgctcgagctcacgcagcgtggacccgcggtcacgtcgcctccgcctccatcacaccggcgctgcctccaccctccacctccatcgcgccgctgcgccacctccgccctccagccagcctgcctccacctcgccgccgcctccaacgacatcgagcccacctccgccttgatgccgccatcgcaccaccttcatctccagccagcgcgcctccgcctcggcgcctccatcccgccggccgcctccgtctccatatggcaggtctcggtgtcagcaggaatagggacaacaggagatggcaggattgcatctggtggagatcgacgggatccaatcatgaagcttgatttgccttttcattttttttctctctgaatctttttaatttgctagtcgcgtgtgcaaattctgagatgcttcatctatctattgatctattgagttgcttttttatttgtcgaccaaatatttgatgtttgttttttgtgattttttttgttttgaccacagatcatacatataatcaataaataacatcaacactttatatcaatatatactagcatatatctattagtccacatggccggcaggggtgaatccaaaggtgggtaccggaagggggtcaagccctccttccccgttggatccccatgcaggaggggagaggaagacaagtagggggttagctagaggagcaagaagaaaatgagctccctcaaagtaatcttggatcctttcctgatgaaaagaatacaatattaccattcatccactaatcatcaccttagacatgcaaaattatattgattagttttacttaggtctacatatatagtgaacggggacgaaggatcacttgtgtcccaccagacctgagatggggacttgttctgttgttcccccatttgatttttcatgaagaatcaacttaaccatccctatacgaatggaaaattttcccttgcgaaaacgtggaatagggctccattgacatctctatctttgctagtgaggcccaagtgcacatcaaaagaaggcactagttttttgacatgaatagcaagggtgcgtttggaagttaggttcacatcttctactctctctcgtttttccgcgcatctgtttttaaactgttaaacggtgtatttgttaaaaatatatatatatgaaagttgttgtaaaaataatatcaatctatttttcaaggattttgtaagttaatattcaattaatcatgtactattgagccaccccgttttccgtgtgtataaaggagagcttcccaacccctcctcgcaatacacaccctaagtgaagatttggggtcgtaaggtgagttttgatttggcatattagcaacacgtaaaacaatacaagctattagcgtagattaatcgagcatacaattttttgttaaaaattgtaccatttagaaagcgtgcagccccatcgtttggtatattagagaaaaaaaagcgaaacgctatatttacaaatgaaaaataattcgtgaataaaacttttatatacgtattcttaactatctaaaaggaaagggtgaaaaataaactacgatgaaaaaaccctaaaatcagctttaaatttaatgttaaaaatttaaattttaactgataagaataagtataaataaaaagacgagcagatgctggtgttaacgaaaacgtagcgttattgtttgcttactcttaattttaaaataaataaatctagtatataatataaatatgtacgaagatatttgtttgttttaagagcaagttggcttatagtttatattagagttaacatgtacagtaaatgagctataaggttatctccttttttctcctcctctctctatctctcacatatgcattttatgtatttatcttaaagtatgtgaatagctagctcttgtataagagccaacaaccctctcagttttttaaattctttttcctccacgtaaatttatagttgacttatagcctattattatacttggtgaggaagcctccgaatcgataaggcaggtaagtactgctccagtacgtaaagtccaccttattattggcaccatcgtcatccatccagcaagccaaccggaataactactactgctgctgctgttgcgttggagtaccaaaggaggaggaggaggaggaggaggaggaataatcttagagtctactagactcacacactagctttagcttagctaaaagaagaaaaagaaaagagaggcacaataataggttaggcatggcggagcagctgggcggcgtgggcagcccgcagctaagcctgagcagctgcagctccttcctttccatctccagcgccggtaccagcgccgccgatggtgctccccatctatccctcggcgtgggcggcgccgaggagctggatctgctgctgcaggtgggcataggcggtggcggtggcggcggcggcgacgaggaagaggaggagcgcaagaccatccggatgatgaagaacagggagtcggcgctgcgctccagggcaaggaagagggtaagaacctctaatccatttcctcatactatctagtatagtactagctactctattaattaatctctcggatggatagatggagtagtatttggttccacactagtactagttagctaattgcatgagcttaattatgtgcgcggatggatgtataggcgtatgtgcaggagctggagaaggaagttcgccggctggtgaatgagaatctcaagctcaagaggcactgcaaacaagttaacttcgtattcccttccctaatacttttattactaataagtcgattcatcactctacatttccaatccatcttttatgtatatatatgtatgtgcatagaatcctttgattttactacaggtatattgtaataataatgcactatatcctatgcagcttaagacggagatggctgctctgatccagcagcctaccaacaagcagagttcccaccgaagaagctcatccacttgatcagaacgcagcagcttaagcctttaattaattaagcataggcaaggtagcgggcagccattggattggggaccattatttaattgggttggctgtccagctccagcaagagtctctagcaagtaacaacaactcactctgatccgccggcttggctttccatgcattccggtagtacgtaagtactctattttgttactgtgtcgatcatccgctacacatggatgcatacatgcatgcttaattgtttgtgtcaccggctaacttttgcatacccttgtttgcttgcttgctgcaagacccaaattaatataaattgtatgagactcggattagctgctatcaattgctccatccgttccataaaaaaacgaatctataaccgaatgtggcatattctagtactatgaatctgaacatatgtatgttcagattcgtagtattagaatatatcacatccggtactaggttgactttttatgggatgtaatgagtatagtttcatgcacgcctgcacttgtgtgttgcctataaattcagttttgcatgcacttcaccaatgaattactgatcactttcttgggtacgcggtgatcatgtgtttggccatccatccaacgcatgccttgccttcgtgttcgtgcatatcccttctttctatgaagtagttaagaatagatcgtaagtgtttttttcataaaaaataaattatctgcgcatcatcgtcggtttcattgatctcaactcttacgtacaatgaatatagataggagtctgtctagattcgtcattcattatacatacgtttgttttttttttggacgttttgggacgggagaagtacggtggagaaagggtgtagcaacatgttgctcaataacggtgcgctgcttctgggaggaagattatatatgatgtcatgtggagaagaacagttttgctatacatatatatatgacgggtgtggctacatgcccctgccccttatacgcacggatctctcccttcctcctcccctctttctctttctgctatagtataccataaaaattttaaaaaagttgagaaaaatttatgcatagaaatactatatataaagaatatttgaattcaaattcaaatttaaatcagatatataaacttttaacttatatgtgtaaatttgaggtgtacaaactttaggtgtataaattacctaaattttgggtttctaaactttatatgtgtaaatttgaggtgtacaaactttaggtgtataaatttattaaaataggaaaataatatggtgatgaaaaaggaaaccacgtggcgagagggggacagcgccgtctttccgatatactccctctgttttttaatagatgacgccgttgacttttttctcacatgtttgaccattcgtcttatcaaaaaattttatgcaaatgtataagatataaatcacacttaaagtactatgagtgataaaacaactcataacaaaataaattgtaattacgtaaattttttgaataagacgaatggttaaacatgtgagaaaaagttaacggcgttatttattaaaaaacggaggtagtatggtgccacatttttctttaatcgttttttagatggtgatttaacaggctgatttgcgattagtttgccatgcttttcggattgggaggtttgcggtcagaataatccgtgcagtttgattctccgcgtgctatcttttttgtgtctttgcttaaaaaatgtgattttcttgaccatatgagaaaactacaatgtaggatttgagatttatattagtataatttaaaattattactgcaaatataacaaacttgtagttaagattatggaattcacagtataaatacacgttgaaaattttaaccgtcttttatgaagctgtgagattatgccatcgttaaaagtgcgctttgataaaacaccatcttataaatgggattcactaaaatgcaattctcaaacagtgttatgtactaaaataccatatgcctcttgcatggacgaaaatgtgcctacctttacttctctctcacctctggtgtgacaaggaaacaatggtggtggcgaggcacgctggtgagaagatagcagcctcttccagctcatatgctaggggcttcctatctcgcgagctcgtgccgggaggcaagtcgtgcgcaggggctccccccacccttatctgtctccacccctctattttctctctcatttatatcttttcctcggcccctcgatggcagtttgtggatggagtggtgacgataccaacggccaagttccttgcatcgggcgaacccctcctcctccctctagcaaacccttatttcttactccgttagggacaacacaagagtggagcgggctacgatgctatcaagacctaccaacaacgccccttcagcgagtccccttcctcctcccttcggccaggttagctctttcttcagtctccaccaccctaccccactgtcccgctgcccccggcctcgccggcgccaaaaggagtcaacagaccagggcgaccgtacctggccggcctcctccccctccccttcacctcgctttgcctccgccaccatgatcagcccactgcccgctactgaccttgcggctccgtggcgccgccgccgcctcatcgcccacccttgttcgccacccaccgccggtccgccgtctcccaagccatccctctagacccgatcccccacttctccctccccaataccaccctctcctttaccccacctcaccctaaccctaacccccctcacgcatggcttgttgtgacacggtcggaaaacgggtgccacttcctcgctcgcccgtgtgtgcgaattaggattcttgcctatgctgtcagcctcttttagctagctcacgcgccatctaaccttctcgagcaacaaagaccaatatgtgggccctacccttgcatgggactcgcatgtcatgatcaaatcaaatggggatccaccatgacacgccgcagatcagggttaaaatttagatatccgtagacgaaaaataatcgtcccattcttttcatgggacttgtatgtcaggaccaagtctgatggggatccaccatatatagcatgccaggttgatgcagggggcggatcagggtcggtttgaatcagcgatggcatccaagataagtttagccgtttagggacgctaaagatatactactatttcgtgagttgggagacatggataacacagactgcccacgtactttattaaaaaaaacattccaacctcaaaatcgagtctgtttatttcgatcggtacatatactcactcatctatccccacacatggggtcatggcgtatatgcgtgacacgggtgcatatgatttttaccctaaaaccaactgaatttcccatggcaattagatgcagatcatcgatcgatcgatcggtgcaatgtcaacccggccccgttctagctaggtcgatccagtccaaccagctagccattgcgtgccacacgtactcctcttaattaatttgttctatgcatggcgccatggatgatgttgtcgtcggagatgaagtagtatatagctagggtgggtggctatgatgatcggacgacgagggtgtggtggtgatgtgaatgttgggattccacctcctcatcctgcgatgcacatgcgcgctgtgctgctgaagcaccagcacggagccgcaggccgtgaagtcgtcggaggccagcacctccccgacggggcccagctccggacactcgtcctccagtagccctcccatgccgctcgtcatggccgccgccgccgagccgccgccgcccttccccaccacgaacagcgagtacgtccccaccatggcgctcaacgaattcaccatctccgcgccgttgctcacgtacctctccgtgtactccacctgtcccgccaacaccagcctcgcgtacacgtccgccatgaactcctcatccgccatcgcctcctcgtcctccaccgccacctccatggcgccctcaccgccatggctcttggtggtggctaataattgttcatcaatgccaatggtaatatcatcctgtcgcgctggaaggaatctcaccaccgtcacgctcacccacgggtgcgccgccagccgcgtcgcgtacgctaccgcctccctgtcgtccggcccgcccaggaacaccgccaccacctggttcttcaccacgtcttccgcgcccttgtcgccgcccccgccgaggcgccgttccaccaggaccccgacagtgcagggcaagcgctgcaggatccgctggttcagctgccgcctcccctctcgccggcacaccatgcgcccgtcgtaccgctgctccttgtggaagggcacgatcaccagcgacgcgcgcgagtcctccacgccgttgcgcacgtctgcgtccatggaccccaggctggagatggcggtcatctgccgcaccggcacgccggcgtcgtaggtgaaggtgttcaccgccgcggccacctgctcgatctcgcgggcataaccccactcgtcgtcgtcggcgtcggcgtcatggtacagatgggtgatggcgtacttgcgcgcggccataagctccaccaggtggaggaggtagacggccagcggcgcggtgcccttggaaagctccgcgagcgtcagcatggtgtggacgcccccggcgccgtggacgcagaccagcacgcggagctcgtggtcgaccttgaggtcctgaaggcagcgcgaccggtatcgggaggcggcgcgctgctgtcggacgatggccgcggcagccgggcctgccatgaaggtgttgaggatggaggagaggagcagcaccacctgcgccgtctggccccagatgccggcctggttgccgaagttgatggcgaggatgtcacagtagcccttgacgttgagcaggaagcccagcaccagcgactccctcgccgagatgcccagcatgcggcccgcgagcaccgtgccgcccaccttcccgactgcgccgagcagcgtcgtgaaggcgacggcgacggcgaactgcatggctgtgaagctgccgacggcggcgaagtcgagccttgcgccgatggccccgaagcagagcggcatgacgagctggtgcacgggataggtgaggcggtcgacgagcgtgcgcgccgtgggcccgtcgcgcggcatggcgaggccgatgaggaaggcggtcatggaggcgctgtagccgaacacctgctcgagcagcgagagggcgatgatgagcaggagcatggcgcagagctcgtacttgctgacgtagcggcggccgcgcttgagcctgttgagcagcctggcggccctggcggccgcgagcaccgccaggcacgccgtgaaggccatggacatgacgatggacatgtccgggaaggatggggtgggctggccgtcggggccgtaggcggtggtgccgacgaccatgatgctgaagacggagaggctagccatgtcgttggcgaaggcggcgccgatggcgagctggccggcctcggagccggtgagcttgagctcggtgacgatgcggatgaggaccggggaggcggtggtggtgaggacgagcatgaagagcgcggtggaggcgtagagcttctcgggcttgaaggggccctggccggggtggaggaggccgtagaagaagggccccgcgagggcggcgagcaggaggcagagccccgagccgccgcaggcgatggcgagggagcggcgcaggtggtggcggaggtaccggaggtccatctccaggccgatgaagaacatgaagatgatgcggacgaagtagatggtgtcgctgagcgcgctgccggcgtcctgcatgcccagaggacgcaggtccacggcgcggccgagcaccgtcggcccgaccaccacgccggcctgcactgccatgctcgcaatctcatatatatatatatatatatatatatatagcttccatctcgatctctctctctctctctgctggaaatttaattatcaatccaatccaatccgcatgcatatatatatatatataccaggatgtgcgagattatgcttggctgcccaacgcgtcgaagcgcgcaatggaagatgccggagagcgccaggacggtcgccatgaggccggtcacggccatcacgccggccatgaagtaggtgccgtcgttcacctcgtcggagcacttggcaccgtcacctgccatgctcgtcgccggcccgccggaccgatcgatcagcacgctacctacctacctacctatagcgggctatcctatatatagcctgccttatatttatcagttaaaatttgaattatcaactttaaatttgaagctaaatttgagggggtttttttgaattttatttttcagtctttacttttagaacgctaataacacgtatctaaaagttttattgataaattactttttatttgtaaatataccgttttgcttaatccccttaaattgcattcctagcttccatccctttcgtcaacccaatctaggattcactatagccaacataattgtgtacgtgactgtaggtttactggtgctcaagttaagatacacagttgtaatcgactatgcagaaataagatatcaagggtcctaatgaattttacctatgaaaccctctaactcatgggaaggataggaaattttttttcattgaaaactttcgttacctttacgttgttcgtttcatgaaatgttattaaagggattccttcaactttttcattaaaataggattagagaaacataatacttaatttccctgtcgtctttaattgttgcaatcacgggtacttttctaagtctactatctactatatattatatatacttatatatacttaaaaagtaaaacctgttttcgtcgtccgtgaaaacaaaaagaaacgatgagaaaaaaaccaaaaaaagaagtccgactcccattaaaaaaaacttccgactcccttggaaattccgtaaaaaaaagaaaagagatttctttatggaaaaaaatcaagcgcgaaaaaagtgcgaaaattttgttatgtccgataaaaaaaagtgctataaaagggtttccgtctaccgtaaaaaaagaaaaataatagtgcaaaaaaagatttatgtccgattaaaaaaaatcccgtcgtccatccccccaaaaaaaacaagcgtgaccattttttctgtccgattcaaaaaaagaaagttgggaaaaaaggttttccgtttctctatctctgactctatctcttctctgcttcttaaaaaactaaatgtgtttccgtcgtccgtccgtgaaaaaaagcgtgaaaaagaaattgagcgaaaaaaaatcgaatccgattatacgtgacgcggtaaaaaaaacaaaaaaagggagaaaaaaatgaaaaaaaaagagaagtccaattcaatctatctatatatacctaactaaaaaatttgtatggcttccgggttatagttttcgttcgtcgaaaaaaatatttccatcgcacgtgcgatcgatcccatttcaacccctctccggtggcaaaaaaaagaaaagaaagaaaaaaataatgagagaccgcatcaaatttggacataaatcatagagaaaacactgctacaagaatacaagaatacaagatcagattcaagaacactaagaaaacgccgatgccggaaggggagggtttcgttgtcgttgccgaaccgccaccgccgtcgcagggatgtcggtatgccagggcgcagccacgttgttttgagagatagagagcggggggaggggaaatgattttagggttagggtttgggctgttgaacttttatataggtcgaggtcaatcaggaccgtctatcagatcagacggttccggcttctcccgcgtcacaccgaacgccaatcccaggccgcccacacggaataagttcactttaggtagcttaagtttttcttcccgattctattcctaggccgcccacactattgggccatctcatggaccacgtgtacgctttgtatggaataaggtcactttaagtcccttcagctggactttttttattttattatgaatatattttcttaaagagctcatatcatgtaaaactaaatcttaatcatgtaatatttttatatttgttataattttaatttacacgttgcaacgcacggatatttttttctatgtaaaaaaaagggaccatgacatacgagtacgagtgagagatatatgccgcacgcacccgcaggctcatgtttaaacgagctggcaacatattgtcaattacaggtctaattgttttatttgggtgattaaatttgtttttatttacataattagtttgctctatttaagctttttgaaaattgctaaaatttgagaataacttttcctacttcatattatattatttttagctaatggaattaacagaaaattaattatatatttttatctttttaacaaaggtcactgcaattttatattttattatgattatgattatgattcctttatattttttctcaccaatatacatgattaaaattatcttcacccgttgcaacgcacgggcatcattgctagttaaaaaaaaagttgaaataggagataatgtgaggccttgagattaaaaggaccccgaaaacgagacagatcgtggccgttgaagagggacacagacaccgtggatctgaacgctgccggtgtttgttatccacatttgcggggcgcagcagcaaaagcacaagggcaaagcctcgccgccgtcgccgccgccgccgccgccgccgccgcggcgatcgccacgccatgtctccctccctcttgcttacctctaggggtacccactcgccggcgccacggccgcaaacccgtcgagcatcacaactgctcgtctctttcccctcgcgctgcagccgcttcgtcggcctccgcctcgcgcgcgcagccgccgattcgcaggggcccaacggcgctgcccctggatctggatctggtggggacggagagggcaaggcagccaatggtgccgacaccaaattggtacggtaaacaaccaacccttccctctctcttaaatcttaatccccttgacttactactactgttccctaatccctctcctgttctccccaattactgttccttctctgtcttaatggatagatagatggattggttactccttttctttcgcctgcctgctaccgtctgcattctcacaggctggttggatgcatgccatgatagaacaggagagataatttcaatttactaacaaataacatgcaccgcataatttggagaagtttcttgtgttaattttgcatcaatcacatggtatgcgttctccacataaacttgtaatggtttgcacaaaaataattcgcactagccctcaactccaagtcgactacctgagaatatgtcggagaagcagagatagttatgatgtcctgagcattttatacattatgagatccagaataagacacaagtagtcaagcactgcataggtcacatgatgaggcaatttaatttaattaccctgagatctgaactataggcagatgaactaaacaaatcaggcttacaaaacattgagattatcttgcagaacatttgggaatggtaacaggacatggaggttgatcctataccaagacaccatgtatatatacatatataaatgatacaccaccaactgcaattctatcagtcggtttcatctgaattacactgtgcaatgaatagatatatcatatgtatgactcatcatgctcacattttttctccattagtgggccgcttgttaataatatataagttgatgaaatattgttaactctcactgatccatggcatcaatgatctgtctaatactgcacgagcgactgttgtctgttgctagggcagctggtagtcaatggattgttcactctccacaaaacatgttgagttgagggcttttatgatatcttgcctttgttgatctgttcctacacaaaacaacttgaaggtcctatatgtaagaaaattagcaaggattgcttgacaattgttgatagccttatagctcagggcagaaagttctggcagaaccttatattcaagaaaattagcaaggatctcttgacaatctttgatagacttatcgctcagagcagaaagttctagcacctctacttctacatccattgctgtagagtagtttccttttcatccctgcagagtgtgcacagagattctcaaaagtcaaaatactgttctgtacttctgtgacctgtttttttgagtgtcaagctgccatgcaggagttcattagaagcagaaccatcatgctagttggactagactctgtttgtagttgtatcgatggaaatatatgcatgaacaccctttcgtccacatgtctttggttctcaattaatccattgtctattatcatgtttggcaccaacgaaaataagctatactaatatcttcttgctaatttagctataatattattctgacaacaatccatattttaaagctatggctataatattctgacaacaatccatattttaaagctatggctatgtgtttttttcattcttacagccaaagaaccggagggacatactcctggaatacgttaaaaatgtccagccagagtttatggagcttttcataaaaagagctccgccacaggtttttatcatcttacttccctcctaagtttccacaaactgtgttttggataattcataaggatgggactgggtcaatccatgggtaccaattgacccactatagttcaaccagatgaactaaaacacaacatcaaagttcatttttagatgatttggttgaactagaggcaatgggtacttatgtattgacccacttccaaccctagatatatagggtggtatgctgatgatttcttgaaatactttgatatgatgacatttccctctgtccatttttttttctgaaaaggttgttgatgccatgcgccaaacggtgactaatatgattgggactctgccacctcaatttttcgctgtaactgtgacaacggtaatgggatatcatatgttcaggtcttgacgccggtttttcttgtatggcattatgtcatactactaattattagcacaattcatttgtacacttgagccatgaaattgtgacatgtttatttacctttttcatcgacacaggttgctgaaaatctagctcagcttatgtacagtgttctgatgaccggatacatgttcaggaatgcgcagtatcgtctggaattgcaacagagtttggagcagattgcccttccagaaccaaaagaagaaaa

SEQ ID NO: 12872 - DNA, 729 bp, Oryza sativa
gctcctggtgttttgatcatttttctgcaagtgttcttaacagtacattacaatgtggtgtagcttccctacttcgcacaaatagtaaatactataaaaaaagcaaagatgaggttgtttaatatgcatgctggcatttgtaggattctgcagattatgctcctggaacccagaaaaaggttactggagaagttatccgatggaacaagactactggtcctgagaaaattgatgcagtaaaatatatagaattgcttgaagcagaaattgatgaactcagccatcaagttgctagaaaatcatctcaaggaagtaatgaactcttggaatatctaaaaactctagaacctcaaaatctgaaggtatatcttgatcccattaccctctgctgcatccatcctaagaatcagaatatatatagttaatactgactttatgttaggatgatcaatctttttggttggtttacatgcgtgataattcatctactattctgaaacattgtaggagctggcaagtagtgccggcgaggatgtcgtttttgctatgaatgcattcataaagcgccttttggctgtctcagatcctgcacagatgaaggtgagtgtttatttacttctttctgtgttcatgttaattgattttgttcagaaccatgcatacctccattttgttgaattgtgccactcattcaggtttgcttccattccatttagtattttctgatag

SEQ ID NO: 12873 - DNA, 10108 bp, Oryza sativa
tgtagttttgcaacctgactattgttggtaaaatacaatcaaggcaactcatattaccatattgtactcccatgttgtatgtctagttcaccaatcaagttgagtctgatgtgagtttgtttagaatcttgactaattttgctacatgacacataagtttgtgtaatttgatagcgtacatcgtaaaaacgtgttatggctgttggacaccttaaaaaatgtgttccttgcacaggaaaaaaaattcttttgaatagatattgatacaaatacctcgaaacgggttgggatacatattcgttattactatagataagatcttttgaataggtattgatacaaatatctcgagataggttgggatacatatttgttaatactatagatagagtatgattttttttcatccaaatagataaatctctaaatataggcacttcttttttcttcacttttgcatttcttaattttgtattctgctattctgacaaatattttttcattcttgcttatcttatcttactttcctagttgttctaagtaatacacgcggtacaaagttcgtgctagggaatttctttgagtcatcatgtttttcttcatacaaaaaatgaatatgtgatttttcaacgaaatgaagctttttttttgcttagcctatctgaaccttttgtataattggaattaattaaaatataataggtattttgtttcgtctagaaacatagcgtaaaaatattcctcgacttgcataaaatctggagtactatgctagatgccattttcagctcaattggagagagaatttttcttagaaagacaagtgttcatagaatcatagtgccaaaagcttctaatttagtgcaagagcaaagatttaatatgccaatatgacgcactcaaggaatgtacttggggtgacgacacatttagagatgcataatttttaaattttcacttcaaagcctaaggggtgaaaatggagcggatttgaacggatagtaggtataccatatcttaaaccatatttcttgagtggattcgaagcggattgtttcggatgttggaaatggtgcatattcgatttaaaaacggattgaatttatcagatattacgtgtataagcaatcaatataacatcgagttagcaatgcaaggaacaaacaacacaataatcgatgaacaaccctcgtaataattatattttttttgagaacgtcgtaataattatatgcataagtgttaaacaatatgaatacttcatagtataaaacacacaactatgcaagtgtgagatgagattatgaaagcctcgaattaaggagtcttggtaaattgatgactagcaaaatttacatagaatcttttagaacatttaggccggataaaaatcaatttcattgtctgtcttctctgcacacggcacgaccttatatgaccctgtaccataacgtttagcggaaaaagctttcaactaatacaacttattataatatatttctccaaattttagtgcccacatattttaaaaaatacgataaattgttattactacttaagatgagaggggtgatgtttttttaagcctttttaatatttaattaaaaaaaataaataatccaacaatttattttcaaatataaacttttggtcagtggcaagaaaacactagcaagcctgttgctatggcgtgattaaaagatttaaatttgtaaataagttttggagaggatttattttaaaaataaataatattaataaaaggttaaaaaataataaaaattcgagagcggtcggttccttggaaacgaagggaacagggaaagtatgcagaagcaagtcaccgcccaagcgaagaagccaacgcggtggaaagtggaaagaaaagcggacaaaccaacccgaggcgaccggcgactcggcgaggcaaggaaaagaaaaaaaaaggaaaagaaaagaaaagaaaagagagagaaggtgtggtggtggaaggaaccctagcggcggcgaccggctccgatggcccctccaccgccgtctccgtccccatctccggcgagcggcgcgcagtacgcgcaccagttcctgaacacggcgctctcccagcgcgggccctccgccctgccctacgcggaggacgtgaagtggctgatccgcaaccacctcgtcgccctcgccgacgctttcccctcgctccaccccaaggccgccctcttcacccacaacgacggccgcgccgcccacctcctccaggccgacggcaccatccccatccaccacgccggcgcctcctacaacctccccgctgtcctctggctcccggagccctacccgcggtcgccgcccctcgtcttcctctccccaacacgcgacatggtcatcaagccccaccaccccctcgtcgaccgctccggcctcgtcgccaacgccccttacctccgctcttgggttttcccctcctccaacctcgtcgatctcgtccgatccctctctcacctgttcggcctcgacccgcccctcttcaccaggagccccaatcccccacccccttccccttccccgccgatccctgccaccccgctccctcgcgtccacccctcctcctcctcctccccctccccatccccctacagattccctgcctcgccccagcttgccgcgcgccccccacccaccgaagaccccgctgaggtctacaagcgcaatgccatcgctaagctcgttgacatggcctatgccgatgccgccacgctgcgcccagtccgcgaggctgaggtcgacactctcttcgccatgcaggctacgctgcgcagccggggggaggtggtctctgatggggtgcgcaagatgggggaggagaaggaggcacttgagcgccgcctgcaggatgtaatgatggccacggacctcatggaggcgtgggtcatggagaacaccaagggtgctgccggcgacactgaagcggacgaggcaattgagaccgcagatgtactgtctaagcagatgcttgagtgcactgctgcggatttggcactcgaggacaccatttatgcgcttgacaaggccattcaggagggttctgtgccatttgatggctacctcaggagcgtgcgagcgcttgcacgggagcagtttttccaacgcgtcctgtcaaccaaggtgaacaaggcacaacaacaggctcaggttgctagaatggctgctcgggcaccacagtatgcatcataggaccggtgaggggtaacttgagtatacttactttgatattgcctttgtctaccaactctactatagctgtcacagtgtaaagttcgtttgctctttgcacatcttttttggggtggatgggggttacttactagatattggatggatgatcccatgtcaaataagaaccttagttgggagtgctgcactggatcttgtgtacgatttctgtacttcaatacatatcttcagttttgttctttgtgataactccatgtctcaatcttcatcgcaaaacttttatcaaagattacaaatcttgaccttggtagaaaatttcagatgcctgggtgttccccatcttactaattgtagtcattgccattggtgccgactaattggtgccagcgccggaacaggcaataataggcccttctgaactggcacctatgggctttcctgcactagtgaattgtggtaattcagatattggaggctgatatacctgaagttactgatactttcagaatgttcagttatatttcttttgtatgactgcattgccagctgtggaaacctagcctatttgttagaactcaaagttgggaagcactaagtaatctaattaaaaattagtaatttctggcttgcttaaatgttatgacaatggaagaggcaatctaactacctctgttgtaaatgttggacgctctaatgtgatataggtatctcaagtttgcttagaggtttgtttgtggtcattgtgtttgtaggtgtcaggcgcgaatgtaatcaacaatttttttggtgtgtgggtgtgggtgtgggtgtacttggggtttcttccctatacgcagctctcctacgtgttcaagagaaaaacgtttgcatataggctttctggccactcttatcaatattaatatatttataaattggcttagtagttggttctagtttggaaatatggttcccctgagcacagggcactgcacactttggaccgaatgtgacatattctagtactatgaatctgggctgtatgtctagattcatagtactaggatgtgtcacatctggtactaggttggttttttatgggacggagggagtaggttatttattactagatgatctgcacgatgcaatgcttacatcatggagtaatgttctgtaatttctggacaacctgaacatgcccatccttagtcggtggtgttggtttttatggttcaaatcgcagcccagattttgagctaactctggttctgtttgatctcaacacatttgtagagccaaacagaatgggtttcttgcagatttagagtgtgagtttacatatgctgcttgtccttgaggtaaaaaacatttttaaaatgtattgcagaaaattacattgaaccattgcaggacaaaaagttactgatgttgccctgttgctccgatgagattcgagtgagcatgccttttgctccagtatagatagtctgagtaaaacctagagttatttagtgtggtattaaaaaaaagttgaactcgaggaggcggcagtggtgatgttgagcccccgagtgaggccgtggacggtgccatagccgcgggacccgaggccgatgcagccgtagagcagcagcccctgccggtatggcaggtacggccgcccctacatctcctccgcctgcgtcctcctcacctcgtacatcctctcgtgcgccgatctcctcctgctccttcccgttgttcctctccctcttctcggcggccctctgccatggacacaacagcgctcacacacagcccaggtggaggaacagcaggccaacgtcgctgccgtagcggtggtgcagggtgtccaatgagcggtgtgggagctggtcgacgaggtggaggtggctgacgaaaggaagcaacggcggtgatggcagaagcttcccttttccaagactcttgattgtgaagacgactaggagcaacgctatggcgaggatgacatatgatcattacatcttggtggatttttatcccaaaggttggatttttactccgaatgtcttggtgcttataaatcaattagagcacattccatgtccttgttccattatctctacaaaaatgttcttgtagccaatcaccacggggcggtgactttcacagatctattgtgtgtctagaatattctatggtagagttttttttctccaaattggattttcacatgcatgtttgatgaactcttatgccatgtagttggggttatttatgaagatcaccatcaatcatcttcagttggattgctgttttcaggctattgtgctggtgcagttgtgcagcagtgcaggtatgcttgtgagttgtgtcaggttgatctgggattacattcagcaatacttctctctcatttcctggtgaattggcaatctatcctaactgttgctggttttccttctcaggtaagatggcatacagctcactatgccgggtatttgcaatatcgagcaccagcattatgtgttgtgaaattccaaaatactattacagttaatcacccttcatatattttttcaggtaagagcacctttcatacaaaaacacaatgtgcccggtgaaagataaaacacaactacaggcttttttttaaaaaaaaaaaactatcacctgtactagtgcagtaaaattgcactttgatgcacccacacaagattcagtgcaaacccaaaaaacagaagagaaaaaaaaattcctctaatcccattttatttgtaaggaggttgaaatggcctggattagtccaggctagcttttgcagggaaacaaaatagagagtacttgagaggctaggccctgtagccccatcttttgaatacgtgttagtgatgcatattttctcttgatttacactgcagatctggcttaggatgataagtgtaccttattttatctacctatctgatgtcttgcatcatagttaattatatgaatgaattgacaactcgatatttgtctacaccctgcattttttcccgtattcatccattgcctgactgtttacatggatgcatgtagaaccttgtgctgttttggttcataagtttagtagatagaatcttatgatgcagaatgaaatttcccttttccttggatgatataaaagtaacatactctttggatgtgagcaattagacatgtcactagcgccccaacagatcagctcaaagtatgttcccacccatgtttgtaagtaaaaagattgtccaggtccattttctttgtttagcattccttggtattatttcccaaattcatttgttcagcatgggaaggccttttttgtcaaaatgcgtgatggtcagtaatgcagagcttttattttgtaactttattggcacagatggattctaaccaagaatttgagaatattagttaatctctttctgtgtaacatgtttattcaatagtgtttgtttgcatgttcgaggtatgaatttacagttgaggttatgcatgccaagaagtatatattttttggggggtttttttgcctggtgcattctaaccagtggcttggagcatgcttaagcagactgtgctttagcccagtctgtacaccggaaatcattatcccgacatacatgattttattcagactttatcattacctttagagatgattatttcatacttccaaatattcatttctgaatgttatacctgctacatttagagttcgatataaacgtttgcagttcacatactatccaatggggccttgaaaaaaaaaagagcaagaatcaatgacgaagcaatgcttcttttcctcttgtttgtaggttgaaagaatgacttgatttatggagctataattatattgaaaagttcgttttgtaattcaatacaaagaagagtgtgagcatgactagaagatctctgtggatttcttacaaggtatttattttgcatcggtcactatgttaggaacctttagtggtttatatagtcatgaaagtttttgagccagtgcatcaaatatcttggtccattaagtgcctgcacttctctaaggaaatctacaggatttatctaagctgcaaatcagaatattcaggattaataaagtaaaaattgcatttctgcagcaacaaagaaaagacttcgaggttgtgattgaggatggcaggtcctaagtcacagggaacgtggaacgtgggtgagttcctcgtcccggaacaaggaacgggaacgaagcggaactttattctgaaaacggaggggtcgtcgttccaatacgtggcatggcgatgaaggaacgagaaggtggtaggatggaggaaccaagtacgctgagctaaaaataaaaggggaactcaccggatcaacgcttcaagcgacgagcagcgttgttgctccttcgttgctcaccgccatcatgccccgaggtgcctccgccagcgcacgccgccgccgtcgagcaggggagagggctgcactgctagtcgcaggtccatatataagaacagccggcaaaatccttgacacatctagagggaagaaatgataaatggatctttgttccgagcagatcgaagaatatgtatgttgggcaggtaaatattcagataccctccaacaagctacggtagacttctgtgaaatggttcatcatgtaacactgtccatgaaacactactgcaggagataagggggaaatttcagcaatccaacttatttactcaccgacggagcaacatttgctactggccaactattaagtagaaaatgttttcaatggaagaagaaacctgcacacttgtgactcaaaaatcgtagtctgcgggtcatgaagtttcactacaaaatacaaactagctattttgaactgactattgattcacatattagaaatgatcaatacagaaattttacatggctgtagtgcatttaaatatcatttttagggggtaaatatagtgctcaattttctttccatatttatggcaacttttcaattcctaatggaacttgcatactgatgtggatgtctttgcagagagaaatacgctcgttacatgagatagaggattttgttgggaggcaattaggtgcgtacgagtataactctaagaaaggtgtcacaaaggtgtggttcattgaattcatacttttaaattggtgaattgtgaaagagatcaatgtgtaaatgatgggttgttgccgtttcacttgaaacaagctgatgttttatttcacttaagaattattaggaaggatgtggccttgagttaacatttaattatgttatgtaggaagaaattgttttttttttcatgctacgccttttaaagcccatgcgtgcgcagcgtgacaccgcacatacccttatattatgaatcaatccagttttccggagttaggatgtgtttagttcacgccaaaattgaaagtttggttgaaatttgaacgatgtgacggaaaagttaaagtttgtgtgtgtagaaaagttttgatgtgatggaaagttggaagtttaaagaaaagctttacaactaaacacggcctcactcgttcaccgtcttcggtttataatcgggcgtgggtttcatcacttctaatagtagcatgatgactatccatgatgactatccgctactgccggcccgcctattaaagtcctccgctcacgcagtttgaattcatctagctaaagtatgtataagtatttctcggttcataggacaatgctacgtagggccaatttgaactgaataatacagtattagtatacattgctccaaaaataattcgaagtggtctcaggttaaagaaaggcaaattctctatccttctaaacttatcaagctgtttacgcagcagcaaactggcttacacagtaaacgaaaaccaccacaagaaacaagggagcctttagaataaataaaacggctacacatagtaataacactagcaattgaacaatgttggtagcaagtaaaaatggcatctcctagcagaccgacttgaacataaatacctacagaatcacccgctcgttcatttaatccgtagtattgactgcttagttgccgctccatcttcaaccagctagctgcacaagagttatgcaatggctgcacttatcatgacattcacaaaccgctccgacagaatcatgcggggaaaagaaaaccagaaaaatatggatactgcccttctctattactcctaccttcacaagcatggccataaaaaatcaacagtacaacatattaggttgcatgcctcaaatcatcaaatcaacagggataggctatctcatatttttctcaatacgaccggatctttcaaaaaaaatatttttctcaatatgaatccccatgactgtaggctagtgagcctactgaatgccttgctcctgcatttccctaacagattcttcttttaaggtgagctgactagcgtgtgatactcaacaaatgacggcgggcaaatttaacaggttatcgtaatttgcattgatttgacactatacctcttaagttaagagccttacccaagaaaaaaaattataatgcagaggacaagacaatttataaactaataccagggtgtaaaagataggaacatcaaacctctgttttgggttcctcatgcaaaaatgaccaaggtcctgatttccatagaagcctgcgatttctcaaattattaagataaaagcataaaagagcatccattagatcaatacagaacatgaaatacaaggctccaaaagggaaacagacataatattaacaattctttatcgccaattgttatattcataaaagtgatgaaaattgggaagatacccttatacaatatactggccagtgcatggatatacatcaaataacagaaatttgtcctatcc

SEQ ID NO: 12874 - DNA, 367 bp, Oryza sativa
cagtgcataaggcattgcaatagctttttctgctcaaagcatctgctaccacatttgctttgcctggatgataatgtatccccatgtcataatctttaattaactccagccatcttcgctgtcggagattcaagttaggctgagtgaagatgtacttcagactcttgtgatcagtgtatacttcacagcggttgccaataagatagtgccgccagattttcagagcatgaaccactgctgctaactcaaggtcatgagtgggataattggtctcgcgtggacgttactgtcgcgaagcgtatacgaccactctgccttcttgcatcaacacacatcccaacccttggcgagatgcatcacagtagac

SEQ ID NO: 12875 - DNA, 86 bp, Oryza sativa
ctggtttccagtcggaggctggtcactcggattggccctatctcctgaagtatgggcgccagtcggctggctttcggcagtcggct

SEQ ID NO: 12876 - DNA, 588 bp, Oryza sativa
atttaaactcggtccaaaatagagtaaagcaaacgattggaaccacatttggttctagctccactcctaaccatgctcatgtgggcaggagttagctagctctcaagggcccttcgccgatgcgtgcggtggcgcggtgacggacgggccggatggtcggagacggccaggatgcggcggcgctccggcgaggtacagtacggaagcacggcgtgtgttctttgctaccagcgggggttcaaagttttaaactccgaacctcctgggacactactagccgttggatcaggtgcgtgcggttcagattgagtggatctccttcgcgaaacgacctcggtttcagaaacaaatgaggcccagcccatttaggggttgccttaatagagcccaccacggcccaagcagccttctctgtttctcctctcgaacgaatcggaccaccctcttcaccgccgtcgagcacggcaccgccgttttgccggcggcggcggcggcgaacatgaatgttcaagcaggaaggatgcaatgtaaacgtttgctactgaccggcgttggcaggtgagtagagtagtagtagccccacgagct

SEQ ID NO: 12877 - DNA, 1361 bp, Oryza sativa
gctgagacatacagcaacaacggctcctgcgggtgtggtgaggctaaaaccggcggctcgggtgaggagttgtttgagatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcggtaactttctccgggttggcttggacgcccctatgagacaccataaaaccaagcagcttccctgacggtactccgaaggtgtatttttcagggtttaatttcatcctgaaggcgcggatgctcgcgaaggtttcttctagatccgagatcagatcatccttttgtttggtcttgacgactacatcatccacataggcttcaacgttgcggccgatctgtgttgaaaagcatctctggatcatgcgctgataggttgctcctgcgttttttaatccaaacggcatggtgacgtagcagtatgccccaaaaggcgtgatgaatgaagtcttcaagcagtcggattcggattccttcagtcggatctgatgataccccgagtagcaatccagaaaactaagaagctcgcagccggcggttgagtcaactacctggtcaatgcgaggcaacccaaaaggatctttagggcaagacttgttgaggtcagtataatcaacacacatgcgccattgccccgttttcttccgaactagaaccgggtttgccagccagtcgggatgatggacttctttgatgaagcctgccgctaacagcttggttaattcctccttgatcgcgtcttcctgtcttgtgcgaatcggcggagtcgttgtttgataggcttggcatcttctttgacatgtaaggagtgctcaatcacctctctaggaataccgggcatatcagatggtttccacgcaaagatatctttattattctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaa

SEQ ID NO: 12878 - DNA, 850 bp, Oryza sativa
cgccggagtagtggaggaggtggaggaggacagagagagagaggcgggattcaaatcgaatcccggccatctcgcgggcgcgggggtgagcgggagtggggcgtgggcgcgggagggcggggcgtgcgggaagtgggcgacgtggcccggggcgcggagtggggcgccgaaagcgggggaggccggccgcgatgggtggtggtttcggcggcggttggcgcgggcgtgggcggccagaggttagggaaagggctgacaggtgggccccacctgtcagcgcccgagagggagaaggaggccgggtgaacttcgggagtaggagggaggagcgggccggcgcgggaggaaatgggccgggcccaagaaaaagaaaaaaggagggaaaagaaaaataaaaagaagaaaggatttttccagggatttaatattgcactttgctcattttaattgattaaaattattttcaaggctctgagaattccactaaaaatcgtgttagcatattttgacatgtagaatccaagaaaaattccacatgtcgattccgattattatttgcatttattaattagggattcatctctaggttaaattaaacaattacttcggacgatttattttatgaatttagagcaagggaggggaacttcagggcgtgacagaactcgagataacaagttcggcaagtggtcaccgaattgggaagggccgtttcaaattcataaggttgtgtccaaatgggcttatatgttgcaaggacttaatggagaagtctatggacgagcgctcaatggcaaatacttgaagaaatattacccaagtgtttgggtgaatgcatgatcggctggat

SEQ ID NO: 12879 - DNA, 1211 bp, Oryza sativa
tggagaaagattaagctatgtgctttggatacatttttcggcgtcccacaacgtcgccgagtatgaggcgctccttcatggactgcgaattgcgatttccctagggataaagcgtctaatagttcgaggcgattcacagctggtcgtcaacaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaattttggatccaagcgcgagacggcgccctcagatgttttcgtcgaacacctttatacaccgaccgtacctcataaagataccactcaagaagcagacactcgtgacatagctatggttgaagccgactggcgagagcccttcatacgatttttaacttctcaagagctccctcaagacaaagatgaagccgagcggatttcaaggcggagcaaactttacgttatgcacgaatctgagttatacaagaaaagcccttcaggatttctgcaacgctgcgtttctttagaggaagggagacaattgctgaaagacatacattctgggatatgcggaaaccatgctgccgcacgcaccattgtcggcaaagcttaccggcagggttttttttgcctactgcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacccagcagataacgctcgagacttcttcatcaacagtgtgcatagatttggagtgcccaatcggatcatcactgataatggcagacaattcactggcggagtttttcaagacttttgtgaggactttggaattaagatttgctatgcctcagtggcacatcccatgagcaatggacaggtggagcgagccaatggcatgatacttcaagggattaaagcacgtgtttttgaccggttaaaaccctatgccggtaaatgggtggaacagttaccatcagtactttggt

SEQ ID NO: 12880 - DNA, 382 bp, Oryza sativa
aattgagtatctgaccttcatgaacattcaaataagatccaataccatggcctgtaccgtgccggtaatcaagaccacttctccaaagtggtgttcgtgcgagaatatcaatagcatgccctggtaaggtttaagtaacgcacaaatatcatggattttgctgaaatataacttgaaaaagtaagtataacacaatgaacataaattggtgtcaaaacatggtagtataaatcattttcttcatcacttgctagtttctgtcatctttttttttttcaaatttagtgagatagtctatcactaaataacattagtgattactggaatcttcttacaggttccaaatgttaaagaaacaatggagtctatcactaaataacat

SEQ ID NO: 12881 - DNA, 745 bp, Oryza sativa
atatttttgttttggctcacatatatagttctataagtgtcaccgcttactcttgaccaaaaaagtattaactagaaagtgattgcacctttaatcgcgtctgtcctgcaattccttttacaacaccaagcggataacgaagggcttccaggacaggcccttgttcaatgtgaacctaaccaaaatagtaatgaaaaagaatggtaaatgctaaatttcttatatctgttatacacctagattaaaataatacagtcttgtatacctcgacataactcccgacagactccgggctgtaccttacttcaccaagagcattagcagtgccctcaagagaattcagctttaggacatcttgaactgtcgtgccactgaagaagttgaatgcaaaatatatactgaatcagcaaacaatttcaaaaaacagttcggttgatttatgcgaaaaaagacaacctcttgtcagatacttgtaaaattgattcaggtagtgtaccagctacagcggcgcttcccagaaaagttgtttggaatctaacaccctcctcatcgctgaatgcaatcacctgaggtttaccaggcaaccgtgaggcccaacagctttatgaattatagatatcagaataaggtataggttcttctctacataagcagggaaacagccaactgagtaaagagacattatataatggattcatcctggattaaatatgtctatatctgtagtctttctgataatctattg

SEQ ID NO: 12882 - DNA, 20621 bp, Oryza sativa
  unsure (1)..(20621): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggtgaagcaattttgggcttgtttttttgaaagaggaattttgggcttgttagctagctttttcctaggagtaagcttcttggattgctagcaaaaaggtcatttcaagtttccctgctgacatggcacactaattagggagaaaatctctctcttgtagtgtttgtgtaaaaaaaatctaagagtggcatatggatagtggcactccggaagagtggcaaatagttaaaacccccaaaacaaattatagattccgtctgtaaactgcgagatgaatttattaagcctaattaatccatcattagtaaatgtttactgtagcatcacattgtcaaatcatggcgtaattaggcaaaagattcgtcttgcgattttacatgcaaacggtgcaattggtttttttctgtccacatttaatgctccatacatgtgtccaaacatttgacgtgacggaaaagttggaagtttgaagaaaaaaattttgaatctaaacacagcctttagcttctaccaaaccgagctgaagtccaagcgtccaactttggtcactcgttcctcggtctaatccaggggcgagcggtgtgttgtggaggtcgtgacctcatttcatcgtcctaccgcgctcgccctcgccctcccgctcccgcgtgcatgagtgagtgagcacattgtcgtttttcctagcctccgtgtcatcgtcgagctcatcccatgggagagaggggagatccagcaagccgccactgccgcctgaggctggatccagcaagccccgccgtcaatccgcttggcgacacagtcgctgctttggccgcctctctgcccggtcgcgccgacgagacggacacgccaacattgctagatccgtctcgagctccttgccatccacgcacgcacgtggtgccgagctcgttgtcgcttcgatccgccattctgtcgctcaatttccgacggcgccccgacgaggaaggtggagggagagccacaccaacgggcaacggttggggggagggaaagtggtgaagggggagaggggtgccgatagtgggtggtaaggagagagggatgcggcagggtagccgaaggaggaggccgaagtagggaaaggataagggagaaaggagaggggggtattataatttttttctagattttagggtgttcggtgtaaattttggacctccacataaattgaaaaataaaatgagaactacaaaaataataggggataagctataaaattgaagccacttctaaagccactttgcagggaaagagcagtgttgctaccatctatgaggagactcacgaaaaagctatgtgccacataagctgaagaacgtataagaaactattcttacaatgcgagtggctttgactgggggctcgtctggcccattctcgcttgctttgcacgaggagcatacttggggcatgacagatacagacgtggaaaggatctcctagttggcatgttggggctgaatgccacctaggtgcattgtgaaagatatgaagaatcaagattttagatctgtaacctaaacctacgtggcactccgaagctcctcaaatgagtaggacacactatgaatgagctaatatggcactcagggtttaatactatgactggctttcctttacccaaaggcggtaatcatctctcacccactaatgcgtggggctatggtttagctaagacagtggggccaccgatccggtggttgatctcctcaatcgtgccatgaggtggggcgggcggttgattttcacgtacgtccgactgggatttaaggcatgtttggttggtgccacatgttgctacacttgaggtaggttaatttgatcaaatatagctaggtttggtttgtttctacaattttagcatgccgcactttcttagatctcttttgatcccactagttatagacctttttcttaatcaaagtttgccacaagtgtggtcatcaattttggagccacaatttacattttgccacacctttgacacaaaattgtggcaaagtgaggtgggcatccaaacaggcccctaagtttgggaaatatactcgtgagatcagctatactactccaaatcattaaatttttaggtttttgtttaagaaaaaaaaatagtcttcaacattagccctaaacaaacttccgaaaatatttatccctacttgtgaagagcgagatttcagctcccaaccattaaggtcgtgcacgtcaggagaagaaggggccatacactggagtgcgaaaagagaatggatttatttggaagtttcttttatgtccacctcttttaaaagttaaattaggttgccggggagaatacttttatcccttaaattctattagaggttttttttttaaaaaaaaaagaattggagaaatagatttgtgtggtctgtttgtgatgctgataatacatcatttacacaagtaaataacttgacctaggtaacagaaacttttaagaagattgaatttatgagcagcttgggatttctatcaattgtctctcaaaaataagacttcatgaaagccaatgattatttcccatcaagcccatttggccttttctaagggaaataactcatcttctcactcctcacgctttatttccattggtttttatttgaggaataagttcatctaaggtcccttaacttgttaacgaatccgatttttatccttccatcgaaaaaacagatacaacgggttcctcaactatcgaaaccggtgcaatataggtcctatagcggtttgggcgacaattttagctgacatggcgcctacgtagctgaaagtgcatctaggcccttaatgtttttggtgattaattacaatgcgattagagatgactaacatttttatttaagcaaatgtgaaggttgttatgtcctcaatgagttagcgtaatgcatatcccgccgaatatgttgatgtgtgtgatgcggcaaatgagcaaatggtatattgtaccttttttctttcgtttgagtcaataggaatgccgtactattaagagggatgatgtattgacatatgaggagtgatcaaagtgctcaaaatcaatttttaaaaagtgtttctcctcagtttggtgtgttctggaaattttcggagttttccgaaagtcattttcggactttccgaaaatgcacagaaccaattttcgcttctggaaattttcggatatgtccgaaagacattttcggactttccgaaaatgactgtgaaggcaaatgtggttctgtttattttcggacttttccgaaattgattttcggagtttccgaaaaacttcagcaaaggcaaaaatcgcttctgtgtattttcggacttgtccgaaagtgattttcggacttttccgaaaacatccagaacgatgttttggtgctggaaattttcggacttatccgaaaaatttttggaatgtctgaaaaatctttcgttgactttgctattggtgctgagctggaatttttggacttgtccgaaaatctttcgtaatatccgaaaatctcaattattgtgcataacgggcagaatttgggctgtggctataaatagccccctcccctcacttgtgagcgcggctggttccattccaatcatttgtgcccttggcttgctctctctctagcacttttgaaccttgctttcttgtttcccctctcacccgtgtttgatttggatttggtgtgtgtgtgagagttgtggattccagtttgtgtgagtgcttgttgttgactttgtaaagatttgtgagcacttgcatcatctccgggagttctttgcttcatttgttactcttggaggttgaggactcctaggcggctaggtgtcactcccgagccactgatctacttgtggttggccgggagaagtttgtgaaggtcggatctcacctccgaaagggaagagatacccttagtagaaggagtgcttagtgcaacctcttgaggaaagggttagctaagacccggctcttagtgagctcctcaacggagagtagaatcccctcaaggattcgaacttcgggaacaacttcgtgagcttcatctttggtgactttacttcctctctctccactagctttgcttgtttgagccgctataggtctagtggctgtttgtgctagcatattcttgttgtaggcaactagatctaggatttactttgctatttgtgctgactccgaaaattttcggaaatatccgaaaattactgcttccgcttttaattgaatttttgaattagcctattcaccccccctctaggcctaattgacacttttagtagctaatttgactctgtcttcatctgatgtggcagtgatgcggtgcttacgggcaattttgatttggaaaataataaaaattgcaggcccacatgtcagttacacaaaaaaaatagtggggcctacgtggccccacatatcattctcacccatcctcttcttcctcctctctccccaactcccctttcttcatctctctctccctctcctctctccaggtgcaagtgaggaggggcagcacacgacggctgatgggagatgggaaaggaaggagtgacgcgcaatggctggcggaagacgagggttgcgcgatggcctatgaggctgaggagccgaccatgccgccgccccgctcgagctggatctattgcccgtctctaacttggtctgctcgctcaacatcgtcgacctcttgttggcgctcatgcacggcaaccaacttgtctcgttttgagccatggcggcagcaacctcatctccttttgagcggcgacggtgtggtcactgtgctcgaccggctccacctcgtctcctctccatcctatctttcgagtgacgtgggtggtggcgtcgccgtcactgagctcgatcgatatcatctgatctccttccggtgagcctcccccatgagctcgagctcaagatctcgattggcactgcctcctccctctccactctacccccgctcgttgtcctcctccctctccgcccggacgccacgcaccgcccctccttgtgagccatccaccgcgcaccacccctcctcacttgcgcctggagagaggagaggaagagagatatgaagaaagggaagttgggaagagaggagaaagaagaggaggggggtgagaatgacatgtgaggcccattttaaaattaattttttggtgtaactgacatgtgtgggcccataattttgagtattattttccaaatcaaattgccatgaaagcgccatgtcagtgccacatcatatgaagactgagtcaaattagccacgtagacgccacgtcagctaaaaccgccatccaaaccgccataggacctatattgcaacggctttgacaattgtgggaccagttgtatatggttttccggttgaaagacgaaaatcagattcattgacaagttagagcaaggcttataatacagccgacatgttggctataaggttctttatagacttctctcagcctacccatataatagttagctttttataattaatacgtagcccacttgtctgtctcacggagtttttttggttcttgtgtccaagccggctgtaagtttacagcccgcttctcctctctctcctctcttctctcctccacctcagcatttagctggcttataaccttctattatacttgctctaagggacctaagatgaacttattcctttatttgattcgtcgattttactttagctggagcaggatggcttgatgtgggccagacgaaactggcataggaatggtcgacaggccgagaacccagctcagtattcgcatcgccatccttcggaggattcttcggcggagttattttagtactcccaacacgggtgcggcctaccatggacgacctcgccgtcgtcagcttcgccgggggcctggagcccagccagaagccgccgacctccatgagtttcagttgccctgttcgtccatatacaggtcttgctcgcttgaatcctaccacgcttttctttctctctttggcttcagtttcagttggtgcgctactgaaatgctctggcgaaatgcgtattgagatgaatgcaaacgttccatggattaaggtggaaaaactgccaagaaatccaactgggttcaggttttcttgctttgcaactcggtgacagttttttttttggaggggagagaactttaggaattcgtagcggattttgatgtttttttaggcctgcagggattcagacttaggaggatcacttgtgcaagatgaatgggcctgaatgtccgatgactaaaaatatctcagcttggaagttggagagctcttctaatatgccaagttaatcaggtaagttgcagagctgcagtgccactgatggcacatgagcatttctgcatttgtttgttaaccaaatattgctcaatgtttcagttccttgcgttcctttgttggaacgaatagtggttgcactaaagggattttagacttagtttggtataagatgagaattttgtaggattacgattcacattatttgcgccttggtactgaaattgtaaaatcgagggttagggcaaaatttggtcactgctaaacattctaatgttaccaaatcccaactagacaaagacatcacatgttatctgtagtagtgcaagatgtgtctgacaggtggttcctgttattatgttgtctgaaatactgttgatctggttggagacttataacagatagcatctggtggtcatcctgaaaaaatataataaaatgtatgaagaaaatagaaatggatctttgtctgaccagggaacatcttcgagggaatctttggatatttttttttttggttggcaagatctcagtgttactgtttgcttgctcatgtagatatatatatgtcagttaactcatggattgtatagccagtttaaaacggttacatataccattagctaagcttcctaagaagcagaaatttggcctatatgctgatgaaagacagctgcctccttagcttccattgcgtcaggtgcaccttccctttgtctactccactaattatctcatcaataagatccttaaagatggatttttcaatggccaaaacaattccttgccgttcactgtcggagctcttccactctttcatgccttgcattgcatcctctgctagcctgctatcttcctcttcagagcaccttatcattgaggaccgagactggatcatgtcaatctctgcacataagtccttgaaaagttgccacccacttaacttctttgactgaaagaactgcactgatgaattcacagtgtggttggcatccatttgctgggcgaggagttcatttgcaagatcaaatatgagcctacggtgcagcttttcttcgtctggttttgcttgttcaaggatgaggaaaagctctggattaatcgggtagcttgatggtcgcagctgatgaggcatcatttgaaaatttagtttgttgtgtaggatccctgatgctgaaagtatctcgtagaggtactggtgatctttattggcagcaactgatgaaaaagtgtcatcggttttcagagcttcctcactcaacatttgcaagagctcaagcttttggatgagggctttcatgttttctgcctttatctggttgccatcgttgcttgcctttgaaggtggtgtatcagggaggcttgttgggttccaactctcatctgaagtatgcgtctcgccgtctgaacaagtgaaaaaaagaaagaaaagataagttgataattcttgtctatctgacattctgtctcatctataaaaatcaaaataattggtgggctcatctacataagtatgtctgcacattaaccaacatactatcatgttccttcgtggcaagtgcaacatgtggggttccttgtagatgttaggtgcagactgtagacatgaacaacagcaggcagctaaggaattgtactctctaacagtttggcacaagcaaacactcacatgtgtatctgcaactgtcaatttactgtgatccttccgatctgaaaggaccacaagctatgcttggtgcattggctactggttgcctgtcactatgattggtggatgtgcttacagctaagtatgcttgtcctatgcctaaccagtttgagcttccttagtggatggaaacaaagttacaaacagtataaaaactcaaaaagtttgcagaagaatagcttgccagaccaagtcctcacctttgaaggaatctgagattctcttcagagaaggcgatgacccctcatgataaaatgttgcatcaagaactgacacaggacttgggatgttctcctgtggatggatcttcttcttgtctgcaggtagaattgtaggcatttcctgggaaaaacaatgttttgtcaatcagttgttactgccagataatgttttcataacagtaaggtctttagaggtggtactacagttaattttctgtacctcacgattgggtgttgaagctattttgctttgatggatatatggtgagttggcattcagaggattcggatgatcaacgacacccacatcgatctgctttgccaaattgattttagtttcagggatgtgtaacacattatcgttgtcagagttgctctttgtttgcgagtgccttgatcttagcctgcctcttggggacactgtttctttagatttcttgcctggtgacgttggcaaaaccggtggaccacctcctttcagagtccgccttcttctgtgccagcctggggctcaatgagctggaaagccttggtgatcttgcagaatttacaggttcctcaccactggaatgagcactttcattcggagaatgatttctcttgctatcactgttttcattcttcctggtgaaagatgtctcttcatgccgtagtcttcttatgccttttggccttgaaaggggagcaaccaaagtatctgaagcatcaggttttgtgatgcatcttgctggtttcatgatcacaattggagactggaaattttcagaatcaactatttgttcagaggccttcttttgaatggctgttaattcaggattgttgtcgctctggcttgggccatcctttttgtgcagtgtgctcaatatcctgagagccctcagttccttgttgcattccgacaactctagacccctgagtcttctctgtatgtcagcatagatggatgcagttcttggcttcacttcagctgcacgtcctgttacagctctctcattctgtctccatggggctgcttcagggataattcttggagaaggattggttttcagtactggagagtgattcttctgcaccgggacactatgatcttggttcttgatcctttgacagtgtgacggctgatcaatttgcgtgccatggacaggtgtaggtgaccttgccgtctcatggatgtcaggagtagttccttccaaccccatgagcttggcaacgacgctgctggcccgctgatggctcggcgattcttggtgcttcagaacatccaggaggttgtcatcagttcttatgtagccagagttcttcagacgtgaacatggattcatggattcttttctgctgtccaaggacagcctgggaagctccttgagctttgctgaaggcttcttgctgtcttgcgcttcgaccgacctcaggagttgccgatcgtcgcatgagaagcgtggtggcctgctggattcatgaacatatccaggaacgccggtgctcctgtcgatcccaatcacgtaagttccatcggttgatttggagatcagcaacggccttggtgagtctttgtgcaatccttttctggactcctttgtcgacgtcttgatggtcataccatgggtttcccggttgatggactccttgacaatgtctctaaagccagtgtgtgggtctttggttttggcctctgtcttggaacatttcacactctttgtctgtgagcttcttggtggcttcccagcaaaacgctctttgttgatgtaggagagctcttgttgtattggtctgttgatgtctgtggacgagaacgaagagcacgatgaggaagaagaagatgcccgcgatgattccatggagaggctactgttctcggtcatacttttgctgaaggttttgtcctacacaagtaagtattatgttttgagtcaaaaaccagtctgtttgaggcagatgaactgcatacttgggatatatatttgtcatgcacagtacagtaggaaaattaccagagtgttgtttgaagcaactgggttttgaatcgagacattgctgttgctgtttggcaaaacatggcctaaagaaagtattcaggaaacagttattaatatgaactgtatttgggtataaaccaaaagaaagttaccgcagttaaattataaatatctaatttgatcgagggaaggaaaagatcaatatcataaagatatctgaattttaaaagttggatttgatcaagaacatatcactgaaatctattgatttgtttcagccaaagaataccaaatatctgaatagaaaaagcacttcactttactaccatttcatttttacttgactgattattcactgtgcaattgcccattactacaactcatatgtgctacatctacattcctgcagcttctgaacttgtgtcagtttcttgtccatgaccatgtacctccctataaatttcccctgttcttacttggcagcagcagtactttctaaacgaaacaattttttaatccctgttctagtttagcatctactgccagtaacactgttcatatctccacaggacagttagtattcagttttgtctttgtgataaactttggcagcaaaagagagagagagagagagagagagagagagagagagagagagaaagaagaagaagaagaagagctacacgaagagcacacgccgcagaagagtacagagaagaagaattggtatggtaccactacctggtggcgccgtgcctcgggctccgccgcgttgacgcgcggtgaggaggcggcggcggtcgaagatctggaacatgccggccatgcagcccatctgccggtcgaagtcggaagcctcctgcgcgaacgcctgcatcatccgggacggcatttcctttgccccaagctaagctctcggctcttgctgaacagctgaagacaacccccaagaatcggagatgaacgagaggcctcttcactccatggcagaaccaggctaagctagttctagcagcaagaacaccccaaccaaagagagcacgtagatgcaggctttacacagagctttcctttccttttctttttttttatcttctttcttctgttctattctctcacgctatcatctacttctctctctgtttgacaggttcagttgagaggaatggtgcttgtcaagaggaggagggagaggcagcagcttgatttaagaacgagaagatatgtgtgcaatggcattgcaaatgcattgcagcagcaacgacgactggtatggctggtcctacggaggccacagcaaatgagcaaatacaatactgtgcaaggcacatgtgggctgatcattgtgggcatgggcatgtgatgcctgtcaggcttttgcaccgtcgtcgtcgtcatcgcccgtcagatcagattcagcctagatcgatcagagcctgccactgccagtgttaaggaaggaatgcagacctgtccccgggtcccacattccgaccccggttatatatacaggtgagaatgattaaaacctcattccttaacattgatggagtgggaaaaaaatgatcataattttgttgggtttcataaattggatcatatgaccgagattagtagttgtcgaagttacatcctgaaaatttgcattcacgtccaaaatggcgtgttttccgtaaacagtgggaagtattactaacatgtataaatctgtaacccgaataaatatagattggttctaatctaagtatgctcatgtgcagaacaatgctagagcggttggtcaatctggtggttaagccattcaatcttcctgtgaagaagaagaaaaggggaagattggagacgaaggaagattcagctacatatccctggttccagagcggcgcgtgtggcagagagcatgtgccggttctacatatgagatatataatctaagcttgcttctggacgtggatcacgttagcagcaatccactacaccaccaccatgaactgtttgttttagctgcggtcagaacggccgggccatgctcaatgttcagacttctacggcctcagctgatcaccaccaaacgatgtggatgctctgcatgcccccacaggcaaccacccgaagatttgttactccgggttttgccgctccatgtggcactgacatgtgggtccttaaaggtgttacatgtgggtccttaaaggtattacaggtagtcggtggtagcgagacggtctgtttgattaggatgatggtggaaaagaaaaaaaagggatagatttgcttgaacgatgatgatagggtgtgtatgcctgggccctcgcatgtttgcggatgcaggagcatgcaaatggaaggttggcactatttttcggatgagttgtaagcgctgtacttgagcaatttgatgggtgagctgtgttagactgttaggcatctggtttttgcaaaaggacaacttgatcaacgtgctgtttgctgttcggtcatctgttgcaagagcaatttgatcagtgtaggccacgaggttaattcattctgcaattaatctctctctgtatggaaccactgttcagtcatctgtttactgtagatccccgtactactcactcattgtggcaccgcgtttgccacctcaatttgaggcgccatgtgtaatgtagctaagcctaattatacagctgggtccttgactcaatttgtaaatggctgccaaacaatcctatctctcagctggtttatcagatgaggtccatgagattcctcttgtagcctaggtggaccaaaagagctattcctcttgtacagtttactcctcttttcacattcatccacacatgcatcatgctctgacactgctgcatgaccctaactcctggaactctctgcaaagtgtatcaacactgacatcagaacagatcaaacatatctcaacatgtgagtacgtgaccttgctgttgacaaccaccttttctttttttttttcactttgcacacaattttcagtcaacataatatatgaaacaattctcgggaagtagttaacacaccatttgttcagtttaaaggattttcagcccatacaaatattaaaagtaaaggaataggaatggatgcacgtatcaatccatataattttttctaagaggtttgagcggatgtaaaattcccatgttttctctctacaacttgtaaaaaaggagaatttcctttggtttttctatagtttgtttctacaacccaaatgatacttatagaaattaatctttagaaattctaatactttgtttttcttctacaagtagaacacgctctgaatataccgaatgacactaatacaaattattctttagaaatttgaatactttgttttttctacatataaaatacactctaaacgggtcagcatcttgcgcattgggtactatataacatattggaattactcgtaatatagaagtaaacatagtcaaaagatactatgttttgttttggaacagagagggtagtagtacagtagcagtggcaagggttgcagtaccaaacttgaaggggatgcaggataaactgggaagtgatgaaggcagctactagatcagagcattcctgctggttccttctcaagaagctgcaaagaggggaccaagcaaaagacacagcgataaatggatagcaatttgtgtgttttgggggtagctagttgtactccagggaccagtgtaagcagatctggaggcatggatgttgttaggtgggttatactacctcacactgatggatgtatggatggatggattgctgctagtgctagctgtattttcttggacccctttgctgtggtggtggtcgtaagttggatttgcattgattaattagtggacgccttttatgtttcgatcgcctgtttgtgctttgtccgcctcaattgattaggattcctggatctgacactacaaaccatatatagtggttctttggtatatcaatatacttcatctctccattctataataagtttatttttaactccactcgttttgtttttaattaatcattgtatcagagtttgtgaaagcaggaaataaatatgttgggagtagataaagtataaaatagttatattgggatttgataaactgaagttattctgatatttttacatttcattgatatatatggaattcgtgaaaaatgaactcattttgaaacagagtggatttttttctttgcatttaattttattggaatgttcatttttaaccgtttggtaaatgtgcactttcgggtttcaacctggcgggagcagctcaatggcgtgccgcgtgccttgcaaccaaggaaacgcttttatggtcggttaagggtctcttttgaataaaaggtttaggaagaaattttataggattaaaattctagagaaaatgtttttatttacccttttatttaaaggattggagtttttcaaatcctataaaattactatgaaatgactcgttagatgtagatttttgaagaaactttgtaagaagtccaacctctttgaaaaattacttcaagtctatatctctcattcgattactgtgtttttcccgcggttcaatcaaacgattttttcctatattttgcaatcatccgttttacattggcattgtcagaattttgtatgtatttcctctatttcttagttttttcattcatatgattcaaaaaggtccctaagatcaataataagactcactaatatggtagtatggtgtaatgtaaatttcttttttacttcggattatgtgaaaaggcatatgtatatacatcggacatcactacacatatatacaccaaagaaatgggtgataaagttgaatatatatggcttcaccaaataaggttcaactaatcttagtacccacaattaattacgtatatgcgggtgtatgtattttcactgggaatttggtgaggttcacacggaattatcgctggcctttcttatttgaacgttaaaaggtgctctgaaacttttacccatcaggtaaatttagcgatagttttctgctaagtgtctgttgatccatttcgctcttttccatgagcgcagaatagaatttagttcttttgatagtattaattaatttctccttttttacaataaaaatcaattcaacatatattttgtttattcctttttttattgtggtttaaagaaattgtattgattacttcggaggaggtgggctgtgtgccgatatgatgacacaggcctaagatgtatactatactattccattataaaaaagaaggaatttcttccgggattaggttaaacacacacatggccttgtgccatccaatgttcaaactcatgagatatgacattttacatcacttccacattcttgataagataactcctagtgttaaatggttaatttaaaatacatcattaaatcctaaccatttattctctctctttgatttaaaactaacccttcactcattttcctatcccaatcctacttttcttatcacattatccaaacatagcaatattatgtaagttactggaatcttatgagatactattaatttgcatagccttatcggttgctcatattcactaataagccaaaatggtttattagagaataaaaattaatttatatttacaaattttatagatttttttatagggacttaaaagccaacgctaaaaaaaattgcgttgaaaatatcttaaaattaattttaaaattaagttcaaaaatttaaaatttggcttttgctttgatttatcaggccgagcgataatgctctttgttgttccacgtgaactagggccaaagaaaccacacaagtaaattagcagtgttctcagactatttgtttcaattaccgtgcccaattattccaatccataaattgcatgggtaagttaattcatattgttttgagactttggtctggtctgtcccttccaacacttacacagcttcgttgtttcgcttattcacttatccgaattacttattaacaaataaaaaattatttgtgagtaaaacttttatatacatgtccttaagaactcaaaagtaaatgttgtaaaagaaaatatgatagaaaaattttaaaaataaattcaaaattgagttctaaaatttaaattttggtttataagaataagcataagggaaacttaattatgagaccctagttgttatcaataaaatgttttgaaatgagatgaaaggcataagggaaactatgagaccctagttgttgtcgataaaatgttttgaaatgatatagaagtagccgaaatacagaagaaataaggccgtgtttagattcaaaattttttcgtcaaactttcaattatttcgtcacatcaaatatttggacatatacatggagcattgaatgtggacgaaaaaaaactaattacacagtttgcatttaaattacgagacgaatcttttgagcttaattacgcaatgatttgacaatgtgatgctacaataaatatttactaataacggattaattaggcttaataaattcatctcgcagtttacagacagaatctgtaatttattttattattagtctacgtttaatactttaaatgtgtatccatatacttaaaaaaatttggcacatgaactaaactcagcctaagcttgggaggtttcgtttaaaatgtcatctccacgtatctgtcctcctcgcttgcaagtcaacatatttttttggttttcgtttacacagagtacaagttgttacaccgagatgagattctacgacttgtcgcatttatttacgctttgcacgaaagtttatgtaatgtcaaacaaactttaattagacataatgctctaattaaatttccatctcaatgaatgggattctgatcttcccccttaaaaaaggtaaaccaatttagaccactgccaaaatgatgggcaaggttgggcttcgggccacgcccaataagcctaagcttaatgctaaggccctctttatttagatatagacttattaatttagacttttaagttagcttattaggtttatatgatttataagccggtggatttaatatcctaagtttaatagtcaagtcatgtatctatctcacataagtcaaaaaagcttctccaacttattttttggcttaatagtgttagaagggcttatagctttagaaaagccaaactaaaaagccgcttatttatttaagctcagatttttcgggggaatagttggcttataagcctaaaaacaagggcctaagacaaaaagtcaaaagagagcccgagcctaaccatcctagggttttgagatagggtgggttctcttagcttttttcaccgcctcaggccttattcgattaatccctataagggagtggttggaggagatttattctagtatataagttaaatgagtgtagccccatttaacctgggacatttaacattttgccacttttaagatgtgcgtaattactagtatttatcactcgttatctatgacatgctagctctcatgtgtctatgacaggtaggtccagtagtaaattttttatcaccactcgtaaaagtggcaaataattaatcattctattttatccgtttatcagcgatcgtaagagtaagagtggagctaaagaagactagtaccggtttatccgcttgtgcagaaggtgaaaatcatggggaagagatcttataataatatcgtcaacaatagaagagctaataattggctggaaatgtgctcataaattttagatcgctatattctctgcaaataaaacaaagaaaataaaccaatcgcggtccatcccttatctcctcagtttgtcgacacgtgtgtgtgtgtgcgtgtgccgactaaaaaccgctgcaagtcattgcactgcatgcaaatgtaacttggagaaacaattaatggatgccggggcattggccggtcgacgacaaggcttccatttatcctcaaattccgacgagaagatatagagatagagcgcatatgcatgttccgatacacatgcgaatggagcatgcatgtctttttcttctctttcagctagaggacatgcatgttggatagagagtactctagttagatgttgcagtcaatccatcagtcgctgccatgtgtgcagtgctaaagctagcatgcattatttaaacggtttttgaccgtttatatatatatatatatatatatatatatatatatatatatatatatatatatatattgaccgtttaaataagctactagctagcaactcgaccctagctatagctagggctccaggacagttgccgggggatcgaccggcagacacgcgtgatcggttgatcgatcgacgcgtgcgacgacgagatgacggcgaacaaagccaatctaacgttctccatcgcgtcggatggcgacagcctctttttccttcgctactttacccatcttatactactacagtaacctaaaatcgtatgtaacttattctaatactattaatagagagttttctatcaaattcattgtattatcataaagcacattcggttttagattgctatatattctgagacagagagaatccatattgttctctctctcatgtacttatggtataagattatagtcgtagtatgtactcctgtaccaatatatatgggggacatataaagaatacaaaacgtactctgtagaacgtaggagctggcaagcatgcgtgcatacaacatccgatcaatcggatggaaacatagggtataccgtacttatgtacatgcatgcatatataacacttagtgccggtcctgctactgtgtatcatcaacatctgtgattgaaaggtttccaagaacatagaagaacaatatcacagaatcaaacatatactagtcagcatccaagaacacagatctcgaaggaagagaacgacataccgtcactgctactactcttcgtgatgaagttctccaaccagtgcatctaccgctgtcactgcttatcgccgtccaatgcgccgactgccatcgagcccttgctggtgggaggccacccgctatatgccgctgggggaggatgcacctttaccgggtggagaagagaagaggatttggtggaagataaactggtcgcttataagtcaacttgtgtcttatgtcatctcagcttgattcatcggtggcgtttttcttaaactaattaaataacactgatgtctcatatataaatactggtttttatacgcccaacacaaatgactcacatgtaagtatcagttttttgtcataaccaatacgtgtatgactattgatattggttttaatttgataatgtcaaaacatggaaaacctctcatatgagactggttcatatgacgtgttttgtactagtgcagcccccacaccggtaaggcaccttatggcctatggcacattgcagcctgatagctagctgttctaaaatacaaaatggactccaaaatctcccaaatttagtcatcgatgcacttctgaacaaaattccgtgacaacgatgaagtgcactatactatttgacgacctttgtgatggtatatttttcaattcacgttccttgcaacgatagctctggcagagtcgatcaacaaaataaccagcgatatcatacgcatcatatatagacaaatgcaactgacacgcacacacttaaattaactattaacaacgatcatgtgcgcgtccttcttcgatcgttcagctcaagattccttaatcaaagcatcgagattatattttttttcgtatgtattagcctaactagctaccagtgtgcagctggtacggtagtgcagctccaaagtctttctaatatcttatactcttttcatggtcaagtggcagtatctcgcattgcatgcatgtgagcatatatatcagcgatcgtttgctggagccacgggtaaagtctagctagctaagtgctaattaggagcacacaaaaatcttgtggcagttgtcatatttattcttcagttaattaacgacaaatctgtcggtcgatgtggatcgatctatatatatatatatatatat

SEQ ID NO: 12883 - DNA, 70362 bp, Oryza sativa
cgtttcaccggctccaccggtcgctgtccaggccgccgccacctcagctggtcactactgcccctctccaacccccttcattctctctcttgaaaacacatcttcatatgtttacagatttattcatgcagtaaatatatatgatcaagacaatgtgtgttccattaaatcagcaaaatataggcatattttgcttgtcgattattatcctgctgtacataggaaaattttcaacttgtttgcaacaatgtctaaaattttcaacttgtttgcagggtattatctgtgtctgatgatttgatgaatgttggatcgaaggtttgaatagaacggtgattagctgctggctgtcgggtacttctccagcagccgccgccgctgatcttcttcccaggacaactttctgcagccgccgatcgccagacacatatcacttgttcatggttatttaattcaaggctacttagtagtatatgttctcatatggtctttagtacagtcagtctatcatgcatattatgctgcagcagaacttttttcttaatatacatgtatatattttcatatatgcaaacattgggatgcgacattatctatttcaacactgaaagtttctgaaaaatataagatagggaagtctgaaaacttactatcacaatataggaataatagggaggtctatggccctcaatttcctctgttctatacctctatgtaattcttttatctgatagttttatatatcaccaccaaattcatatatacatcatatataatctttgagatgatattttatatagtgtagtcttaccaatttcttttgtagtagatctgaacacgtcaatgaagggtattaataatgacttgtttgttttctgcattgtagtttcaacaaatcgccataccctgtgcctcctctctctatccatcagttgcctgccgacgatcttctgccgacgaagtgctgctgtccgccgcgatcttttgcatacgccacgccacgtttggccttctcagatgatcgctgggaaggcctcacggcccttccccctgatcgactgcttgatctacctcgacacgatggtctacagcaaggctgcagtgcggtcatgaggtccaccttggtgagcagctttctagacctctttgcaattttgtttggtctttgtttattccttgcaaattgtaggctgacatcgccatcatctgattgtttatcagacctgatcgtttagtttagttttttttttttttttttgcattgcatcaacgtgaggacgcttcataattagggagaaactgtgggtaaaaagaattccaggtgccaaatgcgtgggtaaaaagaatcatggactgatattataggagacattgaaatgtttcatgaactgtgaaaataaatatttgattcaatgaggctgttcacagtctgaaaacaatgttctgttgataggcttcaacctttcatttgtagctgcagccatatacgcacaaatttcattaaagcttggtgctctcagcacttaaatgccaaaacagatctcaattcgtatatgacctgagttttttttttttttgaaagatgggcaaaagatttgcctcctttgtattaatagagaaggagctgagttattggtctgagtgtcttggatcttattaggaaactgggcatttgtaacaagaaatttagatgtgtcagaggtatagctcattaaccagaacataattggtttatcaaccagatataatgcacattatcaatgaaatagaccctctaccagcctctctggctttactcctgatattgaggaacttttattatttttttatgggtagtataaagcttgctcttgctaggttgtggttattaaacaaaatttagaagcttcacatctgatacatgctgacatcccttactggatcattttgacatgattgctatgagaatatggccgagtttagttccaaactttttattcaaacttccaacttttttatcacatcaaaactttcctacacataaacttccaacttttccgtcatatcattccaatttcaatcaaacttccaatttcggcgtgaactaaacacaccctgtgtgttggaattcttttcaggctgttttccatatagccaagtaaaactcgtaggcaatgtaatggtagtaacaagtaatgtattcctcacagtgatatttcaccatgctatcattctttacgagcatcttgtgaatggtttcaggaacagagcaaatggattgcagttaagaaatgcttatcgatattcaacatttcttaggtcagctggtcagaggctgggtcactttttggcattattgagcagaagatgttctcgcaattttcccctttactgtactgaacttataccatctattttcttaaatgtcaaatacttaattgagactgcattgtgtcactgacggttgcttgatagccaaaataaaaagagaaatataatataataaatttgtgcggaggtttctggatgagcctcttatcattttccttatttacctcaggtttggcctttggattgcatctcagacttttgcatggtggtcaactggcaataatcttcagtttttttttatgtaaaaacactatagaaaagattcctacagtgtatatattataaatattaacaaaaccatacagaaaccaaaacttcaggtaacattatggtagttcaggttttttgggcgatttgcagcaaggagtgaaaataattgatctttatttaggtatgttcttgctggcgcttaatgctttttcgcaagctcacgatgtttgggtcactaatattctttgatatgcatatttggatttgacatgcaaatttttatgcatatattttgattcggaagttatttttaattttccttaaataccatattatcgtattttgtctttaatatatttatatatgaccataatcgaattaaatcatttcactaagtgtaattttaaattgatatattatttcccgttgcaacgcacgggcacccaactagtaattaatatgtgtggacgattgcatcgatcacatgacggaattaagcgtgcgcatggagattagctgtctagctctcgatcgtgtcgtgcttatagccatgtctcatatggtctggaaaaacaaatgattggacaatatcatgcactccttgcatcgggcagatacatttccaatgtttcatatatacgtaccatgggcattgtcttcttttttaaaagacaaagatcttaaccaattaacatatcaagacaaacaatttgtggaggatttaatatagttagtggggtgggcgtatctataaactgaggatttaatttgttgaggaattgagataggcttaagaagggggtaaatcacaacttggctgattttgtttggcgatgtggtttatgtggtgaggaattgttatttttttttttgcgggggaccgtagattcattaatcacggtcagggttacaatcttagattaagatatccctaagttcagttggggttataagccactccaccacctgagagagttctgggataccatccgggcacaagcatgcgctaccctattacagtttcggctaataaaacgtaaattgaagtctatgaagctccagcctccggctgaggatctccatatgtgtaagcagagctgagatttctgaacattgctgtgctctcatctcccataaaccagtaaggacttggcagtcagtctccaagatcagtcgttgaacacctttttcccgagctagcatcatgccatcgcagcacgccaatgcttcagcagcaagagcatttaggcagtactcgtaccaccgagcagtgcctccacaagttcttccattttcatctctaagaactgccccagatgccgccgagcgtttgccatcttagaaggctgcgtcgacattgcactttacccatctcggagccggtcgttcccagggtattggattaccaatcattgttctttccttttccggatgaatcagttgccagagatcgaaggcggtatcaatagcccattgtgtggcagctctcaccggtcgcggctcctcaccatgccacctgctgttcctcgccatccaaagccacacaagattactgcagcctctttggatgggacacaccttgggtcgaccagatcacacgcccaagtaagcgggtgtaggtgcaggaccttgattccagataaggttttcgtctggttccaaaagaatttagccaccgtgcattcaagtagaacatgcctcactgattcattttcccctccaaagacatcacaattagcaatgggttctatgtgtctgcgtttcagaacagatttatttagccggaaggaaatcatttaccaccctccaccagaagacgcgaacttttgggggcacacatagtttccaaattcgggaccaagtcgtgtctcctgagggacttgcatgagatgtagcatctaactgcctctgttcatcaaacaagcagcgataagcttatctgacagagtaattccaatgtcttttgagttcccaagcccaggaatcttctcttactccactcaccggcaaactcaggatagcctgggcatccacatcaaggaagagttgtttgattaattcagtgttccaacttccacttgggattaaaaggtctgacaccacatgcacatgctgccgaactggttcagtaatcggcttccccctgaaatgtccaggcaaccaacgatcttgccagatcctcgttgaattgccatcaccaattcggcgcacaagccccttgaacagaatatctcttctcgctaatatagctctccaagtatggcttgaatgtttcttccgagtggcttgtaagaactctgactcatgatagtatctgcctttcaacactcgggcacatagtgaattaggatttttgatcagtctccatccttgtttacctaacatagctaggttgaacaatctcaaatctcgaaattccatgcctccatcagctttcggtttagtcagtagttcccatcgctgctagtgaatgcgtctgctatctgccgagctcccccaccagtagttcgctatcattgatttcattttccgacaagtatcctttgggattaggaagcagctcatgggataggtcggtacaacttgagcaactgatttgaacagcacatccctacctgcacaacttgcttcacggccactccatgttccaactagatttctgattttggttggcataaattcaaaggtgtcctttgttgcccgccccaaggcagtagggaggcctaggtacttctccgctaatgcttccatatcaatatgtaaaacttctcttacctcccgtttgcatgcattatcgcagttagcactgaaaaagatcgctgatttatctctgttcaccaactgtcctgatcctcggttgtataagtcaagaatatcttgcaaccgtcaagcccctctctacgaagcttctaagaaaacaatgcagtcgtctgcaaacaggtgtgaaatccatggagcgtgtatcccaacctgcacacctctggcaagatgcaccggtccaaccacccttaagaggcaggagagaccttcagcgcacagtaggaagagatatggggagattgggtccccctgacgaatccctctcgacggcttgaacgggttcgaaagttgtccattgacccgtacagagaaagatactgaggtaacgcatctcatgataattcgcacaaaactttctgcaaatcctagttttaacatcgtaccttggagatagtcccattccactcgatcttaggctttcgccatgtcaagtttgactgcgcatgcccccgtttttcctttcttcctctttagatagtgagtgcattcataggccactagcacgttgtctgtgattagtcttccaggcacaaatgcactctgttctgcagagataatctcatccaagaacactcgcagtctattggcgagtacttttgagcacaacttatagaccacattgcaaagagagatcggtctgaagttcttgagatcctgtgggtgttttaccttcggggttagcacgagtgttgtctgattgattgcctccggtagctcgcctccattcagaaaattcagaacagctctggtaacactcgggccaatcgtctcccagtgcgcttggtagaaaccaactgtgaagctgtctggcccaggcgccttgtgggcacccatcatagatagagcccgatctacctcttgtccagaaaaaggcctctacaacgactcgttcatggcctcagtcacatgccacggtacatgcgtcagaatgctgtctggctccaaggttggttgggccgtgaataggtcaccatagaagtccacagccattgactccatcgctgcctgtcccataatcagatcaccattagccgccctcagagctagtatctgattagtctttgctcgttcccttgcttttcagtccccttccttcaaccatgtcaagcgtgagcgttgcttctccattattttctctcgtgcaagaagttcagaaatatgagtcataatttgcagttcccaccgagatgggcctaaatggagggaagagctcctcacattctcaagttcccagtgtaacctgcgcacttcctgccgtactgagccaaaaaccgtgtgatccattcttggaacgccgattgcattttcctaagcgagttttgcaactcaccaaaatcctggacatggtttacatccccccatgtgtctttaaccagctatagataagaaggatccctcctccacatgttctcgtatttgaaagttcttctacctcttcgcctcttggatcggttgcactcgatcaccaggcaacagtggtcagattctgttgttagcttatgaactaccttgatctgtttgaacatatccgcaaacgaggcgttagcaaaagctctgtcgagtctaaccttaatattatgaattccttcttgacggttatcccaggtgtatggcagtcccgagaaacccaagtcaagaaagccacacatggccacagcatcacgaaaaccattcatttgtctttctggccgcagcgcccctccaaattgctcgccggcatctaagatttcgttaaaatccccagcacacagccacggggcattgctttggtcattcagaaaattcaacagttcctagcttcggtgtcgaagttccctcttagcttcaccatagaagccagtaaaatgacacagatccacacccgataccgggtccaccaccatcacgtctatatgaagcttgtcatatgattgcagcttcacacagacctcgttgttccacagtagggcgagacccccaccgcaaccataggttcccaccccaatgccattcgggaaactgaggctactccgcaatccttgcaccttgttggagaagcatcgagtttctgagagaaagaccaccacatgtacttcttgaactgcctcgagctgccctaggccctggcaattcaaacgtaagagtttcattgtgcccggtggggactgcttcctgccgtcgctgccgatgatgcgattgtcagagattcagatattttctgtttctttggcgacacctccgaaatagatgcttccacctctccacctgtcttgcctagttgactcactcgctccgacaccagtccccttggaactagggctgtcatattggccacttgattgttggggtctgacaccgaggtactacacgaaccattcgctttcctttttcgcagcacaatctgaggatcttcattgttattctaggataagtgacgatttgcaaccaccccctgattagaagccttctctcaagtagaggcctggtttcccggaggtgacaaggtctcatcatcttcatcgcataggtaggattcttcgggcgcccgtccttggatctcaacgatgatcccttcggctgcttcgaaccacccgaagagccactgccaaaggattctgccactgcggcttggaagctcagcaatttcttcttccgaatctctggtgctctaagtcttatgtcgtagggtagcttacccgacccatatcggaccaccggtttctcatactccagctctaaatggcctactataccgcacgcaagacaataataaggcagcttctcatactgcagataaaaccattctggtgctgcatccttttttgtcttcaaaagcatacctcttcttagtgatttggccaccacaatcgccacacgtccacgtaggtaagggccactcgctttgccgtcagagtccacctccaacttcctcactacgccaaccaatcccatagcgagttcgccacggtgcttgtcatccagccgagtgggaggttcaagattctaatccagatctccattcgattaaaccttattactgaaggtttgaggtttccatcatagggctgcagcatcaggacgtggcgtcccaccatccacggcgagccacccaaagcacgttgcaagtcccgctcaactttaaatttcgtgacaaaaatgttatccgccttctcgtcgatggatctgatcttcaatccgtagggattcccccgtgccggtttcatcgcccggaatactgtggtggcatgcactattgctggcgagaggaccttgccaacaagcatccattcaacctcctgggggtctccagtctcatcatcatcgctgaattccgcaacgttttcttcttctgtagtcaggttgaggttctgaagctgatctgcaacgtgcactttcggcataaaccggtggtccactcccgattgcggccatggccacagatcggagggaaataggatatgcagcgtaccgattggaggctagcacaccaaaaccgatcccactctagggttcctagcggcgctacccctagtgagaaattgtgtttggtggcgccagaaatggctaaccgacgatatgcggtggccgtcgccgacaaaggtcggaaaacggggtgtgggcactgtgatcggagttgtcgccggtgttgctaatcaagatcgccggcgatggcggcctaaatcgagagtgggatcgcgatcgcctcctggatcgcctgcgcacgggagcagattcagtaaccagacttttatgacaaaatgaatgtcggtgaggaattgttactcgtgtagtccctggtgatggccgagtggtcagtttggaggatggcgtgcttctatgctcgtccagaaaaaaaactagcacgaaagttaaagcgcatcagtggttgagattaaatgtggattaacagagtgatcgttattggtgaggggcattttcatccatggaaacttgagcacacgtccagcccaagcccacctcaagcaaagccatgcggctcccccagcaaacagcgccgctggcccgccgacccttctgtagcatcgaccaatgattgactggataactactagagacgtacgccgaacacaaaaacacaagcttcagtatcattggcttggttcttctgtatcacagggttggttggtgttcttcccaggagaagccagatgacagtacaacagaagaaccgagctactagtctggagagagatctatgcatgcatacacaacgaaccaaccaacaggaggcttaaaactgctaatccctagtgcccgtcggtgcagtagattgcagaatatctaaaatcccatctgcatagcggcggcggctattaagctaacaacgatgatgtgagtactaaccaagcggtggtggttaatttgatggtgaggagggagtcccggacggtcgatctcgtaggacgggtacttgtttaggcgaaggcagcagactcgccccacggtgcctcgctgaagtggagctattgcgcatgcaggcttgcatctctgtgcttcggtgcggtcatggacatctcgggcgtggtggcggtgtacgacgatgacagggaaagggcgctgaagtcgagctgttgcgcatgcaggcttgcatctctgtgcttcggcgcggtatgtacgtctcgagcgtggtggcggtgtacgactgttaacgaccaaatttggtaatatcagcatcggagatgaggattagattgaagcggaatcaaagatgaagatcgttgcagaaacagagtaggaatcggctagagtccggatcggctacgattagatcggctaagttcaagtcagacttggtttggtgatgcagccgattctggcaatacgacttggtgtaagacatcgggttgaattgatatgcttcaagatgattgccacgcatggatagaatcctgagaaggcaattgtatatattacttaggatattttatgtaattttcttagatatatgttttggcaaaagtctgccataaagacttatgatatcttagagtttgttagagataggagtcatgtccgatatggacatagtttgtaattttcgggtacaaatagaccccgcaccccatgtaatcaattaacacatacgttcaatacaatctcggcgcatcgccaccctttttgctttagttttatttcgacgagttcttgctttcgggttgagctgcatcggtttcgatcttcaacaagaggtaaaacttgttatgacggcttgcgttctcgggattagtgcttccatctttatgatactctaatcttgtttatgtaattcgtagagttatcatatatcctatataatctctggcaatatcgctatctaacctacaatcggctaacgtctatcaatagatggcagccgattaggttaaatatcaacattggcttagattatatgatatctaccactctatgaaacttccaatggcttgattgtctagatattgtccttcttttcatacttatagctgcatcagttgtttgatcttatgagtcgtgattagaatctcaatctctagcctgcttcttggttgccgattagggtagtatcggagtttcagccgatcttacctgatttaactacatttgttttatatgctttactgacatgttaaatctgtcctttatattaagatcttatcgcatttaggtatattatgcttttgtttggtatattctgcttgctttaatatcttaatatagagtggtatcggagtactagccgatacatgctagatctatctgatcggctatgctatgaacatatatagttttgttgtttgtatatatttcaatctaagtgatttatactgtctcggcatggcgaccgatctatcccaatcacttgatttaagtatatatccacataaggattatatattgttaatatctacagccgatcaagtagatttagttctttattattcatttataactgtcgatcgatgtatatatatgacatcggctcaaagataaatgatatgtcatcggcacttagccgatcggctatcgtttatcgatttagttctttctttgtctttatttcatgttgattgcaggatcaaatcaactggcatgctagcatacccgaaggcgagttttggacctgcactggagttaagcagatctctcaggcctcgtgtttttcatcaacaacgactatgacagggaaagggatgagtcagcggacggtgcattgccagaggacgagaaggagcagttgttgatgagcgcggaggaggtggcagtggcagagactgaagtggaggcggtgccatggaggacttggcgttcttggcggccatgatgttctggcacagcctagagcttggcgtccacggaggcgtgaagcaacccacgggatgcggcgttgtcgggcaagttgagccacgccgtgttgccgcggaaccggtacgcggcctggtaataggcgagcgccacatagttagttctgccaaaggagccgagccaaaagcgtgtgcggttccacgcgccgcgtggaatcgaggccatatggcccgaggcccgacggcctggcccaggcacggcagtgccatgtctgggctgttaccttggcacgctgggccggcaggacccgacacgaagttcagggatgtgaaacagacttattttcaaccatatgtaagatacggcacaaagaatagggatgaaaaatacacatattatatggcatgggccaacaagtagggacataaaatagacttatattagctatatatatatatatatatgtgtgtgtgtgtgtgtgtgtgtgcagcccgtggaaccacaggcacggcacggcctgccgaccgtaccgtgggcagcccgtgggcaggcacggcacgacacgaactgccgaccgtgccgtgccggcctgatcgccttgggccgtgtctaggccgggcgggccttatggccataccatgggaggcgaggaggggaaggggcattgacgctgctcacgaggaagagctgcgctgcgctgctcgaggtgccaggacgtggactcaactttacttggacaaaagtgcctctcgctaatgacagttactccattaatcaacttttaatctgagccacttatgcgctttaactttcgtgctttttttctttgaaagcatagaagcacatcttattgagaaataggcatctgggagatcggcgtaggcgcgttgtggacttgtggcggggtcgtgaggacgatctcgaggacgaggagcgccaaagcgctagatcgtctggcctgctgccccatttgagcgtgagcttcgaatgagctttgagtgaaggcccgtgtactggagaatgctaggcgcctatgatctgatgaataagttcacatactgaccctcaaaagtgatcgaaatctaatccgtgaccctaaaccacaaaaccggatatctcgaccccccccaactctaaaaccggcgcgatttgacttccttggcggtttggagggcggtttcgctgatgtggcgcctacaaggcgatattgaccaggtctcctttacacgtggcgtttaggtggcatttagaattaaaaaatatgtgtggaacccatttgtcattgacacataaaataaattgtgggacctacgtgtcccttctctctcgcccctccctccagttccttctccctcctcgccactccctctctctcccgcggtggcggcgagggccggagcggcggcgggcggagaccgtggcgagcggcggaggcgcggcggcctgcgagcagcagagacgtgggagtggcggtggcaggcactggagcggcgatggcggcggcgctcgggctgagctccaccacggtgaagatgaaggagaccacaccacctcccgatgacatgaaaccggtgccggcaccatcacagactcccgacaccaaaatacttaggggaggagggtagtacgcgtacctgtaccgtgacagcgtcaaagtcctggtcggtggcgccctgcagttcaagcagggcgcggccaagctcctcgcaccccaccgtttgtgcctcccgcctccgccacccagcgtcctccaacacccatagcatctctctctttttcctccgatgccgtcctccgacttccgcgtctcgccgctcgagggccgctcgcgccagctcctattcggcgccgaacaggaggagagcagcacagctcctcgcaaaggggatccaacccccgcccgccctcctgccgccggctctcgcccagaccctcgctgcccgccgcgggagagagagggagcgactaggcgggagaaggaactaaaggaaggggaaagagagaagggacacgtgggtcccacaatttcttttctatgtcaatgacaaatgggtcacacacatatttttttaattctaaatgcaacttaaacgccacgtgtaaaggagacccagtcaataccaccacgtaggcgccacgtcgacaaaactgccaagggagtcaaattgcactggttttaagagtttgggggtcgagatatccggttttgtggtttagggtcacggattagattttgatcacttttgagggtcacaaagtgaacttattccatgatctgatactgtaagtacaaatggaaaaagtacatcgaaggtccctcaacttgtcgtcgagttacaaaatcatcctccaatcgcaaaaccagatgtatgacatccctcaacttacaaaaccgttcactttggtccttcagtggttttgatcctggttttatctgacgtggtcgctgagttagcgtgggacccacatgttaggatgccacatcaccatctctctcttcccctcttctctccctcctcactttctctcactttgccgaacgacataccccaacgacggcggcggtccagagcagcagccgtggcatccggcatccagcgggcggcgaccccctctcaacactggcaccagcagcgagcccacgagcctgagccccgaggtggtgagagggggcgacgcggtggcagtgacgttgtgcggtgccgacaaggacatgatgcagcgacaacgctggtcctccccatcctcatacaccgcgctgccattgctgccgacgccacggacagctcgcttgctcccatgccaccggccagcggcaagcacgcacgaagagggaggatatggggcgggggttgacagcgagcacgcggagagagggaggatgcggcgcgggagtaggccggggctccgagtccaccgtgtccacctccatgacgcctggccccacctccagctccacggccactgccgcaacacctgcccgcgcggggccgcttcgcttgccagcgcgctgctctgtcacgcgccgcccgctcctcctcccgccgcctacgcccaccggctgcaggcaacagctccctcgccgggcactgcccgtgccgctgcttcccccaccgcctgcgctcgcccgggcgccgctccgccgcctgcgcccagctactcccctgttggctgcccatgaagaagagaggtgagaggaagagaggtggagaggggagggcaagaataggctgatgtatggggcccacgtgggttccacgctgagtcagctgccacattgaacaaaatctgagtcaaaaccgccgagggacctagtttgcactggttttgtaagttggaggatgcgtcatatccggttttactgttcaaaaatgattttgtaactaccaacatattttctctctctcacacacacacaatataatcatatcataacttacatataattgcaatataacatattaacatgtgtctaacttttttgaaccgttagatttgcatcaatatttgtgcaagtagaatagggaaaaaaatcataacacgtgtatgaggggatttagccctgtaacctctgcttccgggaaataacgtgttgctgcaagattttgtaaagttatattttatatatgtaaattatactccctccattcaaaaatataagacacaaccacccttaacccaaaaaccaaaaaattattattatcacctcatagtttagattaccctaataatgttttgactttgatcagagtcaaactactttaagtttgagtaagtttattcacaaatataatgatatttacattaccaaattagttttattaaattagtaattaaatatattttataataaatttatcttgggtcgaaaatattactatttttcgataaacttgatcaaatttgaagcagtttgactttgaccaaaatcaaaatatcttataacctaaaacagagggagtagaatgcatgcacccaataaaattagagatcttgatggtggaggatttaaataataatattttagtggaaaagtggtgccagttaatggcatgaatgtatacacgccttatattatgaaacaacttttaaaagtatttgtaccttatattatgaaatggagggtgtaatatataagttactacgactatactatatttacacttgataattctcaggtgaaaatttattaacatatattatggttaattagtcccagtacaaaatagaatccaatatatgtccttcagctctgatctgacgagccaaaataattcaggcaacgtgactaaaccacatggagaacagtgcaactgatgcgtgcaaggttaggaatgggctgagctgctgcttgggctaattaattatacgtactgaacggcccataagccttttttttttcacggttgattgaaggaagtccatccaaaatgttgggaaaatggttagacgtcctccgcaactgctctccgccatcaacgccttctagcccatctccactcctcgctacgctggctcagatctccactagcctcttcaccagatccgaccaaggagagatcggttggagttgtgttgtcttggcagcccaaaactttccatgcgccaccttcaccctgttcttcatcctgttacagagctccctactgagaggggggaggagctcgacaaatagataggatatcaagccaaccattaggaagacaacccacaccaccaccatgcctcatcgttagcgcctactaccatgccaccgctcccctgtgcactacctcaggatccctctgatccgctatccagtagcctgctcgccacatccggtcaaagagagtctagatttgggcagcgatgtctcggtggcccaagcctacccttgttatcccactactaccttctccacggaaggagaagtggagctccaaaaaaaaaaagagagagtgttcggccaacatcaagggacgcgaccctccatcaccctctatacctttatctctcctgaccaccatcgaccatgactggctggcagcaaggtatagctttgcctcctctaacaagccacgccaccgccatgactggctatttttagcctagtctaagccaagctggctaccgctgcccttcatgctagctccaagccaccatcgtgcctaaccacgacaaggaagaattcctgttgttgccacctccaagagctcggtcgctagcccgacctatagcagccgtcggcctcctccactccagcttgacaccatggctacccccaccacctatacggtttgtgatgctacccgcccctaactagccatatccgggtgcgccaccgatggatctggacagatccaaccataccgcccacgacttcatcctccattaccggcggcgactgccgttgcatcatcactgcgcccaggctggctccggcggcatggcaagggggaagggagggaagtggggtggggtgggggggttggagttgcagcggcatgggtcgccgcccgtgttgctcttcacgagcgcacgggggcctccattctcatgccatcataagtcttagtttaggagtatatttataagatctagatggctcggtacacacattgctctctctttctctcataactctcgcctgattggatgatacgactgttgacagtagcatatcttgttgcattaatttaatcctagctagccagtcgtgtatgtcaagtttcgacttggtccgcatcgattaggaggacatggatatatccctctagcttaaggccttgtttagttcctaaataaaaatttttcaccctatcacatcgaatgtttggacacatgtatggagtattaaatatatataaaaaaattaatcacacagatttcgtaaattacgagacgaatcttttaagcctaatttcttcatgatttaacaatgtggtgctacagtaaacatttactaatgatggattaattaggcttaataaatttgtctcgcagtttccagacggaatctgtaatttattttgttattagtctatatttaatacttcaaatatatatacatgtatatctgatgtgacatatcaaaaatttttcgttcgtgaactaaacataccctaattatcgatgggcgaattgcttccgtacatggtctagttgaccatgtaatataccacttgcggtaaatatccagctagctctagctcttgctagtagtagtatgtataatgaattagtattactgtgtacgtaaacgtacctaatgcaacagtgcaagacgactttgagatgtttcatgcacgtgggcattattgttcctgctggccgcgctctgcgcattaatggcattagcagtgcgccacctattttgcagagcctggggctaccacataggataaaaacacaagaagaataatacttgtcacaagtttcacagtgctatgtagcctcaaacaggatccacacaactataaaaaaatcatttctctcaccttatcctcacacccacttccttttcccctcacgccagtgccccggccgcctgggcggagcctgatctcctcccccgggcagcgcctctcctcccctttctcgggtgacgcccccgagcggggcctctcctccccactgccagtccccactccccacatcgtcggcggcggaggaccccgaggcaagtctcggcgacgacgtccatggagtggcctcacgcggccccgcggatcaagcctagcgtggcgggtgagctcccagcggcgcggatcgaggtcaacctcaccggcggacgcggccgactcccccaaccgtcggtggtcctcgcggagccgggcggagtgacaactcgccgaatttcccctctttctctctctgagttcgccgatgccaaatcgatcttcaccgccgccgtcgctttccccctattgagccggcgagcttctccggcgaggacggcgtccggtcgtcctcctccccgcggcggcgtggagcatggggacgacgacgcatccctctcctcttctctctttctctcttcctgaaaaactgatgaggaaccgatggcaaagagctacgcagtcttggaaaagctctgctggtggaggaaatggcaccgaatattcggttcggtgtgcctaggttgaatgccacatgggagcattgtgaattaatggtctaactagcgctagctatagctagtcctcgttgactagctagctacttctacatcacttcatctgcaccttgccgttcgcatgcaggcatctttgatttgctgccagaaatcgatggaattccacgaacgcatacatgcatgcatgcatctatctatcacattctgagtttctgtctatttagtccactcagctatttcaccccccgttccaaattaaaacgaaatgttttccatgataattacaggatatataatgattaaaaaaacccttcttcgtatttctttcaaaacattctgaccatggtatacacagcgatcaacactattacagtagaactaccgtaccacacaaacaagtttggcaaaagttcgatatgaaagagaaacaactttcgcaaatccggttgccacgtctctgtccatcaccattgaagaacacctctattgttgtctgctccaacaagtgagacttgacgtaacaatgactgattgtcatgcctcattttgagcaaagactaaaaacgtactcatccaaataacacatgaaaatcagccatttatagggttagacatgcagttttttttcgtcttttctaaaaagcaatatcatttttatttaaccaaacaacatactccctccgtaaaaaaaaaccaacataatagttcagattcgttgtactaagaaacgccacatatccaatactatattgtttttttttgacagacgtagtgcaaaacaaaaaagtatagtgtgtcattgctattgcagaaacaacacaattagttaacccaacataaagcagccacgcgaaaaaaaaatcctcaaaccttacattcatcggggaaactatttttgatcctcgagggaatatcccattgttatttgcatgtcacttagatgattataaaaaaattagaaaaaattaaaaagatgtattaacatgtaatataacactccataaacatgcaagttcaaattcaacttctacatctcgtaacgaaaaacaaattaaaccataggtagttaacatatattcacaattaaatttgttttttttcattgcgagatgtataagttgaatttgaacttgcatatttgcagagtgatatatcacatgttaatacatcttgtcaaatttttttcataactatttgagtgacatgcaaacaatgagggaatccctcgagggatcaaaatccacttcccattcatcatcccgttatataactaattcccaaacatgaagaaaatatttctgaaggatctagtaatccgaagactgcccataaccagtcgaaggaagaaagacattggatagtgtcaataattgctactcgttctgtttcatattaattatgagtcgttttgattttctttctagtcaaactattttaagtttaatcaagttaataaaaaatataataatattttaatgcaaaacaaatatacggactaaattatcgttgtagtattttaagagactacaagttcttattcatgggtttgattaccatagttagacgtggacgtgtacatcgattgggctgaattaatcccattttgatgtatatcggaatatctttcatgggtatgctgcacatcaattagtagtagctatgatttcacgctctccgatttttgtccactcgatgatactgtattctttccatacaatattaatcaagtggtactgtattctttccatataatacattatattttaccaatcgcttcgtcgtgcattactgatcatcgtcgtcgatcggatcaagttttattcatcgatatggtgtaaacatatactccatcagtgattatttatcactgtgtggaagctaggtaggcgaagcttaggagccgaagggcctctggctgtagcaatccaagttggcgtcgtagctgacgccgaggatgtcgcagtagcgcttgtagaagccgatccggtcggcgacgcgatcgtcctcgccatggccgcactccagcccgccgttgatgatgttggtgatgacgccgtagcccggcacgcggcccgccgcctggtcgtcggcggagggcgtccactggccggtggcgaccgcgtggcacgacggcttgggcgactgcggcgtcatccagaaccagaaggccgtgtcgaaggagacggtggcgtcggacgccacgaggtccgggtcgccgagcaggtcggcgccgatggcctgccccgccggcccgtagttgaagttgtaggagagctggatgggaccccggccgtagtacttcttgccggcggcgcacggccactgcgcgctctgctggcagtagtccggcccggcggcgccgccgttctcctccttgaagcagtagccccacgcgtaggggccgtcgggcgccgtcgcccaccccccggtggtctcgtgggacgtctgcgcaaggaacgcggcgacctcgcgcttgttggtgtcggcgtcaccgcccgcggcggcgaagcccgggaaggcgctggcggcggcgacgaaggcgtcgtaggtgtagaagttgctggccgggcacgccgcatcgttgcggtggagcagcatctggtcgaagagcgagcgcgacacgatggacgcgacgccgctgccaccgctgccggacggcggggtcgggccgccgccgccgcagccggcggcggagcactggctctggcatccggcgccgcagtagtcggaggtggagccgcaccagccgaactggctgcagcagaggcagttggggcacaccgcgccgccggcctggctgccgcactgctcggcatgcacggccgccgcgaggaaggccgtggccaccatggccaccacagcgagcgctctcatggtgtgttgggtaaatataagatcgctgagttgctgtatacagattgactgattgagggaaagtttgtgaggaagaagcgatgggagcgcatggctttatatagagcgcgcgggaagtgggcgtagtattggcatcttggtatttttcaacaacaaattgcattgccaatttgccacgattaacagacatcactatatcatgcatatgcatgcatcccttactaactgtgattattggaaagtcattttgcctagggatgcgctacttatttagaggggaaaaggggttccatagtagcactattgtgcatccaactagtagtcatatagtacatctttgcatttcatatagtcattgcattaatggaaatcgctagggttgacaatgaattgagtcgagcacggacagagcaggaacatatctggctcaccgctcatcacacaagtatacttgattgtgttttgagttcatcacacaaagtaggctcgatctcaaattgccctttggttgaatcatgaaaggaggagtttttttttgtttttttttgggaggttcgttgcttccctgctagaggagattcgttctccgacaagtcgtttcatgccttttaaggtgttcaataacaaaaaccacaaactctaaatattactctctccctcaaaaaaaaaaagccaaccttggggacggagggagtatgtagcaaattttttaaaaatatattaaaccagcgtacgtaaatatcaggcgcacggtaatatacccataccacgggtaggattgacgtcccaatctggtggacattggacatgttggccaaatacttgcatatatgcctccatggttccatctcctatcatgacgactgcataaatgatctttgcgaacgggtggacggcccacctaacactaggtgtatgtaaaaaacatacatgtacccatgtgtaaaaagtgatttttgcagcaaaaaaaatagaaaccctagcttcgatctaccatcgtcgtcaccgctgaggccccgctactcccaaggtcggtggtggtggatctgtcgctgtgtggtggcttgccaccgccggagttctgccaccgtgccccaccactcctgaggccgccaccgctaccatgtcctctcaagggtgccgtcactagagccaattgcagcgtgtcccgacgaaatcgccgccgctgctcccatgctaataatgtggcgccattgtcacttccgtgcacatgcgaggcctctggcccctcgtcactggtggtgccatcgccagctgcgctcccactgagcagggggtgagagagaggaatgggaggtgatgagggatgcgagactatagatggaaagcaaagaacatggagagagagatagggtttatctaggaggattaaaaaattataggggaagtattgtgaccggtcatgctatccaccgattttcgtagacaagtctcttaacaagtccgtctgtgtaaataggtcgatttttgcaagtaggcttgttaagaggtctatcttaaaaaaacaattttcacaagtttgccctctatcagatattccaagctttttacatacgggatcagatattcccaacctttttacatacgggtttctttggtccgtttgaacaaaattaaaggagttgtccgtaaaaatcattttttatagtaaggtgaaccatggataagtcactggacgtggtaacatttgacgaatgatcgatcatccacgatcgaacttagagcaggtacaataacagattataagccagctataaacatattttaaagagataaaagaaaagaggaaagagtagcacactacacatttgtagccagttgtaacacggactccaagacgtaatgtgtgtatgacaggtgagatcagatattaataatataataaacaactattagatgaattggctattaaattagctataaataatttgaagctggcagttaactatactattaaacttttgctcttagcagccggtcgtatgccgagctagctacaaaccaacaaaacggctgccactacaaaccaacaagcaggctggcacatgcatgcacatatatatgcattgtctcgtgagagcaggtatagtaacagactattaaccaactacaaatatattttaataagataaaagataaaagagaaaagtagcgggctatagatctatagccagttacaacacggactataagacgtaatatgtgtatgacaggtgggaccatatattattagtatagtaagcaactattgtatgaattgactattagattggcaataaatgaattggagttagtagtgaactatactattaaacttgctctgatgcgtgtggggatgtatacgacagatagctacgtacggggcatgtatacgaacagtacattctcttggaagttggaacatacttactccctccgtcccaaaaaagataaacctgggtttccgtatccaacatttgattatccgtcttatatgaatttttttataattagtattttcattgttgttaggtggtaaaacatgattaatactttatatgtgacttgtctttttgatttttttaaataagacggatggtcaaacgttggacacggaaactcagagtttgttttttttttgggacggagggagtaggctcagttcgctagaataagttcccatccggaacagtgatcacggaaaacataacggtacaatagcacgtgattaattaaatatttgctattttttttcaaaaatagattaatttgatttttaagcaattttcgtatagaaacattttttttttgcaaaaaacacactgtttagcagtttgaaaagtgtgcacgtggaaaacgagagagaggggttgggaaaagggcatccaaacacagctttaggatgcgtttagttctttgggtgtaaagtttttgaagtatacagacgcacacttaaagtattaaacgtagactaataacaaaacaaattacagattccgcctgtaaactgtgagacgaatttattaagcctaattaatccgttattagtaaatatttactgtagcatcacattgtcaaatcatggcacaactaggttcaaaagatttgtctcgcaatttacatgcaaactgtgcaattgtttttttccacatttaatgccccatacatgtgaccaaacatttgatatgatgtttttggctaaattttttttgatctaaacaatgccttatcttttttccttgtgcaatccatcaatcaaagtgttgtacgcaaggagctgtaacaaatatagctgctgttgtaaaaacgctgatatgtctctttttcacttttttttttgactgaaaaaggtagagagactctaccttataactattgtattaatggtagtcaaggtgttacataaagagttacaaaaggctctttttcacttgaaaaatgaatctatatagaacgaattaattgtacactggaacactttttttttttaatcgccgactcgccgttatagcttagcgaggctgtgtacctcctgcagcatattatgtgcttcctcgtcaggcctctgtaatgatcatcggcatagcttgctcgctaaaatcgtgagctgaggagagagaagagagatggaggaaaggtggtagaggaagaactggtctaatgtagaatattttgtatgtatgctatgtgggtctcggtctctgactcagtctggatgatcgaagtcagctcgtcacgttagctaaaatcggaagcaatactgtcttgtaactgacccggatttataagattacagatgcgttgggtttaaggatgattttacaactcagacgacaagacgagggacttggagtgaaccttttccttcctggactgcaataggcctacaaattcctaacttgaaagcccagcccaatacgcgtccgttcccccttcgcaacccaacctctctctttcttcttcttcccccatcttcgttttgccgggaccgatccgacccacttccctccccccccgtccgtcctccgatccgatccgatcccgacaccaccgcctccggtggtagatctggatcggagccaccccgccgccggcgatccccggcatcctcgccacccatcggtagcccctccgccgccgcagccgacgacgacatggacgctgcccccgccgccgccgaggcgcacgacgggcagagggagcggttcgacctcggggtgttggtcggcgacctcgccctcgacgaggatgtcgccaggtacggacggtgacgggatgccgcgccgcccgatctcgtcccgtggataacgtccgagaacgtgagcctttgcgcgctgttttgaataacatttggtttggtttttttttttcgacagtgatgaggacgagtcgctggaggggttgaggcaggagctcgacgactgcaaggacgacgaggtgctgcctgttgatccgatgcttatttatttttgttacttgtagactagtaacgagcttggcgattgagctctctttgggctacgtgcttctcaggtccctgggtgctgcattgttgtctttccgagctcacttatcaattacgagcaagaaacagtgtagccgtctgtttttctttcttgtgtgtggatcgctgattttacttttctgtgtggatgtaggaagtggcaaatatcctggctaacggcatcaaactgcgtgattacacaaaaggcgtcgagaacaacattcgccaaattgagctggattctatacaggtatttatatatgatatggtcattcacgtcaatcatccaagttaatatgcttgatctagagctgctctttttatatacatatgaatatgaactgcagtttgaatttgacgttgagtaggaatacagttacagcatggttttattttattttgaaataagattatttagcttattttgccagatggctataagactacgaatccatccaatgacttgcctattcttaccagagaaagtttacgttgatcaaataattgcacaaatgttgtggaaaaaaaaacttatgatcttcagcttctgatgcttcataaatagaaattggcagtggataaaatgtagtgttccctctttgtaggattacattggagaaagtgaaaacttggtatcgctgcatgatcagattcgtgactgtgataacattttgtcacaaatggaaactgttctgactggattccaggtaaaagcatattctcatatgttctgacaaaactatctgtggcattctcttgtgtgctggctagctgaatgagtagttatactgaacatattatcatcatgtttggaatgtgcaaactttagtattactttgtatcaattagcaattcacgtggtttctgaacttcttctcaaagaggagtctgcctactgtgagctacctgaaaattcaccaggatcatgtctctgcatttttaagctgtccttttgtcaactaaataacatgaaggcaacctccttggaagaactttctttacctgtatcacaattctatgctcaatgtttctagtttttactatgtgatccatgcgagaagttcattgacataattgaatcaaaacatttttagcttattatttactctttcttatcatttaattggatgaccaatgttccctctcaaaccaaaaaagtctttatactttttttttcctgttttctctacctaatctttcacctatagacaaaagtaactcactcttttacgatcactaagtcattctgcaattcttttgacttctgtggtagacagaaattggttctataagttcggagataaaggtccttcaggagaaatctatggacatgggattaaagttgaaaaatcgtaaggtttggttcacttcatactgtacattttatccgcatatatccaattattcctccatttcaatcttttctgatctgagtgcatactaggtccttgatttgaaatatctaggggattggtggtttagcatatattggttgcatcttggatattttatgactgttaaaatttgtaccttccaatatctcaagagtagatgccagagcatacatagtttctgtgttactacaatagttctttacatatcgacacatgaatgatcaccccattgcttgatataatgtttcagaaaatattgcatatgcgattaaggttctatcttacacttctgacaaataatcatgcatcataaattgttaccgaaggaacagccatgtgttgtatcttttttaaggaaatgtgttataactaattggacaaaccgatttgttatttagatttttgtttatcaaataatgagacaagactcaagtacaagacatggcatagaaattataaaatgagccctttttgcaacattataagggcagtcactgtcatctgaatcatcaaaagtagcttatcttggaattgtttcacagtttttatagctttttgcatgttatatatttctttcgttccatgcttaattatctttgatgatcctaatgttggttctcactcatttggaaatactgcaggctgcagagtctaaattgtcaaaatttgttgaggatataatagtgcctccaagaatgattgacataattgtcgatggagaggtgatcactatattcctttcatgttcgtttgcagctaaccttgcaactttctgatatggtaccaataccatgtgtagttatgcagcgcatgtttggttctcttgcccacccttgcgtagccttgcttctacctgatagtgaggatgcctcattttttcttgcataacattgtatttactagtaattgtggacgaggagatccttgtcaatgaaagatagccaattctgactagtcaaggtgtaataccctggccttaagtggtggcccaaatatagtcatttggtggaattaatcctacatgcggcaaagaagagagtgttagagggtgctatggataagtgggtctgctcccttcccccgacacacacataatcacagaggcacacacacaaagctagtgaaaaggggattttagacgctatggtattactattacagagtccttggcaagagatccaaacatgccattatgccaatggtttcttctcttctggctcagccgtgagaatgttcagtttaactgctttatatcctttcgtaggtgatttgtcctttttttaattattttttggtgcagctgttttttttctttgtctttgattgatatatttttttccaacagaagatttcaattgttagtttgatgtgtcatccgtcccaaggatctactttgttatcctagtcaacttgcttcttttgcagttaattctgattaatttgtttgagaactgaaaatgacctatgcatcaacactgcaggttaatgacgaatacatgaaaacacttgagactctaagcagaaaaatcaagttcattgaagttgatgcaatggttaaatcgtccaaggctctaaaggatgttcaacctgaggttgagagacttaggcagaaagcagtctcaaaggtttgaagaacaatcactagtttattacttctagtttcttatgagtgtgagcaggtctaggatttatatcatgctgaaggtgtatgtgcgtttcatctttcgtacatgcttatttttgtcaaaataattataggaaacaatctatggctttcagcatctgttttatgtgggttgaggggattatgtgtcatgcctttgtgctttctgagtttgcaaggtctggttagttcatacatgctatgtcatctcagttcaatagagataattggctcagtaatatcatagaaatgagtcaattgaaagtgcctggtatgtccaccattaactagaatgatatgctaataatttatctggtacatttgatggcaaccactttggtgttactaagaaagatgcagctatgttggctaataatttatctggtacatttgatggcaaccagtgtgtcactttaccatcaaatgtactagccatatgggtcatttaaaattaggagttgccctaatttctgctacctctgtttattgctcagatcatacttgatagcgtactccagagcaaatacaagccattgtagatttggtcatttgaagtaagaagtcacatcaatgtccctctggatttctctgaaactttatcaggctttacatatgttcgggaaggcaagattggaaaaaaaatgtctcgtttattcatgagtatgaacttgaactttaataaaacgtccctggattcatggcatcctgctgattgaatttttatatctagccaatccaattgcagaaagctactaaagagttttatggctgatgactgatgcgttcataattgttcttgcagatttttgaatttgtcatccaaaagttctatgccttgagaaaaccgaaaacaaatattcagattctacagcagagtgttcttcttaaatacaagtatgcaaaatggtcttctctgatcctgttttatccacatttagttcttgcatgagcaatgttctatggatagtcattgggatcatgggtcaatgccattttccatgctctcagattcagtctgaagtcaaagacaaacttgtgggtcatgaatctaaagggagaccgagagggatgagatggggttagcaggattcttttttatgttcttgttgtaggtgcctcatgtttctgacactcgtataatttttgtaccttgcactaaatgtgatttgtggaccaagtgcatcaaatgcaccttgtgcctacaagtctccgtatggcattgcagcggattgttatccttttatttggtgcaactgctttaggcattttggtgtctggcaaattgctttccatttaatatataataatattatgtttcaaacaacggtattattgtgttctaaaaatatggaacaacttggagagacgtgatagttggataatatattttgtctaaccttagtttgattataaaacaagtatacttgattttaatttttcgtttgatagctttacaatatgcataacgcagcacaatgcagaactgcaatctgagcctaagttcctctacatggccatgcgattaaatcttcttctctctccctctctctggggggcaatttcttgattttcgtttgggctccccattgcaggtacacgatagtttttcttaaggaacatgctaaggagatatatgcggaagttcgtgcagcttatattgataccatgaacaaggtgaatgttataataaatctcatagctatggtgtgaataggtattagattatcaatgtatgacctggatcctggtccagctttgtgtcccaatcattgccagggtaaggtttactactgcactgctgtacaaagtgtagagtagtagcaggcatgcttgagggtccaaatttagcaactatgtgttaatcctaggcaaagagttcaaaggcccaagctagctttttcacgcttgtgctgcttccccaaggtggggtttggtcattggtgacttttgggcgatggattgttacagttgcatccctgtccgtttttcttcattctgttctttttgcaattctctgtatgtactgctgtgcttgttgtggtatcaaccttactcataaaaaaataattccatatgtacatacttttgaaactttctgcataggttagggaacactactagtctgtgtgcgatgacttttgacttgtgcaatgcagtgtactagtcgataacaataacaagagcacttgcattgtgtgtcttcttagatattttggagcaaatgctttcttgacatttttaccatattaccaatttgcaggtgctgagtgcacatttccgtgcgtatattcaagcattagagaaactacaactggacatagcaacctctaccgacttacttggagttgaaactagaagtacaggattccttttctccatgggaaaagaatctctgaagacccgttcttctgtctttgctttgggtgaaaggataaacatattaaaggtatttttattcctgacactccaactgacatttagatttttttttttttgataatgtagtttgtcaagtaattcactgttagctgtaatcagtcgatcctatacttatggttgtcttcaactgcattctacttgttaagcatgacacggaggctgggagctaaactgggtcatgtgatgctataaggttccaacaagaactaatggactaacataacaagctatttagttagcggtcaaacatgccacgagacacctatcattgtaaatcatcttatagtgcataattggcacatgaccataaatataatcctagagtaaatgtggctagttgccagacacttagtcctgtcttgttcacattttgagttgtctctaacattgtaacaagacatatggacttgcccacaccatttatggtgattatacaagttcagtaacatgattgtgccatgcaacccccaagtttagggacacaaatgacatgccaacacaaatttaaggattgaggatccagttagcaccataatcaaatttgtggatacatttctctactgtaatagatccagtcaaattctatgaatgcaatgttcttgccatagttgatcagacaagaaaatcttgttgcttgttgtaccaaaaagaattattttaacatgctttgaattcttctcacagaagctattgactgtttcatgcctatatatgttcgttgcagttttggacagaatcatcacctaactttatttagattttgatcttgccattttgaactttgagtaccatattattgttgaagcagcacagtagcatcatttctgtctgtcatgtgggcttttgttggaatgtcaggaaattgatcagcctgccttgatacctcacatagctgaagccaagtctcaaaaatatccatatgaagttcttttcagaagcttgcaaaaacttttgattgatacagctacttcagagtaagcctgatttcccttgtatttttattcgtaatggcttttgaatgagtggcaacctgatagatatccactaactgcaggtaccttttctctgatgatttctttggtgaagaatcactgtttaatgacatatttgcaggtttgttttgtcctatttttgaatgtctatcttatgtggatgtagtaatctaaatggagaagcatctagtgtaaatccatcgctcagttctagcatgtgaatgaacattcatatttaccatttgatgaggtttggatggatcagatttaaagggatgtgacgggacactcataaatgatggctcaaaccgcaaggcagttattatttgtaaatagtggtccatgtggctattacatcctgtttggatctgatccacctaaaattatgaatcaacccagatggagttggcattttagaacctgaagttcaaagatgcgtagatactcccccaaaccgcttttacatcgtcctttacccgtaggaagcacaatgcgtgcaaagactaccatacatttatatgcctgtttttgctggtcatactattgagacatactttgatcaatattgttctgccacagtggcttgaataactaccatacatttagtttgtcaaggccaatcttaattcagatgttttgtggttaccctgatttaaattttgctgaaattaaaagtccagtctttgttatgaacatttctggctgagcaagtgagcataactcttctcagtcatttagaaaatgtgcaggataagatttcagagttgatagaaaataagaatatgctttgcattacactagtaaccaaagtaatatactatctgttcattttatttaactttaggaaataatccatttattttatcatgtctgacatataaatgctccatgtcatagataatccaaactgattaattgaatatatcaagtcaagccattttatactattaccactgtcatctacctgaaaatagacaatgaatatgtgttttaaatgtttaacataaacatcaaacaagtgatgtctgttacttttcccttaggacctatccaagttgttgatgaacatttcaatgctgtgctcctgaactgttatgacgcaatcggcataatgcttatgatccgaataattcatcagcatcaggtacgctttgagttacctattgaagcagcttagaaatatcaccattcatgcccttgttgactgtccttgctttgaaggaggccacatctctctctctctctctccattttaggtagaaccctttatattgttatatgtgagaaatctaagtggaattgatgttttatgcagctaatcatgtttaagcggcgaatcccatgtttggactcttacttagacaaggtgtgtgctttgtcgcatttttgttgaaattttatacttgtatcgacttttttaagggtcactatgttggatagccaatgcttcgccatgaatctttcttttgtttcaaattcatcaagtccatttgtgcacattgcacacttgcacaggttaacttatcactctggcctcgcttcaagatggtgtttgatttgcatttgaacagcttacgaaatgcaaatgttaagactctttgggaggatgatgttcatcctcactatgtcatgaggagatatgctgaatttacagcatccctcgtgcatctcaatgttgaatatggagatggtcaggttagtttatcaaattcaactcaacccgatttctgaaaagaattattgattcccattccatgcgataagcaacccctttatatggcttatgggaattgtataatgttatttatatctgcagcttgatcttaatctcgagcggttgcggatggctgttgaggaattgcttgttaagttggctaagatgttccctaaacaaaagttgcaaactgttttcctgataaacaactatgatttaacgatttccatactgaaggtaggcggtgaaagttcaagcttcattaagttgtactgtggtgcaatctactagtatcatcttattaaatttgttctgagctgtcatacaggaagctggcactgagggtggaaaagcacaagttcactttgaggaggttcttaagagcaatatttcagtatatgtggtatgcaatgtgccctctgagatagaaataatggaatataatttctgcgtgggcacatttcattggttttactgtgttagggggtacctgtttgcatctgtttaggggctatttggttgcatcctaacttgccagggcaccaaaccgtgatgtgttgtgtgaccacttgccgtttgtcctagtctatttattttagtacgacctctgtattttccatttgattctagaatttttacatgtccagagaaaatagtgggaggcctactgtcagtttagtatttcttttcttaggattacgaagccaatcagaggctagtcccattgatttttaatactggcaacagatgtccattttttctcctttcgtttgaactttattgacaatatttgtaaagagggagctgtgtggatagttaaaattttctaggggtaagctgatataatgaacaaatatttatgcaggaggaacttctactggagcatttcagtgatttgatcaaatttgtgaaatctcgcccgtgtaagttgatccctgttacaacatcaagctggttcctttttttgcaacggcatctcatctttatgtgtgtgttttaccagctgaagacacagcatcaagctcggacaaggccagtgttagtgatgtcgagccattagtcaaggattttgccggtcggtggaaagctgcaattgagcttatgcacaaggatgtcattacatcttttagcaacttcctctgcggaatggagatcctgaaagcggcactcacgcagctgctgctgtactatacaaggatcaccgagtgtgtcaagaagatcaatggtggctctgctctcaacaaggacctggtttccatatcctctatcttatatgagatcaagaaatactccaggaccttttagtcagtactggtcctgccatgtacactggtgtattattctcatgtaacgaaaatcctgatatatgctatgcaggttggttgggtttgacacggaactctgtttctcttgctatttggcagatgttaagaaattacacgggggtgtatctaaaatagtttttcgattgagagtaatggctgtttgtggtagatcgttgagctgattagcgattagctgcctatcagtcagccattcagatgttctttaattgtagtcatagccattcagatgttctttaattgtctggcggtgtttgggaccgtagaaacttatccccgcctgtggataagtgaatagaaacacataaattttgccatctatcaacaaatcgaaagaattaacatttctgtgactgtatccactcgcctcttgccaaagcgcccacatgtattatactccctccgttttacaatgtaagtcattctatcattttccatattcatattgatgttaatgaatgtaacattaaaaaaaacctgcacagcacatgaaggcgtccacagcgccacttgactgtcaaatataggcctaatctaattcttatcccttaaccgcaataacggatatcatgattcttgaaatattaaatctgatgtactttgactcctataacagtattgataatgatattcgctgacgtggcgctcacatggcatcctagtcatcaaaaaattaaaaatgaagtgggcccacatatcatcctccacctctatattcttccttctccaccgcaaatccccaatctctctaccccaactcctctcgacggcatcaataggttgggcgtcatccctgtcatgtcagcaatggaatcccggatgctggtgaggaagtagctctccacatccgcagcacgatgtctacgcctgagacggagatgacggggtggaagatgtcagaggagatggcgaggaaagttgccgggcatggggaggcatcatcgtcgttgtcggtgggctgcccacactcctcgaacatgtaggcgctgttataataaatgggctaggcccgatttattctattaaatctcaaaggcccataataaatgttaaggataataataccaccttgggaattaaacgaggagtatctcaacttaaatagggagttattggaggctccctgttgatcggttgaggtggggatcggaaagccacacgcgcgcgcgcgtcgggccgaggcgtgcgttgcgatgcacctatctctatccttttgcaacggaccaatcccaagattgcctctgtaacgggcaggcgattcaattccaagagattccctccgtaacgggcatgtgattcaattccaattgatctcgcgtcgttactgcggcaacgggcggatatcgctcctgcgctataaggaaaagtaacaggcatgtgattcaattccaattgatctcgcgtcgttactgtggcaacgggcggatatcgctcctgcgctataaggaaagagctaatccgatcagattccgctgcttactttccatctggtgttcttcctcctcctcctcgcgcgcgcattccgctgcttactttccatctggtgttcttcctcctcctcgcgcgcgcctggtgctgctactgttctgcttccccgcttctgatcgcttgcgcgcacgagagattggaacgagtagggccttcggaaccacacctttgcttgagatctgcatcgggtaggcgggtgatcaggtttttggggagtgcttccgcacgactgctcctcgtcttttgttcgtcgccgtcgtctgctacataatgtcttccgccgccgctgctactgccgcacctagagatggcacgccgggagccagagccgctgcgaacgacaacatcaacggaggcagttctgccacacaatccagcggagggacattcacagggtataaccttcgcttactgttatttcatttttttcatatctatgttagtcgcaattctattgcgttctttgtatgatgatgatgcttattatatcttaagcatgctcctggttatgttagattttatcactagatcaccccatattgttcatgccatgattattgtcttaatattttagattaaaatatgccgaaatatgactatatttctaacaatccaaaaacctgataggtcattttcggtagttggctttgctgctgcactgaaaccacatgcatttgatggttctaattataagaggtggaaaacacgtgcactaatgtggttgacagtgatgcaatgcttctatgtttcacggtgatgaggacacaactagctcggatataaccatgactaccttatgtattaatcaactaaaggtgcatatgttctacattagatttatttgttatatatttgaacaacgttgctgcacaatgagtttcgtgtgtttttgtttacagaggtatttgcttaggcgaaagaaaagagattgagcgtaaggaatgcatggatgattgaagaagttgattggggaccaaaccaagaccttttccaagtcttccttcatctcaccacgtcacttttggtccatagaagacaagagataaagttctacacgttttggattcggattcgggcctcctaacagcatcaacttcaaatggacctagccgctgatctagaaggtattttggggcttatgagtacttgttggaaagcttatggagtctaccttcatatggttttggtcccacgttaaaattcctaccgagctgccgggaatctgcaaaacaagccacgtatctcatccagtccgaatctgatttgggttttgggccttgtaattgtgtcgtgggcttagcccaagggggtgtgcgccctagggcaaccctaggacgtccctaatcacatttatttagtagccgtcatcgtttagagttgggttttgattagattattctgtcaagaacagtttcacccctagatcggtttgtggaaccccaaattcgagtgcataatcattcatatgcaatttggttgcaatctatcttgttcttgcttgtgttcttcgattcgcatgcagggattagccttcttggtgaggtcaaccgggtttcggcatggttgataaccagaggagacgtggtgctgcaattgcggggctcagtagcttgttcgttcagaagctggattgagttgtgtcgcgattccgctcaaatcaattgtttatctatacctatcgaaagatcgggacctaactccctcataagttggtatcagagcgcggttgcccgttaggtaatttatcttcccataaccagaaaattgccacacaaaaaatttattctttacctagacaatttgagccgttgcattgttctattagattttgctttgttgaattctaggttgcatcgtcatgtcgagtgctggtttagttttagatttaatttttagttttgagtattgcatctgttcatcacttaggtctagggctcatcactcaagtgtgtgagttgtacgtcagttttgggtccagtttttcatctcgtcagttgttgctgggaccttgaaaaattgaatcgtcttgtcgtcgggtttccgtttttgtgatttagagaaatttttatcaaacggttttggagttgccgtactttgcgcgtgtactgtgcgcatgaggggagtactgtgtgcgcgtgaggagagactccgtatcagatcagatctatccgtgactgtccgtatttccctctttatagatctgttaagtagtggatttgagatatttttataaaagtggaacctacatgatatgagcaatccatttttgagatgatccaattttagttttgcactttgcgtttgagtccctgtaatattcagatttatatttgagtccctgttcgaggtcagtggtcagtttttgttgacaaaaaagttaaaaaaagaataaagaaagaaagaaaaggcggaaaggtgcaaagaaaaaaaaaagaaaaaaaaagctgcacctaaaaaaaagaaaaaaaaggcagaaatgtgcttaaaaaaagccccactaagaaagaaaaaaaatcattcatcctttgagtatgttatcagagtgcagagttgtgcattgattcatatctagtctttaggggtgtcgggtgtttgcttgagctagagttgagtctaggctaggccagcacattgactagtactttgaactattattcaactttgcattttctgattagcataattgcgttcttttgctactatatattgtgcctcccaagctacacatatatacttctggtcagcaccgctttgatccttgcaatcgccacttcacgtccttcaaggtgtcacgaactagccaccggttgtaccatccttagcattgctggtaagacacttgtaagagcttggtaaggtgctccatttggctgagttgttgaggagcaccactacaccgcatagcagattattagggataaccttcattgtttgttgttgttttttgtgtttgcaatgacatgtatgagtgacgctcaaaatcagcgataccaacaaggtgcacatgatgaaagtacatgggtgcaacaagtgctaagttctcaaatggacaaagcggagcaatggcagtaccacgaattatttgaaacaaagtttgtggttaaggatagagcatgtcgtactataatcgatagtgagagttgcaataactttgtgagttcagatttggttgagaaacttgagttgcctacacaaccgcatcatcatccatattagatcaaatggttcaacttttgtggtaagttcaaggtaaatagaattgtgagaataaacttttcgattggaaattaccatgatactggcaattttgatcttgtccctatgcaagcatgttctttgttgtttggtcaaccataggtatatgataataatggatcgcataattttgttgctaacacatgcacatttagacataatggttggaaaatgaaattggtacccatgagttttactgaaattttcgaaaataatattcaaaggatgaagaatggaatcgatgagattttcagagataccaagaaagatgctattgtgatgtcttcaactaagtctgaattacaaaacgaacgtatttttgtgcctattgttttggacactaatattttgcaggcatctgagaataaccaaggtaatgagaaagagaagaaatacgaagtggaaaaagatctatctatagctccatgcatgctggaagaatgttccattgaccaagcacctataatttctaaagaggagaaaagagatactgataatggtgttataactactcagggtatgcatagttatgatgtgccaactatgtccactacttatgctatgttagagcaacccatagtggaaacaattgttgaaatacctttgtcacaaaacaatttgcttgatgtttcttgtgataaagagttgtgcgatgcttcacttatatccatgccacaactaatgaatggacatgttaattctatttttgagatatttttataaaaatggaagattggagcattccatttttgagatgatctaattttagttttgcattttacatttgagtccatgtaatattgatatttacatttgagtccctgttcaaagtcagtggtaagttcttgttgaaaaaaaagtaaaaaaataaataaagaaagaaaaggcaaaaaggtgcaaagaaaaaaaagaaagaaaaagccgcaccaaaaaaaaaagaaaaaaaaggcaaaaatgtgcttaaaaaaagccgcaccaagaaagaaaaaaaatcattcattctctgagtatgttttgagagtgcaaagttgtacattgattcatatctagtccttagtgttgtcgggtgcttacttgagctagagttgagtctaggctaggctagcacattgactagtactttgaactattattcaactttgcattttcttattagtacaattgcgttcctttgctactatatattgtgcctcccaagctccacatatatacttctggtcagcaccactttgatccttgcaatcgtcacatcacatgcttcaaggtgtcacgaaccagccaccagttgtaccgtccttagcattgctggtaagacacttataagagcttggtaaggtgctccatttacctgagttgttgagaggcaccactacaccgcgtagcagattattagggataaccttcactatttgttgctgtttttgtgcttgctatgacaggtatgggtggcgctcaaaatcagcgataccaacaaggtaacaataatcgcgtgcccgatgatccttatgctaaggttaagtttaaaataccatctttttcgggttattatgatgctgagaaatactctgattgggagatgatagtagagcaaaagtttagtgcccaccttgtgcctgaccaacatagagttcgacaagccagtagtgagttcaaagattttgctatcatgtggtgggctaggttagctgatgatggaattttacctactacttggaaagaacttaaggtagctatgcgtgatatatttgttcctccatcttatcttagagatttaagcaagaaactgatgcgtttagagcaaagggataaatctgtacaggattactatggtgagctacaaaagggattgatgcgatgtagcatagtgaagggaactgaggattccatttgtcgcttttacatgggattgaggcgcaagattcaggacatagtagataataaggaatttaacactgtcaaccagttgtttcagtttgctatgcttgcagtgaaggaattgcaggggcgtgatcaacaggtcaagaataaggcgagcacatacataccgcgagcaaagccatctttggggcttcccaagcccatctctttctggacgaccccactagcgagcaagcgaccagttgcgtccggagtttctgcagcgccaaaaccaccttccccacgacctgcagtttcaggtaaaggttcttcgcaggtatccaccaagagtgcctcatctatcgcttcgacgggacgcacgtccagaattcggtgccaccactgccatggatttggccatgtgcagaagatttgccctagtcaacgggcatacgttgctacggtagattgctacatctgcacctccgacgttgaagatgttgaggtggaagagaagaaagacggagagcaaaaagacttatccatagctccatgcatgcttgaggaatgtctaattgaccaagcgcctataatttctgaagatgagaaaaaaggtaatgataatggtgctacaactaatcaaggtatgcatatttatgatgtgccaactatgtccactacttgtgctacattagagtaacccatagtggaaacaattgttagaatacctttgtcacaaaataatttgctttatgtttcttgttataaagaagagttgtgcgatgtttcacttatatccatgccataactagtgaatgaacatgttagttgtacagtaagccactatgtgttgagtttaagcatgttattcacattgctagcaagaatgaagagcttaaattgctatcttctttaaatacttggggttatattcaatttgatgatctttgtccactcaactgtttagagaagaaattatttgctaggtttgaattgccatacccttctgatgtgatttttcatattattggcaattatgataataaaggagaatataatgtgcatcgagtatatatttgttcgaatttgactatacctctttttcatgatgaaatatattgtctagaggaccgcatgcatataagtaattctctatctagttcctctagttagttaaatgacttacaggttggtttggaagaaggggagtgttgtggtttttcgactacaaagattttaggatccaatcatatggccatcaagaaatgttccgcacaggatgttgtgatagacaaagataagtacaatacgctccatgaaaaggtgataccgaggacggtttctaatcaagaaggggaggatgatgaggacataactagctcggatataaccatgactaccttatgtattaatcaaataaatatgcatatgttctacattagatttacatgttatatatttgaacaaacgttgctacacaatgaattttgtgtgttttcgtttgcagaggtacttgcttgggcgaaggaaaagagaccgagcgtaactaatgcatggatgattaaagaagttgattggggaccaaaccaagaccttctccaagtccacttctacctcaccacgtcacttttggcccatagaagacaagagatcaaattgtatacgttttggattcggatttaggcctcctgacagcgtcaacttcaaacggacctagccgctgatctagaaggaattttggggctcatgagtacttgttggaaagcttatggagtctactttcatatggttttggtcccacgttgaaattcctaccgagctgccgggaatatgcaaaacaagtcacgtatctcatccagtccgaatctgatttgggttttgggccttgtaattgtgtcgtgggcttagcccaagggggtgtgtgccctagggcaaccctcggacatccctaatcacatttattcagtagcagtcatcgtttagagttgggtttttcttaggccctgtttgtttaggcttataagtcaacttataagtcgaaaagtctaagccaaaacaaacaagcagctttttcatttggcttttttgaagccataagccactctaacactattaagccaaaagctaggttggagaagcttttttggcttatatgagatagatgtatgactccaccactaaacttaggacattaaattcactggcttataaatcatataagccaataagctgacttaaaagtctagacaaataagcccaagcctaaacaaagagggccttagattattctgtcaagaacagtttcgccgctagatcggtttgtggaaccccaaattcgtgtgcttaatcattcatatgcaatttggttgcaatctatcttgttcttgcttgtgttcttcgattcgcatgcagggattagccttctcgacgaggtcaacctggtttcggcacggttgataaccagaggagacgtggtgctgcgattgcggggctcagtagcgtgttcgttcagaagccagatcgagttgtgtcgcgactccgcccaaatcgattgtttatcaatacctattggaagatcgggacctaacatcctcatcatacggggtaaacgaagtgaaccacctctctctcctgaggaagaggttaagtttgaggcttcggattgcctgttccgtggagcattgatcagtgtactcgctgacaacatagtggacgtgtatatgcagatgccttcaaggaaggacatgtgggatgcacttgaggccaagttcggagtttccgacgctggtagtgagctgtatgccatggagcagttctatgactacaagatggtcgatgaccgttctatagtagaacaagctcatgagattcagatgctggctaaggaacttgagaacaacaactgtgagttgccggacaagtttgtggcggatggcattattgccaaattgctaccttcttggtcggactttgccacttctctaaagcacaagagacaagagttcagtgtttctgatctcattggctctttgggtgttgaagagaaggcgagggcaaaggacaaccggggcaaaaaggttgagggaggttctagtgccaatatgttacagaagaagaaccctcatgcatcccacaacaacaagaaagtcaaggctgatgtgaaacccaaggctacaaccaattttaagaagaaaggcaagggaaaggcaaagggagactgctttgtgtgtggcaagtctgggcattgggccaaggactgtcctgagcgcaaagacaggaagtctgccaacatggtcattagtgagggcagaggaacatcggggtacggtaaattattacctacagttctctctgtttttcattcacctgattggtgggttgatactggtgctaatattcatgtatgtgctgatatttccctgttttcttcttatcaggtagggagaggtttctccttgttgatgggaaatgggtcacttgtggctgttcacggtgttggtacggtcgatctgaagtttacttcgggaaagaccgtgcagctgaagaacgtgcaacatgtctcttcaataaagaagaatctagttagcggttctctactgtgtagagaaggttttagacttgtgtttgaatccaataaatgtgtcgtatctaaatatgaaacttttattggaaaaggctatgacagcggaggcttgttccgcttttctttggatgacgtgtgtaataataataatgttgtgatccatattagcaagaatgatgagtccaatgtgtggcattcgcgactctgtcatgtgaatttcggttgtatgacacgcttggctaacatgagtttaattccaaaattcactttagtcaaaggttctaagtgccatacttgtgttcaatcgaaacaacttcgcgagcctcacaaggcatctgaggcgagggattttgcacctctagaacttgttcattccgatttgtgcgaaatgaacggcgtgttgactaaagggggaaagaaatatttcatgacactgttagatgattgcacttaattttgttatgtgtatctattgaaaacataggatgaagcattgcgttacttttaagacctataaagctgaggtagaaaaccaacttgaaaggaaaatcaaacggttgaggtctgatagaggtggggagtatttttccaatgagtttacatccttttgcgaagagtttggaattattcatgagatgacgcctccctattcaccccaatcaaatggggtggccgaaagaaagaaccgtactctaactgagatggtgaatgccatgttagacactgcagggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatgggggtgtttggccaaggtaaatgtacctatagccaaaaagcataaacttggaccgaatactgttgattgtgtgttccttggttatgctattcacagtgtgggttatagattcttaatagtaaactatggagtacccgacatgcgtgttggtacaattattgagtccagagatgctacattctttgacaatgaatttgccatgaaaaatacacctagcacttctagtcaagaaactgtcataccccataagcactttgcaccgatagaacacaatgatcaaacgcctgagggaaatcctgaggaggacaacattgtagatactcgtaagagtaagcgacaaagggttgcaaaatcctttggagatgacaacattgtatacctcgtggatggcactccaagaaccatagaagaggcatattcatctcctgacgctgaccactggaaggaagcagtacgcagtgagatggactcgattatgtctaatggtacttgggaagtcgttgagcgtccatatgggtgcaagcctgtaggatgcaaatgggttttcaagaaaaagcttaggcctgatggtacaattgaaaagtacaaggcaaggcttgtggccaaaggttatacccaaaaggaaggcgaggattttttcgacacatactcaccagttgcccgcttgaccacgattcgagtactacttgctctggcagcctctcatggtcttctcgtccatcagatggatgttaagacagctttcctaaacggagagctggaggaggagatctatatggatcaaccagacgggtatgtactagaaggtcaggagagaatggtgtgtaaactgttgaaatccttgtatggccttaagcaagcacctaagcaatggcatgagaagtttgacaccacacttacatctgttggctttgttgtgaacgaagttgacaaatgtgtgtactatcgctatggtgggggagaaggagtgatcttgtgcttatatgtcgatgacatattgatctttgggactagcctcaatgtgattgaggaggtcaagtattttctgtccaagagttttgaaatgaatgatttgggagaggttgatgttatttttaacattaagctactaagaggagatgagggtgggattacacttgtgcaatcccaccaagtggacaagattttgagtcgctttggatatagtgtctacaagccagctcctactccttatgatcccagcgtgctattaaggaaaaaccgaagaatagcaagggatcaactgagatactctcaaatcattggttcattgatgtacttggctagtgcaacgaggcctgacatctcatttgttgtaagcaagctgagccggtttgtctcgaatccgggagatgatcattggcatgctctggaaagagtaatgtgctatcaaaagggcactatgggctatggaattcactataccgggtactcaaaagtactagaagggtatagtgactcaaacttgatatctgatgctgatgagataaaagccacaagtggatatgtgttcacacttggaggtggcgctgtttcctagaagtcttacaagcagaccatcttaacgaggtcaacaatggaagcagaacttacaacactagatactgcgacagttgaggccgagtggcttcgtgaactcctgatggatttgccggtgggtgaaaaaccagtgccagctatcctaatgaactgtgataatcaaacagtgattattaaagtgaacagttcaaaggacaatatgaagtcatctaggcatatcaagagaagactgaaatatgtcagaaagcagaaaaactccggagtgatagcattggattatgtccaaacggctaaaaatctggcagataagtttaccaaggggctaccacgtaatgtgatagtcagtgcatcaagggaaatgggcttgatacccacctaaggttgcacaatagtggaaacctgtccattgtgatcggagatcccgtgaatttggatggcgaaacaaactattgtgtggcttagagaagagacccttgaaaagggctaattttcatgttgtacttctcttctttcctgcatggtaggatggcttatgccttaatgtgatccgagtggcttttctaagcagagatgttgatctgcagaacatctcagaaggaacacacctatatgagttcgactgctagtcacaatctatgagatttgggcgatctctagatactcatgaaagggcctggagtttgacttatatgctccaaacagaggggatgcgaacggcagcccagtaccagtcaagggtttgagtgaaacttgatcacacatgactgacaattcaaggcatagttcattgtttagttgtggtctgatgtagctcatttcctaggtggaagttcaacttaacagtctccactaaaacactggtatatcaaaaaggcacaactttgagaacatttcttatgagccatgaaatttggtggggattgttggaataaataggctaggcccgatttattctattaaatgtcaaagtcccataataaatgttaaggacaataataccaccttgggaattaaacgaggagtatctcaacttaaatagggagttattggaggctccctgttgaccggttgaggtggggatcagaaagccacacgcacgcgcgcgcggagccgagccgaccggccaggccgggccgaggccgtgggcatgggcgtggcgtcttttgcaacggaccaatcccgagattgcctccgtaacgggcaggcgattcaattccaattgatctcgcgtcgttactgcggcaacaggcggatatcgctcctgcgctataaggaaagagctaatccgatcagattccgctgcttactttccatctggtgttcttcctcctcctcctcgcgcgcgcctggtgctgctactgttctgcttccccacttctgatcgcttgcgtgcacgagagatcggaacaagcagggcctccggaaccacaccttcgcccgagatctgcaccgggtaggcgagtgatcaggtttttggggagtgcttccgcacgactgctcctcgtcttctgttcgtcgtcgtcgtcgtctgctacaccatgtcttccgccgccgctgctgctcccgcacctggagatggcgcgccgggagccggagcctctgcgaacgacaacatcaacggaggcagttttgcttcacaatccagcggagggacattcacagggtataaccttcgcttactgttatttcatttttttcatatctctgttagtcgcaattctattgcgttctttgtatgatgatgatgcttattatatcttaagtatgctcctggttatgttagattttatcactaaatcaccccacattgttcatgccatgattattgtcttaatattttggattaaaatatgccgatatatgactatatttccaacaggcacaccacctccatcacatccctaccgattcactcgccactgtgatctcccctgtccactccgagtcgctcgccgtgacgaagggctcgagctccagatgacgccctcgatctagcatgcgagaagcaacaacaccagaagcagccggggtggagcaggtggcagtggcactgtggtgggcaaacagggagctagcgagcaccaacttctcccttgatctcactacggcaagagctttagctatgaggaggacggcaccctcccggcagtgcacggggctggtgtagcgaggccttggagtagcgtagaacgagaagaggggtgtcagggtttggcttctgcttctccacggctgatcaggggccctttgcttccccacgactagatatcccacgctattctcagtgctaattgagctggcggtgacgagcccgacgcacaacgcgttcaacgctactcaaggttgagagctcatgctgcgtgtcatcatgtgggccccatagtttttttcccttatcacttgtgagccctactaaatttgtgatagggttgccatgtgagcacaggcggaccaagtcaacgttccatatcagcgaaatccgctcacaaaaccgttgagatttaaattacaccgttttttatatttgttgagtcaagatatccgatattgcagttgagggatacgaatcaaattggacatatatttgagggactcatagtgggcttattcccagcatacatgggtattaaaggaatgggtcgattgtgtcagatctcaccgccccggcccaactaacaattggacgtatatggtatgcggactccgacaggtcacgtatacggtacgccgtatcccgtatgtggtataaatatactttacaccgtacccgtgtccctccttcacgcatctaataatctaaagctggctctttttgctagctttcgattggtccacgtggcgtctcttgctttgaagaaaaatcataaatttatactagagaaaaaacagctaacaatcatatgtgaggaaaaatctagataaaaatatcacatatggattccagaggcttgcaaaactatcttctatttccaatcacacgaacttctactcctttgccttctataaatataccacgcctactcggtactactcctataactctagaatatatatatatatatatatatatatatatatatatatatatatatatattaaacccaaaattatgaaggacaaaacaaatctaaaacaacaaatttacattcattctccttctttaattatactacgcatactcgttactactcctataactcctataactctagaatataaagtaacccgaaattattatgcaaaaaaaaaaattcacaacaaacaaagaaagaaggtcaaaacaaacaaagaaagaaggttaaccttgctttcttatatcacggaatatgatcattaatacctccacaacaaaaaaatgattgtattttgttgttacacaacatatgttaaaaaaactctgaatatactaaatgattgatctttcaaatattcaaatccacaagcaaatatatttgaaccaattaattttgatgaatcttaaaatttacttttttttggatttcatcaaaatttatgcataaaatgacatattaaattttgtacttttgcttgacatggcatacaagttctttatttttttataataaatatatttttcactactatacataataactaaattatttatacatacatacataattttttttaatatcatatatgtccatttgtgaaaactaaaatagtggttcacaatttttttaaaaatattttatgaaaactctaaaatttgaaataagaaaagaagtatatgcatattttaaattaatgagcacactaattttttcatatagtatttttgagtgataagtatatataggctatctagcaaacatgcgaatggcacgccgattattttcagtctttgctaaaccctaacctctttctcccgcgctttcgagttttctgaaaccctagtttccccgttgtcgtactcgctccgaaaccctagtttctcctactgccgtactcgctgagatttggccgttcatcggagcattttggagtttgaggaccagtctccatgaagggccgttgtgcgaccgcaggtggtggagcaccatccagcacgagctggattgaggattgaggagaagctccgcaccaccgatgagtgggccccctacactgccgtcgccgggaagaggttttcagcgattttccagcccactggatcccgaagcaggtgagatcgttgggatcagaagcgggcgaggtcaggagatggaggaagaggaggaggatccttcctccatcttcatcgaggagggtcgccgccggagatcgatgaagaggaggagaatccttcctccttcgcacgatctgtcgtgattcaaccccactggatccatctgagctccatataccatatgaccttattctatcgcatagtctattccagatattttttataattttcttttaattttattatgccgcatattatatttcagtattttgagtaaattgcaccaacggtgcttaaacttgtaagcaagtttcacctatctccataaacttgcaaagtgcatatcgagatccctaaacttattttattatatcatcccggtccaaatcctcgtttgaccatagtcttgtctacttggcatgctactttgaagatgacatggcaaaatttcccatttcccttttcaccctcccttcttttctcttcttcctccacgagtgcatgtcgacgtccctaaacttgttttattgtatcatcccggtccaaatcctcgtttgaccatagtcttgcctatgtggcatgcgacttggaagatgacatggcaaaatttccccctttccattttttcccctccccttcttttctcttcttattccaccgctggatgcagcggcggcggcgatgggcaagaaacacacagagagggaggcaaagagagatggcgtcagccactagagaaaaaggcaccggtggcggagttggcccgacgatggagcggaagctcgaggccagaggtgacaatggtgaccacgagctccccgctctctcccttctctccttctctagctccacttgatggcagccaggagctccacctcctatttgtcaccgcatgcaccctaggtcgacgccgcagcctccacctcttcgttgttgttgcgtgccctcctcctcctcttcgtggatctgcaaccttcctctttactatctggccagagaaagtatgcagtggccatgtgtaagttcaaatgccttaatttagttttggtgattaatgacaaatttaattatatgagactagagtttttatgagcttttctttgactagtctcatttggatatgaaaataaaaatgatgagaggtatgtattaaacatcacatattctaacttggtctctcttgtggatccaaaatataatgtgagctcctgattgattctgatttattatgtgcatatgtgttctttcatatccatatgtatgcacatcttgaggggggagcttatgctatattttgtttattataagatctctacattgattcaaaatcatctttcatctcatctctctatattgtttatatcgggttattatccattaccaaagagagaaaagattgaaagatcttggattaaacaatttgtgtaattgttgctttggtgatagatgataaaccaatgtttatgggattaacctctcttttacataagttgtcaactaggttatttcctgataatgaaatgtggtagatatgtattcttttgtgatggaccttaatcatgataaggatgaaatgcatggagatagagcgatatgtatcacttcttatctcctactttttgataggttcatatatatcatttccatgttattgttatataagtgtgagactaatgtttacttgagtcttatcttatttagtctcctttacattgagacatggacatcatgaaggtatgtttttttgtttactttatcattgctacatgccttcttcatgtgtataggatagaccccattggttcttctttaattatacatacacttgtctctcttgtatagttatttgtatgcatatatttagggcgagcaaatcctatacatttattgcacatgttctagatccatgttcacctattatttatattgaatctttgcacttgagcttatgcacgagtatatgacacttgtggtgttaatgaatactcaacgaacatattcatatatttcatatgcaaccggttggtcatcaagtggaggatgacaaccgatttgttgggactaatgttctcctttgagatgtgcaaaggaatagttccgaccatgatgaggctaatggatgacatcatgggttgatagtcactaagccaaggacatcgccatgttgacaagaatgaagtcaagcttctgatgacaagaaaagtcttgacaaaggatggtcaagacctcggcataaacatggatcaaccaaatggtcataagtgttgatcttggctcaagcattgacaccaagttagatggcacaaggcaaaggtataatagagctaagattgttttttagtcttttcccagtcttgctgtttggtgtagactggatttgctagataggcgtcgtactatcaagaggggtctatgaagtgagtatgtggatgatcttgtgccatattagttcatatgcatgtgggtgcatttggtggtcttgtctggccaagtgtgatgagttctgtcaagtcccaaacaaagagagaagtgggtatgtcctataggtttgggtagcctaatgtggttatgtccagtggagtatcttttggagtgttagccctttatccctggaaaaagttgtatttcttggatggattgttcatgggttggttagccctttgaataatctttccatagagtccaaaaacgttagattccgaaacccgagtcaagagataacgtcgttttactaacggttggttgtgttgaaaagtgagctacggtctgaccgcagggtgttgtccgatctgaccgaggctctcatggcggtctgaccctgattttgaaggtctcgtcttgtcaatccagagccgctagagccgaggctagtcagaccgaatccctggcggtcttaccgagcctcgggtgctctaactagccggccaatgcggtcagatagttctactgctgcctgtgcatttaatgccctgtaactgctacttttctagctgttataaccatcggcggtttgaccggccaccctatgtcggtcagacctgcaggcaacataaattggggatttcgattccaacaggtaattttagtgattgggggtatatataccactccttagctgcaagggtaaggttttggcactccattgcattatcttgaatccttgcaagaactctcacacccttgtgcacttagtttatctagtgaggtgtttgagagtgagttaagccaatccaagtgcattgcttcattgttagagctagagtgacacatgatcatcttcggcaagcatcttagatttgttactcttagaggttgccacctcctagacggtttggaggagttgcccggtgacctctccgagaaggttgtggaggaggcccggtgttgattatgagtggctcggtgtttgccatctgcggagtggaggaagaacaaccatagtgatagaggcttgggagaccactccatgggccggctcccaccttgcccacccctttacgaagggggcttatggtggcttcatggtttgaggctttgagcggtgaagttggactcacctcaacagtgacgtaggaggttgacaagcttctgaacatcgggtggaaaaatcctttgtcacttgtctcctttattttgtgcaaatttacatactagagtttatttttgctattatcacccaaggcttgcaaatcacaacataggatagctactttgtgcacatagttgagactaattgattgaggttttgaattgtgcaaaaccgtattgatttacgtttccatatacaaaactcggttttagccaaaagttttaaaaccgcctattcacccccctctactcggccacggaggacggaggaggcaggcgccagtggctgcggaggacctcttccttgactttcccaaagaagaaacaggcggcaacgagagagacagtggtggcggccgagaagcagcagcagctgctggcagcggttgtggcggcaagggagaggaggcagaggcgacagcgtcaaagtgggagcaagcggtggctggaaggtgagagaggaggaagaggccaaaggagaaagagaaatgaaagaggaagaagggaaaaaaaaggaaaaataaaaatgtgccatgtcatcttcgacgtgtcatgccacgtgggcaagaccacggtcaaacgaggttttggaccgggatgacacaataaaccaagtttaggaaccttgatatacgctttacaagttcgtggacataggtaaaacctgcttataattttaatccagtatttttcttcaattatgctgcatagtctgttttatcactattttctttttattttattctgccgcacattatctttgagcaattttcttcaattatgctgcactgtctattttatcactatttccttttattttattctgccgcatattatgtttcctatgtagaataatacacttctcttcagtttttttcgcatgcccatagatcaacttaaagttgggactatgtttctatgaattaggtagctccttacattatgacatttcctgcaaaccaggtgttctatattgatgaggagggggagtctaaatggacttctatatcattaacatgtattgaaaaagggtccccaaaatgaaaaatccaattcatgttgcgctgagccaggaccagttgacgttggaacaggacatcgagaggttgtcctggcatggatctgtgccttacacaaaattgtgtacccgtaccgtaattgttgtgctaaccagtcaatttatggattaatttcgactgattagcataacagattaccatggagggcaacatcacagatttcgtgatacaccccggtcaaggccattcacacataatgtgattgttgcgcatcaatgcaaggttaacgctatgcttaactacaaaccttattgttttcatcaagaaaggctgctacttggcttgtttgattgtgggttaaagcatatcgctgtgcttaaagatagagacttgactcggattgccacaactacaccaaggcaacgtaatcgtgcactacccttgctatcatatgaacataaaccatcaattggactagtgccatcatttcaaggatcgataacatgtagccgtgcagaggtaaactcgctcctagctgaaacatattttaatattaatgagaattatatattgcctaagtcatgcactttactgttactcaggttcaccaaggaggatgaaacggagcagcaagatcagatcagtgcattacaaaacgcaccagcaaaaacggagcagttcagtgcaaaacggaccagcccagtgaaaaacgaaccaatgaaatggactttccaataaagagtaatggacaaatcattgaagaccgctcataagacaaacagacgtgcgagtcctcttgggaattcacttatggtgacttttgacctagcttatgtctagtaaattcccaagacatttcattcccaactaggagggttgttcttagtataaatatcctatatgttttatcatttggaagacttttgacaaatgagagttcacttgtgtgctaacaaattcacagagagatcctttgctcctgttatttccttgtgagattacagaaacgacattcgacgcccccctaattggtgctcctggtcccttcgaggtttttccttgattgattccaggttgtgttggttggtaacttagagtgtggttgggcgaaccctcaattcaggttgccgtaatagagacggtggttggcttcgagtacgatcgtcaggttgcactgttatcttggctgtttgcagctaagttatcttggtctctttgaggctagttatcggttcttgatcctacgccgtaaagatcgggacatcacccctacttgggtcgtatcacttagtcaaccaaatcgtcaatctgaatcgcacatgctttctttttcttgcattctctgttaattcatgccttaatttctttgttgatttgctgcaaatttttttacttctcttcaaataagctttcacctctaaaactgtagtcagttcgaaacaagaaaaatatatagacctatcttaatgactgttcatgatcaaattcagagttttggtttgccaaataggaaagcagatagatagagtaaacaatgcttaattgatataaagtgttcagcattttagatcaattaaacatagtggaaattattattctcttagtacgaattctactgcttgtaacaaatttaagaagtgtctttacaattgcttcactgatatctagacaatttgaaaacaaaaatctatgtgtctctgttaggcctggtttagttcccaaatttttttcccaaaaacatcacatcgaatctttggacacatgcatggagcattaaatatagattaaagaaaaactaattgcagaattaggggggaaatcgcgagacgaatcttttgaggctaattagtccatgattagccataagtgttacagtaacccacatgtgctaatgacggattaattaggctcaaaagattcgtctcgtggtttccaggcgagttatgaaattagttttttcattcgtgtccgaaaacctcttccgacatccggtcaaacatccgatatgacacccaaaaattttcttttcgcgaactaaacagacccttacttgatgttttagagttcaaaccaatttatgctaacaaaagtatgtatggttccgaagttctcccgcaatatttgaagaaatggttataaaggaattattttgttgcttacaggggaagctaaccatcttggaattaagctttgaataatggacgttaacaactattgacccacaagaatatggatatctttcatggttcaaattgaatgtttcaattaatcaattctagccgtatttgatgggtgattcgacctcagtttggacaccgatggaatgtatgcatatattatactattcctcttcaagttgggttgactggaagagtatgttttttttttcaccatatttgatcataaactatatagtttatgtgcatttctgctgtgctctggtatataattttgtggacttgtaagctataatatgggcagtgaaatgattgtgctatgcgtgtccatttttcaaggtatttacacatgtacttcagaagtagtgttttgcctatccataaaccaaatgcacaatgagaataattgtgtactattgaggtattcatccttggacagagctggcagataaactaacagtcatatatgttgattagcttaaatcggattattgtttttatctgttggttgtagattgttacggcgagaggatggttctacagttgcttattttagagggaatccgttgcaaaaactaaacttgtggagccacatgcaaaattttgttcaaatgaagtgagtagtgaaacttagtttttttaaatggtagtgaaacaaaaggaccaacgagagcttttgcttatttgtcactttcatttgtcaattatgtttcatgtaaacatcaatggtttgaaataagtttattgcttataacaataaatggaattgaagtgataattttgatataaacgtgcattacacgtgcacggttactagttcgacacaaagttcagctttggttggttgtccagtgtcagcggtttcacagtccagccatttatttgaataattaaataacctagctaagaacatagctatcaagccttgtaatttctaggctaagttaataattgcatatttctgctcatatcaattgtcaaacccaaagccaacccaacagaggagaatatgaaataggtcagggaacagagttaccatatgcataaaattcaaggggaattaagtatttccttctatttttcctagtatttcttatttgtccctatattcattgagtatatacaatttgttcattcattccttaaaattgagggtatgttattccttatatttttgaacacaaatatcatataccttaattgattattaagtattcatgtctttttatttttcacaaaacaaacgagactgtttattcaaagaggactttactctacttttgcatagagtaaaaagacaagatatctccatttggcagtcatagattgatcaactgtaattgatgctccccctgtaaatctctcttgtaaatattctctatatatttttttaatatatcacagtaggagcctctcctgttgttttactggtaaaaaatttttaactctttcccctcccttcttttctatcatcttgatcataccagaccatcatatgttcccaccattagtctctagaggttcattatatcatacttctatgtttattgccactttatcgaggtctacatgacataagaaccgattacggggacattgatgaagaggtcgcatgaaatagattaggcaactacgttgtccatagaagatactacaatcactttggcacgaggatcaagacactagttgtaggcttatagcccacaatgacgaccatactatgaggataatggggcaattcaaaaagcattgtcattgcttgtactcgctagctactaaccacgcttattgtagcctgatcaccactattggtccctgttggaataggagagaaaaagagaagtagagagaatgaggagaacggacaatccaattattgtaatatctatgattttaactaaaaagaaaaaggcaagttttttttatattcggtgctagttgtacggaatattttaaaggggcgaatgataaattaagtaatacgaaaacagaatcatcatatagacctcaccaaaacaggagcacgtaattactttccccatccatcaaccatagtagtcttccacggtggaaatgtttgggttgagaacatatggccgagcacaatatagatcctgttcgtttcttctgcaagcatatgattaaagtttagatactcgtggcacgcttttcaaactgctaaacgatgtgttccgtgtgaaagctttttatatgaaagttgctctaaaatatcagattaatccatttttcaagtttgtaataattaaaactcaattaatcacacgttattaccacctcgttggtgtgaaacacttaatctttatctcatcttcaggagattcaaacaccaccatattacctaaaaatcatgtacatggtgatcaaagatgctcttcattacacatcaaacacgcagctaaataggggcgaatctttattatttatagcgagcgtgagtggttacggtatgcaattcctttcatcagcacagtgtgagcatcacgcgtccccgtcccgtcggcgcaccagcacagccacaggctggcccagagagggtgcctcaactgtcggcgcctgcacatctggaccgtccatcgcggcgatcggacggccacccgtcccgcaaccccgccccgcgtcgcctatacaagacgtcccacccccccccccccgtacgctcctcccccatttcgaacggatccgggcgcagggtgcgagtgcgtgaggcccaatccccaaatcccccccccccctcgccgccgccgccgcccgtctgcacgcaggcctcctcgtcggtgaggtccccccgctgatccgtctccctcccccccttcctgttgatccctgcgctgtggagtggcccggatcttcctgcgagatcccgtcgcccccactttctttgtttttttatttttttactttttctcgggtgttcggcgcgggcaatgctggatcggtggcggatttcgctcgccgtaggtagcgcacggcgtgatccgttcgtctgtagggtcgtttccgcccaccgtgcttttgggcggttgtttgtgctgcgtctgtgcgttcctggtaggtaggaattgcgtggagagcattagcgaggagtggaatgtatgttcgagattcggctgcggaagctaactttgtgggacgatttctgatgggtccttgtatggtctgtggctgtgtgatgtgtagaattgtggattttgttttaggcctttggaagaggatgccacgatctgttttgtttagtttttcggtccgattggactggatttcctgaatcattctgtgctgatctcatccctttgatgaaacatagtgatgtacgtcagtatttgcaacggtgtggtcgttcagatgagcctgatcttgcagttagatttgaatatctagtaagcgtgacatgaacgtcttaataaacgtcacatgagcgtcacctactgttttctagcggcatagacgcctagtggagacggaagatctttctttattggttatcttgttgttttgcacaaattacttggtagtgatgttgctgtctgtgtacttatagacaatagaaagttgctttcaaatgtaatacttcacaatgttgagcagtaaacgcaccagagcgtaaaggttcttgtgttgtttatacttcatgaatagcaaactaccatctaggtgcttatagccaccttttatgcttgacgtgtaagttggaaattgatggttcatacaacattttctcttaacacgagaaaagttatttctcttaacaatagaaagttagtacacaaggtaagtttagctgctgcatgcttgctgtgttctattagtaagaactaatctctttatagcttgctacggaacatatacagattcacagaacatttttaacaagttaagaagcatatacacttgcgtgcttgaagcattgtcctttttgtgttgataatttctgctatgaattaagtattcatcatctttatagctgttttttttttaattttctcactaggtaaattcaaacttaaccaaggaaaatagcttggtgatttttttattggtttattctaataatttggtcaatcgtactgttgtttttgttagagttctgctctatgctatcttgcatgattagaaatctcactgcacactggagctcccaatgatttgagcacatgctactatatgttgctgggcagaaaatggttgaacattagaacaagagttagaatggaaagcaacaggaattagtcttgtactctggttaccatcctcttgtttcagtccaataaaaatgtaaagtagtgaaagaatttatctttcttggatggagaatgtgccacatcatcaaaatactaatagccatcgggtgcagcttgaaaacgaaactaccgtttgatatagaaccagtacatcctagtttggctgaaaaactttttatttcttcagaagcataagttcatcaaagtatcaaaaactttatgatcattatcatgtttcataagttgaactcaggtcaactttgttttgtctttccttgcagtactgaaaatttgagttttaatatttttgccttaaatttctgctcagcttcacttcatcaacaatcaagatgagtcgtggtgggagtgccggtggtggccaaagttctctgggttacctttttggaggcaatgaggcccctaagccagctgctaaaccagcacctgcagctgcacctgcaccagcgccagcaccagcaccagctgcggctgtggctgctcctgctgagaaaccatcacctgcaaaggctgatgccaccaagcagattccagctgggattcagggcagccggagcaataacaactaccatagagctgatggccagaacactggaaactttcttacggtacggttctttccttttatccacatcagaattacagtttatttgtaatgggtcaaggcatttcaggattcagaacttgtaagttctggccaacagttagtcaaacaatatgcaagtttagtgtcacaaatgtggtaccattagatatttttctggaagtaacttcttgtgggcaatatatttgaaaaaaatattatacatcaactttcaaattggttttgttattatcaatatatactttcagtaagctcagttctttaattgctgggcatcttttttataatactattgaatgaattggctagtttccacatccagaatggacaattgagtaattcttgatcattttagccttaagtcctgaatattgctaatttcacatgctgatctttatgctgcaaatcgaagttatgcatgaggtatgatttggacacttgattgtccttgtaaaccatctctcttccttttgggcatatgttacgtatgtctgctggtaaattgtgaatgcttggttggtgtctggtaagaaaggatcagtctacactgagatagaaacatagttacttatccactatttgcagtatgagattgaataatttctgattcatggggcttacttatagttctctctggcaatttcattgtcatttcgcaggatcgcccttcgaccaaggtccatgctgcccctggtggtggatcttccctgggctacctctttggtggaaactgaaggagtgatcctggtgcactgtagcaccggatgaagaaggaagtctaccgctatccttgtttatcagaactgggaacccccattgttttatcattctctatgcatgtcccgtacctatgactccgtggcaaacaccctgcctgggatcatgatcctgtcgcttaaatttcgaggcaaatcgtatgcctgaatcttccaaaattatcgtgtgcctgtgccttggtttcagtcacgttcatgtctatgtttttgctcaggattatatgtatggtagtaatcgttatctggatgtgcgcacaatcatctgcacctccctgtgacattcttttttgaaggcctaccagtaaacagcacagattgccggctgtatgacaatgatatgataggagagctggccttagaagaaaacggtgagtgcgaattcttattgtagtagtcgtttgaagaaggaaatgggtgttacctggacatactttcttcgtctcaaaatataaataattttaattgaatatgacatatcttaatattataaataataatattataaataagacaggaagattcagattaataatattaagatgtgttttatccaatcaaaattatttatattttgggatagaaatcagttaaaatcatttatatttatattgagatagagagagtaagtggtgtttttttaaaaaaaaaacacttggggctcagaagtgagtgcaggctagtcatggtactccttttatttcataaaaaataatcattttatttcataaaaaataatcttgatatgatgtgacattttctactaagtctgactagaagttatctagatttataatactataatatatcacattatatttagatttaattttaatgaaacgagtcagcctcgtttggtaaactctagctctcatctccaacttatctgaagctgatcctctgtttttgggagtggagttagcagagctattcctttaaaaaaaatacaaaggtgaaactgaatttttttaacatatttacataaaaatgccacttaaccatcccaagacaactccttacccctctctctcgcgcgcgactggcgggcaggcagtgcgtggctgatggcgcgtgcggggacggcgtatggccgacgcggggtaggtgaggacagcgcgtggcctgccgctggcgacgcacacgggacagcaacctagggcttcacgaggtattatggattgttttttttccatttttttttccgaatactaggcaaacactttttagttggtctcccacataagagtttagagttaggatttggaatttaaagcccaaccaaacgaagcgagtagacatgtagcagcagcagaattacatcctctgcgacgtggacctagaaaacaagtactagaactgtagaagtagcgacaatgtacatttccttcatgcaagacagcaagagtcagcggctcaacgccgctcgacacatcggccagctccggcttgcgccgccgcctcgctctgcgatgctgacagctgattgtgtgcccgtggggcccacctaccttcaaacaggatcaactgcaccctctacgttctaaaataaaaaatgagtgaatttcacgtaactacatatattttaggtaaattatcacaatactacatattcaatatgatgtattataaaattatagatttaacaaaaaaatatattatagaactacaaatttaagatggaatattacaaaactacacatttagtaataaagttatcacaaaattataggttttacatcaatataatcacaaaatttggacatttataactcaaacataatattagagctaaggatttaaacccaaaatccataattttgtgatatgtttattattaaattcgtagtgttgtgatacttggccttaaacatgtagttttgggataaatttattattaaatctataattttatgataatttggttcgagtatttgtgggaaaaaaaaattttacttttaaaacaattcatatagctgaaacatttttacctctccttaatcaacgaataagaaatgaacgtaaccttataaaactaatcatttcatattataagactttctagcattacccatatttcatattataagactttctagcattacccacatttcatattaaccgtctatcattttaacaaatgacaaaaaaatagcacttatatttttcttacgtggaagtgtgcaaacattcgttccaattaaaaatatcaaaatacaggattaaagtgacctatttacatatatctaaaagtaatttcccccacatatatatatatatatatatatatatcaaaatacatgattaaagtggtctaccaccttaaatcccaagaattaaaaaacaaccgtaagaataattgtttggatggaatgcagaaccaacatatgaagtagaaaagagatatagctaccgatttatttttcaaggaatgaatatttagatggggaaaaaaaaccgccatgacaaacatagaaagcagaagagagagaaacagacgcaaatgatttttcatgagagattgaaattcaagttagaattcctccaaaattatgttttgtgtcaatccaaagaaattttataggatttgtatatggctattccttttatccaaataaccacgtaggaaaatttttataggattgaattcctctaaaatttctttgttacaattgagacgtaaatagtgcggcattttgccctaagaagtagtatctctttatccaaccccaattttatacctttttaatgagtattttagtctctttgtctcactactgtacttattattttggatgctacgctaggaactttcttttacgtagggagtagtacctctgtcctaaaataaacaaaaacatgagtttccgtgttaaactttaaccgcctgtcttatttatttagttttaaaaaaatattaaaaaaataagtcacgcacaaaataatattcatattttataatcaaataacaataaaaaatactaatcataaaaaaaatttactccctccattccaaaatataattctcaaccactcataacacaaagaccaagaaaatatttaatcaccttcttggttagatcaccttgactcatccaagcaatgtgatagggagatttaatggtataggatttaaaacaaatcaattttattggaccatgaggtgctaattaatgtatgcatgcatacacgtcttatatggagtatgagacatgagagaaaagtggttatgccttatattttaggatgaagagagtaaataagacaaaggattaaatttggacacgtaaacttataactatgtttatttcgggagggaggagacgtctagacctatagctgggctccatgcagtctcgttacctgaaaaactgaacggcaactcatcggacggttaggcagaagattttttgaaagatcatcaatttggcgattgctattgctgcaacgtacgtaacggcagtgattacgcctgcatttagtttcgatcgtcatttgagcaggagtaatgatttcaatggacggttacataatgatcaagtggtagaggaagaggcatgcatcaattttttttaagacaatagaaacgtttttttcaaatggacaatataagtatttatatgtgcgcgttaaaataaaaccgccaatttctcttctacactagcggaatgcttgtgtttttacctgctaaattccaacaaatttatattaaaatctatcactagatgtcagtgtgcatacaatgcaaaattatatacaagaaaattctttgaataaagcacaatgctactccctccgttttatattataagtcgattgtctttactcttaatcaaacttcttaaagttttcctcgcaaaaaaaacttcttaatgtttaaccaaatttgtaacaaaattttagtaacattttccaatacaagataaactttgtatcaaatactattcaatgttaaatttaataagactagtttggtgccacaggtattgctaattttatctataaatttagtcaaacatatataattttgactaagaaaaaataaataatttataatcaaaatataaacgatttgtatcaaaactatttataattgaaaaaagaaggtaggtgtaaatgaaaagacaccacaaatcaccagctcatcctttcaagacttgggtatggatcttggctgtgttcggaccttccagtttacgacccatctcggtcgttttccatgcgcaagctttttaaactaataaacggtgtattttttttacaaaaagtttctatacgaaagttgcttaaaaaaattaaattaatctatttttgaaatttttttattaatacttaattaatcacgtgttaatgaaccgctccgtttttcgtgtagaggagatgttgttttttcgaaaagagaagggcaaataacacttttacgttgtgttttgatgttgaaattgagaactaattcttacacatgtaaaacaaattgattcattagcacataattaattaaatattagcttttaaaaaaaatagattaatatgattttttaaaagaaatttttgtatggatttttttaaaaatgaacaccgtttaatactttatcccaaggaaagaactcttgctgccaaacaaagagccgtactctatcccataaaacaaagtgaacaacacgtttatttttcacagacaaactaatttagtaaatttcatggcaaattgctactatccgagacctttttttcttttttgcctcttcaaagccattttttaaaaaatgaaaatttaaaaccttttttcttcaatgataaatctgtacatccaccgtccaaaatagatactactattagcagtaaatttgaatacagttttgttttgttgtctagattcagggattgaagcgggccgacctgcaagttcacttatagatcaaatagataataacttatgaattttcacgtcgtggtccggcttgccatattcagagatgcaagtgtggatccataaacttatttatagattaaattaatatattacccactaattttacctataagcaggttcacggacaaacccgcttacactcctatctggatttgatttttttaaacaaagagagtatgcaagagaaaagtctatatctaccaaccttaccaaattttagtaaaattacaaaaaaagtggctacatttagtttagcatagtggctaccaatttttttttttcatcaaagtgaacaggccctttgttactcgagacagtgcacaagcacaaccctctcgctatttaaaccctccaatctccccttcccacgcccgcaccctcctgcctccccccaacattctcacacgccatggatgccactctcggcgcctccactacccatggctacctcctcctcctcccggcaactccaccacct

SEQ ID NO: 12884 - DNA, 8248 bp, Oryza sativa
tgctcgggttgcagggggaggagaagatgacggagtccgacatggtcgccgttctctgggtaaccaaggatccatctgacatgcatgcatctattcgatcgatcttgtgcattgcgatcaacggattcatggatatatttgatcttgcgcgcgtgcaggagatgatctttcgggggacggacacggtggcgattctgctggaatggatcatggcgaggatggtgctgcacccggacatccaggcgaaggcgcaggcggagctcgacgccgtcgtcggccgcgggcgcgccgtgtcggacggcgacgtcgccggcctgcgctacctccagtgcgtcgtgaaggaggcgctccgcgtgcacccgccgggcccgctcctgtcgtgggcgcgcctcgccgtgcgcgacgcgcacgtcggcggccacgtggtccccgcgggcaccacggccatggtcaacatgtgggccatcgcgcacgacccggagctctggccggagcccgacgagttccggccggagcggttcgcggaggaggacgtcagcgtgctcggcggcgacctccgcctcgcgccgttcggcgcggggcggcgcgcctgcccgggcaagacgctcgcgctcgccaccgtccacctttggctcgcgcagctgctgcaccgcttcgagtgggcaccggtcggcggcggcgtccacttgttggagcgcctgaacatgtcgctggagatggagaagcctctcgtgtgcaaggctaaacctaggtggtgatgatcaaggagtatggggctgtttggttggttgctgccctgagtaacataacatgcctgaaatttctgtgcgcctgagtggcatgtgagaagaccaatgcatctaacctggtcaggcagcttgagtatatgcttgtttggttggttgttgctgcctgagaaacaaatatgcaattacgcctttaatcattacacagctaaatcaagtattaatgggccgttacaaatcttgccacaaattgcatctgaacctcctaccaagatccatttatgacccaacttcccatgtacaagcacaaatcttgcatacataacgaggataaaaatctaggaaaaaaaagcagggaaaaagagagaggagaacgcaatcgaagagtcaaatagatcccaaatccgtgcatcaggagcgcaaccttcagatgattctgtccagatgtgcaaatgcatctggcaacctgcaaatcgatctgcttcgcacgaaaggcagcctgggcagcatctagcatgggcgatgctgctatgctgggatccggcaagatggcgacgacttcacacgccggcgggagcagcaacacagctttgcagggatccggcaagacggtggcggcttcgcacgccggcgagagcagcacggcttcgcagggattacgaaagacggcgggcggcggcggcttcgcacaccggcggaagcagcgcagcttcgctcctggaatctacgtcgcgtggccgcctccgagaaagattaggattaagatggtaagtatgtatcgctgttgctgcctggagctcaggcgatcgatttcggtcgcctggctcaggctaatgacgggaagggctgcaggccaggcgaagggtttgggatctgagggcaccaaccaaacaagaccaggctagcttcaggtcaggtattttcctctcaggtaacgaccaaacagcccctatatgcatttggtctctctctagggctgcatggattatattatcgcttttgctttgatttggtttcggagatcgagagattttgtacattttgatatgcatgcacggttctactagcacaatatgaatatgtttgtcatctgatgagataattaagcttgacccaggtgaattaagtgcatgaagtactgtggcacatactctcttcgggctgataatacttatcgttttagataaatgtgaagtcaaactttacaatctttgattatgaatcatttttaaaatatttatctttcaaatatggtgattattacatgtatagattagtcgtaaaaggtactttaataaatcatatgtttgttaacacttttatacatattataatgaaaaataatggtcgtgcactcgtgctcttgtcgaaaacgataagtattatcaacctgcagggagtagttaagttatgtgggtgtttgaggttaccataaaaatatatggaaatgtttgttgatactgagggcatttcaatatgcttaatgtttttttttttggttttgaggtttgatgcttctcactgtttgttttgagattgatgatgttgttgttaatgcaaatgacacagagagatcttgaataaaagaaatggtgttcctctgaaaccactctactggcatatctcgggaaaagatatcctcagaagcaattgttcattttagcggattatacacgatcgagtaaaattaaatgatgttcctctgaaacaactgtactgccgttatacatgagttcaaaattctcctcagaagcaaccgtggactttatctcatgtacaattaatggctaccatgtacattaaccaaacacaactcaaagagtgatctgatttcaaatataatttgttctcacaagagttaagagaattgttagaatccaagagaacatacatatgtataaaggacacaacatgacatttgatacttcctctatccacaaaagttacatctatttcagatttgagttttttcaaataagttgtttctatttgtagtatttatgcattcaagacttaaatgaagagataaattaaatgttttattataacccaaagagtcatctaaatactcattggttgtatgcttgcatttactccttgattttgtaacatctaaggtgattctatttcagatttgagttttttcaaataagttgtttctatttgtagtctttatgcattcaagacttaaatgaagagataaattaaatgttttattagaacccaaagagtcatctaaatactcattggttgtatgcttgcattcactctttgattttgtaacatccaaggtgatttaatttctccttggtcttggtgtcaaaagtaatatggagggagtataactcatctttttttttctcgtttttttctttgcgatggcccctttctcgcatttctatgaggtttcattgatttgcattgcgcaacaggccagggtgaagccagctgactagccgataatatcattggcgtcaactccattacatgacttgatacggtgaaccttgaataaaaaatactattactctctccatctattttgataggcatatttcattccaaccacctattctcttaatgactttctcggatttaatacgtgactctccattcttccacacaagattggctacatggacatcgagaaatgtaaatattaataaatcgcttgtttagtagaaataactagtagtatgtttaaattgatgataagtatcaaaataaatacttatggatggagggagtatttactatagaggactatcgagatgaaatatgactatcaaaatagatggagggactccctccctactggtaaatgaagttgtttaggacaatatttaagtcaaaccttgggaatataaatcatgaataactttcgagttgttgagtttgaaaatgtaaaaaatatataaatagatttgtcttgaaaaatactttcataaaagtatacatatatcacttttcaataaatatttttatagaaacaagaagttaaagttgtgttttaaagaccgtgtcgctgcttaaaacgactttctttacgatttacgagtacggagggagtatttactatagaggactttgaatttcatcgggatcggctgacctcgatgatcattactagatcctgtcacgcaagccctatggcatttgttaccgaatttttttattttttaagacctttttatgttttgattttttagtagactacttcaaaaaatattttcataaaccgaaacttttggccaccaaaaagccgagtggctggcgtaacaagttgtttggccacgccggccacagtggcgtggcaagagaggatggtgtagaaggccagcattatcacgtagcgcgcagtcaaaaggttcagatttgaaaatattttttaaaaggaaaaggtacaaattatccatccgaactaacgcggtcgtccgaattacccctctaaacctgaaaaacagacatcattcaccctcaactttcaatacatgacaaattacccccatcgacccaatccaaagcggttttgtcctacgtagcgtacacatggcagtccagtcagcattttatttattaaaaaatatgggacccacctgtcatgctcccccctctcttctctctcactcttcctatcgctttctcgccagtcggcggcaggcgggggacgcagcgacggtggcgtgggacgaggaggcggcggccgcggccacgacgagcagccgccccctcggcgcggacccccttgccctccacgtcgccgcctccccctccctcgccgacgtgtccaccgccgctgccaccaccaccaccactccccacctcgccgcgtgcccccgtgacctcctccttgatcccccgcctgtttatactcatctcgtcacccgcctcatcatcaacagcagcagcagcaaaagaagaagaagaaaaaagagtgatccagctagctcgcctgagttcatctgctgtgtaatttgagtaattagcaacaatggcggctgctaccatggcgctgagctcctccttcgccgccgccgccgctgttggtgcgccatggcgtggtgtcgtcggcgccggccgcgccgcggttggcttcccgcctcgccggcgtgctgtcacgctcgtcgtcagggcccaggccgaggtgagctgagcgttcttgattggtttcactgtgcctgttctggtgatttgcttcgtgtgctaacttggggcgacttcattgtcgtcgttcgatcgatctgcagccggaggtggagccgacgaaggaggagacgatcacgtcgactccgagccccgtggcggcagcgcccaaggcgaagccggcggcgagcacggggctgtgggacgtgctggcgttcagcgggccggcaacggacggatcaacgggcggctggcgatggtggggttcgtgccggtgctcgccgtggaggcgtcgcgtgacggtgagctcttggaggaggccaccagcaggggcgggctcgcgtggttcgccgccaccgccgccgttcgtccgtcccgcccgccgcgcagccgcttccgcgtcccccgccgccgccgcctctgtccgtctccgcgccgagggggcggctgctcgttgtggtcgccgcctccgtctctgcgtcccgtgccgccacccgcacccgcctccatccgtccccgcgctgaggggtgccggttcgtcgtggccgcggccgccaccgccgcctcgtcgcccgccgccgcagccgctgcgtcccccgtctgtgccgaccggcgataaagtgagaggaagagtgagagagagagagagtgagagagaagagagaggaagagagagagaggagtatgacatgtgagtcccacatttttttataaataacatgctgactggactgccacgcatacgccacgtaggacaaaaccgctctggattgggtcgaggggggtaatttgtccggtattaaaagtttgagggtgaatgacgtctggttttcgggtttagggggtaattcggacggccgcgatagttcggggtaattcgtattttttcctttctaaaatgatctattaataaaattaaaatataaaaaggtgtaaaaaataaaaaaaaatcttggttaccctcgtaaacttccaatatttggcatatattatcccgttccatcctatctagccagaaatacttttttttttaaaaaaaagggaagtactacttgtacaagtagattctcttttaaaaatatccatatatataatttgacagtgacgtaaactaaaagatttgtaggattaatttccctcttacgtacatctacgcatttcgcttttgtacaaatgatttagatttaaaaaccataaacaaaatgtaccagtacaccgagcacttgcaccacaagtccacaactaaccgggcacagtagttgtcatctttttcttaaacaaagctaaattaacttctttttttctttgaacaatttagaataaagctatttctaacttcaaaaacaaaatgttttggttgtgcggttatatgccatggctgttagtatgtattatcacaccatccaggatggtatggataactaaacctttatctccttttttttttaatcagctaaacattttctgccccacgattgtttttccaccgtaacgacgctatttagaattgtgggtgacagatgattttaattaggtcttttacggtgcttgaaaggtacccatgtacctcttaacaaattgttatccactgttaatctttaaaaggtaatttaggaaaaaaaattattaacacggatagcttagtactccctccttccctaaatgtttgacaccgttgacttttttaaatatgtttgaccattcgttttattcaaaaacttttgtgatatgtgtaaaactatatgtatacataaaagtatatttaacaataaatcaaatgatataaaaagaattaacaattacttaaattttttgaataagacgaacggtcaaacattttttaaaaagtcaacggcgtcaaatattttgggatggaggtagtaattgcttaatttccaccccgtcgagtgcctaataaatcggccatccacgatatcatgcaggtgtcgagtggctcacctcaatcgatcttcagaatatgtacatagtgatcaaatagctaaattaggcatagaaaccagtaggggatcggatgcgcagcgcagggcattgttgatttgtttttgctggcaaaatcgatcttcagagcctggaatacaactgctggctgcatgaaggcctgacgacaaagaacgggcaaggaactagcagagcagacagcagcccggggattcgtgcggtggcggtgacggcgacctgctgctgcgtacctcagctgcgaccggcgggcgctacgggcgcgtgcgacggcggcggtatacggctgctgctttcgtacgctacgaccggagggcgtgtacggcggcggcgagcggcgggcgtgtgcggcctcggcgagcggcgggcttttacgtagcgacgatcagcaggtagttcatgtaggttcctctcgcatgcgttcttatccttcctcgtttttttcttcctcctgctgaaacgtttgtagcttctctcgcttttgttctttatcgaaaaataatttaatgaaaatcaattaccattttacccttcccctctccatacctggtccaccattttaatacccttttaatatcttttttcagttatcttctctctgtccattagatcattgctgatcaagggttctaattaattttaagcattgaagaagatctctcaattttattatatatatatgaggagggcgagggtgagagcgaggctcggtcctattttttttcccctttcattcgcccgttctgtccccatatattgcacgataatgatataacctcatgcgaatgtatttaccatctatcactcaacaaattaatcagcgttaaggggaaccaatcaactgacgagttccccgccaccttacgatagattttgtgataaaaattttttcttagaattagaaaatgttggtagtaacttattttaggagatgcactatcaatagtttagtggcaagggatgtgtagttataatcataaggttctgtgtttaatttccaacacgctcagattttttttaaaaaaatatttataggaacatctctctccaaagcacatataacatatggtacatcgttcagttttacacagagaccttgatttatgatggccaacacacgacatgaccaaagactaaactttggaagcagtcaacagcctaagttggtatagtcactatctcctttaacccggccacacggtcgggagataagtgggaactgggaaggatacatcaagacattgtccaaattaaacatgttatcactttttttataaactttttaaactttacttttaaaaataaaccttccaaaacttattttcaagatataaccttataaccacgctaacagactgacacggcaaaaacatactaccata

SEQ ID NO: 12885 - DNA, 1882 bp, Oryza sativa
cttccgcctaggcctacgggatgaagacgctgtcgtggtgaagacggccgctaaatcgtcggggagcttcatcaggactggtgggtaagccccgtcatcttgatctggtgtcattggagaagatgcgatctcggccgactggtttgaagccgactcggtgagatggtcttgaagtagctttcaaccgcgttcgggaatccaaacgggaccgaaatccggttctctcccgactggtttgattccgagtcgaggagagaaatcttgccgaagttgtcggtgatgaaatcgaggctgccgaaccgaaacgtctgcccgggcgggaagacgaggtcgtcgatgccggagaaaggacccattgcactgatcggcgaaaagcttgacgctacccctacctggcgcgccaactgtcgaaactagatttcggcaataatgaaagggggtggctatcaagctagaaaagtgtatgggtttggagacaaaggatttatacaggttcaggccttcttataaaagaagtaataccctactcctgtccggggatgaatccgccgagtgtattattgattgtgtgattcgggaaaaatcagcatatgcccctagaggcgcccggaccccccttatatatgggaaggagtccgggttacaaaagataatccatattcctaccggaatatgaagataaaggtaaaatacagtcgtaaccgactaagtctcagggtgtttccttgatacacaagttaagaaacaaacccaagatacagacaagatattctatctacattaggtatcctgtacccagttcgaataccatcgccgtgtagatatgggatacccataatctccacagtagcccccgagtcctttgcagtcgaccatcgtagccctctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaatcgtgcattacatgacaaaagcgtacgcggcgcctaaataggcatgctagccgactgctttttagccacaataaaagaaatccgagtggtttacactctaaaaggttcacgaatgaacatacttgacaggtatccgaataaaaactctaaagattacccatcaagtattatgaagattatggtaataaataagtcgaatagcctaggccttgactatttaccataatgaaaataggtatataacataccaaggaagtgactataataaaaacaagtcattcctagttaacccaaacagcttttgttagcctaaaaaagcttgcaaaaacagcataacgcctttctgtcgggcacctttttaattcgcattgcaataattccaaagaattatatgaccgcataaaaaggatttgatcagcattgggcaacactgttgtgcgcataatattgccaaagcaaaatatgcctaagtccctaaggaacacaatgggccacactgttaaaagtattgggctgaaatactgttcaggcctaggcccattagcacctccgatacccttaactgaaaaatccgatatccaagcgacgcttcgtcttccccgccggaactctcgccattttccccactccttgctacagtgaaaagctgcgccggcgaactagggttcacaactccgctcaaatccacctccgaaaagtgcatcaaaatccttcccgtgatccaccgcctcaatccctcacctttcccaagccatccctcgaatcaaatcagcacatttgagaaaaatcgatggcggaagagagagaaagcttcg

SEQ ID NO: 12886 - DNA, 686 bp, Oryza sativa
attgacgccattgatggctttacagacgggacaagcgtagaggctgctcttgatcttatcagcaatgctcaaaatgcggctgacaagattgcaagtgacgtcgtagatcaattccgcaacaccgaccttcagccgagtagtaataactctgatgatgaaaggattgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaatcaaacaaggcaatgatagaccaaggaagcaaattgaattgataaaaaatcacactccgttattatgatgatagaccccgactgacaacttcaagaagaaaacttgatgttgacagtcaagatagggaagtacagtgataagcttaagcgtagaaacgacgaagatgttcgatgttccaagagttgtcgacgagtgtaccgtcttcgcgcttgagtcgataggaacctggccgggtgactgcagagatgataaatggcccttcccatagaggagataacttgtgccgatctcgtgtagtttgaattttcctcaaaacgaggtcgccgactagaaagg

SEQ ID NO: 12887 - DNA, 488 bp, Oryza sativa
ccctctctccacaggtcaaatcctccccttccttgcttgcaatcctagcaagctccaagatcgcggcaagctagcctcgagggaggcccgcctgcccgggcctcgggctccgggggcccggttcttgaggtttcttggtcgtggggtcgaggaggtggtgggtggtggtggctgcggcttggcgcgatgaacaaccacgcggcgggcgggagcacgagcaacggcggatccggggtcgacggggatggcggcggcggtggcggcgcggccaggaggaacaccaagatgcccaagtgtgagcgcgcgagatctctctctctctttgctcttctttgcttgcttcttgtctcgtctagccttagtgcaagatcaggatgcgatgagcagagctgttgctgagagcgaagtccatgtagtagttagtagcttgggttcttttcgcaatttcaccccgcaaaggtggtggtaatctggctagcttagggggg

SEQ ID NO: 12888 - DNA, 445 bp, Oryza sativa
aaaggtctgagttttcctacgatttcatccgtgggaccaaatgcagcagtgattcattataaaccagaagcatgttcatgtgctgaacttgatgctgatagaatatatctgtgtgactctggggctcaggttgagtacatttcagtcaaactcaaattttgtggtaaaagacttgcttgagtctaattctttctatggtggtatgtttgcagtatcttgatggtactacagacattacaagaactgtacattttggcaaaccctctgagcatgagaagtcctgctacacagctgtaagtttattttttcgtcacttgctaaaattttcttttatttagaacaaatgacatgtcaaatactaagttctatttagaacgaatgatatcctaatagtgtaattgttggtcaaagtaatatgccttatattttgaaatggagggagtat

SEQ ID NO: 12889 - DNA, 752 bp, Oryza sativa
gatttcacctagtcacctaataatcaaagatccccgtgggggcccacctgctgatcgataacggtcgctgtgacggtgggcccggggtggcctgggtcgtgattgggtgaggccgtccgtcggaggggtaggtgtgtgtaggtaggcttggctctgagtgtggggcccatccgacgtggcgtggtgtgtaagccaagacgacacgcatgcacaaatccggttcgtcgaggttgacccatcgcgttagacacatacaagcgggggcggctaacaccccccatcctttctttctcctcatcttcttctcttcctactacaccataaatttttaaaaaataaaaaacataagcttgaaaaaaattatatatagaaatactatatataaaaaaattaaatttaaatttaaatttaaaacaggtatgtaaacttttgacttataaactttgggtctataaactaatatttgaatttaaattcaaattttaatcgggtatataaacttttgacataaactttgggtctataaactttagatgtacaaaatactatatataaaaaatatttgaattcaaattcaaatttgaattggatataattcaaattcaaatttgaattgggtatgtaaacttttgacttataaattttgggtctataaattttaggtgtataaactttagatgtatagaaatattatatataaaaaatatttgaattcaaattcaaatttgaatcagatgtataaactttaggtc

SEQ ID NO: 12890 - DNA, 750 bp, Oryza sativa
  unsure (1)..(750): unsure at all n locations
agtaaatgaacattttacactccaaatgagtgctactccagctgctaagcgtatgactgagatgtgataacaatctcacaaaaaatggacctattcttttttttttaaaaaaaagaagaaggatgaaatgcatgtagatagatgcgagaaccagaatgcagacaataataacccacgcaaccctgacactgcacgcaccgacaattcgtcgagcggcttgggcgcgtcccgtccggccgccaccggcacaccaccccccgccttcccccgcgacagctcggcgttcccgggcgacgccacgagcgcggcgatgcgcttgcacgcgctctggacgtgcgccacgaggacgacgaggtcgtcggccgcgccagcctggcccatgtactcgagcagcgtgggcggcgtctccgccgccgcggtcgccgcggccatgccgtcggctgctacggcacgcgcccgggagacgggcgagcggcgcgcgagcggctagtggcggaagatggggaggaggagggcgcgagatggatgctgcggtggcgggtaatttgaagttggcggcagcggaactcggtggatggggaggagggaaagagaggataacggcatagtgtanccagtggtagtagtggatggttggttgctggatgatgcgtggctcgtgtggatattgcactccacgtttcattgcaaaaattggaaaaatatattacaaaattttattttattttttaataagacgtttcattgtag

SEQ ID NO: 12891 - DNA, 950 bp, Oryza sativa
aattttcatcgttttatttttttgctgctcagaagaagatcatcgtcaaaacatgtcgctcatttcgaagctgcggttgatcactgtggatgtcaccggtactctgcttgcctacaaagggcagcttggtgattactactgtatggcagctaaggctgctgggaagccatgtcctgactaccagcgaatgcatgagggcttcaagcttgcatacaccgagatggcaaggcaatacccatgctttggatttgcagcgaagatgccgaatatcgactggtggaggatgtgcgtcaaggattcttttgttaaggtgatgccactgttttgtaggtctgaagcttttcaggaactagtgatgtctttgtgttcagaggctaagtgcttcggttgcttgatatgtgctgtcttgtaggctggttatgagtatgacgaggagacatttgagaagattttcaaacggatttactcttcttttggctcgtctgctccgtactcggtattccctgatgcgcagcccttcatgaggtggcttcgcgggaaggggctcacggttggaattgtcagcaacgcagaataccgttacaaagacgtcatcttgcctgctctaggactgaaccaggttcgatattctccgcataacaaattacacctcatgctcctctaatgttatcatcttcacaagtaaatgttgtggttcatgacttctcttgatttttttttaaccagggctccgagtgggactttggggtgttctctggaatagttggtgtggagaagccagatccaagtatctacaggattgcactggaaatggcgggcaaggtcgcgccagaagaggcgcttcacataggcgacagcatgcgcaaggactacacccctgcacggagcatcggaatgcacgcgttgcttctggaccgattcaagaccgccgatgctgagagctggaggaa

SEQ ID NO: 12892 - DNA, 476 bp, Oryza sativa
caaggtgcagcaggaggaatggtgcccaaaacgcaaccaggttgtgctctcgtgcggtgctgctcagggaaagattaccgacggcgtatattgcggtcgagtcggccagctggtacgccagccagaggatgaacctctccaccggcgtagcttcgcgccggcgtaccccggcgaagatgtggaggacaacctgcaacgtgaggctcaagagcaccaggatctgggtcgcccattggttccacaaatccatcgcgccctcgtgccattgttgcgatcaatcttcaggagatcctgcaacagaactgcactagtacgaaattgagagatgtctgcgtgtgacactgttaattaccaacatgagtgagaaagcatgtaaggagcctagcctagctatatgatgctcgaattagtatagtgcagaaccaaagaaccgtcatacaatgtcaaggttgcgcttgattgagagttatatacgg

SEQ ID NO: 12893 - DNA, 582 bp, Oryza sativa
aagcgcctccccgctccaacaatggtggtaaggatgttattcggggtcgtgtgaaccatgtgacggccgaggacgtgctgacaactccagacgtcatcgttggtacgttcctcatccattccatccctgctaccattttgttcgactctggagcttcccactcgtttatatctgtgccattcgtggggagaaatcagttgggggtagaaaggcttaggaaccctttgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgtgcgagacgcacggttactctgtaccgagggccggaacaaccggttgttttctttgcacccccaacctctgtcagaagttcagaacttcatcagatagtactgtcagaaatccccatcgtcagagagttcggagacgtgtttccggaagaactacccggtatgccgcccaacagggagattgagt

SEQ ID NO: 12894 - DNA, 417 bp, Oryza sativa
ttccctctctctctccctcggattcgtccggattcatcccgcgaagttcgccggcgtcttcaatggcgcccgagatctccgcgcgcggtttcctctctccccggccgcgctctccccctcccgttgctatatattcgatccccgtgcttcgctcttccgtttccgccgctcgccgctcgctctcgccgtcggtttcgtgcccgcgccgtgctcctctctctccgccgtcgccgccgaccttcggttcgccgccgacgtcgctccggtcctccgcccgactcggcgaaacctccatcggcttcgccgagtggttgccgaccccgtccgccgttcggtttcgccgccgaccgtcggagcgccgccgtcatcgtcatccggagccgcgccgccgtctccctccgctccggccgccgttct

SEQ ID NO: 12895 - DNA, 1229 bp, Oryza sativa
aaaagaaagaccatacccagagaatgtgtgtggattatcgtgcattaaacgatgtgactatcaagaataagtatccgctacccagaattgatgatttgtttgatcagcttaaaggtgcccttgttttctccaagatcgatcttcgatcaggatatcaccagttgagaatcaaagaggaagatatacctaagacagcttttaccactaggtatgggttgttcgaatgtactgttatgtcttttggacttaccaatgcccctgctttcttcatgaacttgatgaataaaagcgctgtttaaatggaaatacctagacaagttcgtggtggtctttattgatgatattcttatctactcccgaaccaaagaagagcatgaagaacatcttcgccttgcattggagaagctacgagaacatcaactgtatgctaagtttagcaagtgtgaattttggttgtctgaagtgaagttccttggtcacgtcatctcagcaggaggagttgccgttgatcctagtaatgtggaatccgtaactaattggaagcaaccaaagacagtttcagagattcgcagttttctaggcctcgcaggatattatcgaaggtttatagagaatttttctaagattgctaagcccatgacacgactgcttgtcacgaccggaaataacccaacgggcgttccttacgtgcgtgcattaatccttgtcccaggaggcaaggtacaccaaaagttgatacatttcagagtttaacaagcggaagcgtaaatagttaatttattacatgggcagcgaaggcccagcacacacagagacaaacgagaaacagcggaagactagggcgacgaccacaggcacttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaagggttagggtttgcagtaaacagcatttaaagatatttagttgctcaaagctattttgtaaacacgattctagaactatacaatattattaatcaaggccgtgaacccacacgaacctgccttaacccaaggcctacgatgattcagaccgaactggcaacccgaccctgggtcccagctcgtcccaagccaacccaggccaaccat

SEQ ID NO: 12896 - DNA, 524 bp, Oryza sativa
agggaagagaagagaagagaggagaggaaggatggatcaagtggtggtctaggccaggtgcacaaatgggcggctgtggaggagaaaggagacgaagtggtgtcgctcaagccttattgaggacagaaccattgcccatggtagaaaacttaactatttgccattttttcgtttggcaattatccaagtacttctcttaagtttacacatactaatttaccattggagagagaagaaatcttaattttataccattttttgtccacgtagcagaataatccgattgccagcatggatgatggatggtgtgaattatcaattttgccctcaagtggaccccacgtgtcagcctcttccctcatcctccatctcttttctctctctgtttactgcctgcgcggtcgccaaatccaccgccccattatcagccttggatgccgccgccaccatgtatatcagtgactccctgcgctgctgcacagccccgccagcccacgcacacaagaaacctcacggaaagcaaa

SEQ ID NO: 12897 - DNA, 1652 bp, Oryza sativa
ccgcccatgtaataaagtaactatttacgtttccgcttgataaactctgaaatgtatcaacttttggtgtaccttgcctcctgggacaaggaataatacacacacgtaaggaacgcccgttgggttatttccggtcgtgacatttgtcaaccgtgggtaataaatcgactagttcatgttacttatgtgacctagctagaactatatgcttagccctgcttaaataacactagctcagttgatgggataattacaatattagacctttttagtatcagaatgagctgcgtgctcgagacacctggccatgcttcatggtcgtaattatccaactaaaatgcgactgcatgctgggctgtgggtgcatggtttcgctagtcgcacccatggcaattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaacccgaaggtgtggtgcgatcggttagagggggttatgcgaagggtcctgtcacggcctctttccggtatgtcgtgttggcatgtcggcgcacggaaacgtgtcgtggggctgtgtcttgtgggtgtacagttgtacacctctgatcagagtaaaactattcgaatagccgtgcccgcggttatgggcggtcgaccagattcaccgtgattagtcccaccttaataaatcgactcaatgcactgaagttcaggtgggttggttgggcctgttcaacgtggtgtagcgttgatcagtggagattttaatgttactttaattactcaacagctttactgttttgctcaataaaatgttttacaaccgcctttatgcaaatagccacaaaccgtcattgtatccctttgcacgtctgcatcattggtgtggcttgctgagtacggtggttgtactcagccttgctattattcccccttttcagaagtgtagtgcttctgagctgaagacgaagttagaagaccaaggctcagaccccagttgagtttttcctgtggagtggagctgaagtctcgctaggatcgcctttttccgctgctgtcgttctgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaaagaagcaggatgcagattgttgtgtaacatggccaagctaagctaaatgtggaggagcaaagcatatgctctagtctctctattgcttgatgagaagtataaagctgaaaagatcgaagatgtccccttgtgataatgagaaacttgaaaaagggatagtgcgtggcctcgtgctcgctgcatgtgcaccgtggagcggagcctcgcggcgcctgttgttggtgcgcaaggacggggacgaggcgaccacggcggtggaggagaagaacgt

SEQ ID NO: 12898 - DNA, 1314 bp, Oryza sativa
  unsure (1)..(1314): unsure at all n locations
caggagcgtgttgccccttacggtggcgacggcttccaggtccacgaggagtgccttcacaagccaactctcggcatcaccggtggccgtgaggttgggaagaaggtggtgattagtttggtggcaaggtctccgcctctggcgatgccatcgtgtgcgtcggtggtgggtttggcgatgacactggccatctagtttgtcttgtcacatagacaaaagcggcatacaattaagaatcctttttctcccattactagtaagtagaaacctaaaaatagtactccctccgtttcacaatgtaaatcattctagcatttctcacattcatattgatgttaatgaatctagacatatatatctatctagattcattaacatcaatataaatgtaggaaatgctagaatgacttacattgtgaaacgggggaagtatttggataattgccaaacgtaaaagtggtaaatagttaaatttcctacacacgccgctcaggaaagaggatggagaagagatgagatggatgcttgagctcggtgtcaccgtcgccgcagctcggaaggagacgatgtcacaaactcacaaattcctcggtgttattttttagcattttcatttggacttgcggggagctcttagggcaatagcaatgcaaggcatgcatagagtatctttagcccggctgaagctgtcaaatcggcccaaggccatcaactcaaacagtacttgttacctttttagtgtgtctctagtgtccattcctgctgtactgaagtgagacgcagcgtctccatgtgaaagatcgaggaactcagtaggggcgcgcaagcagtcgacacgtcggcgcgagtccgaggtaaggcaactcgccacgtaatgcattggggnaaagggcccctttngtgggcttgggattacagtcacgtgcggcccataggccttaactgactgacagcgattctcttgcggcccatgtaatatggcccgaacaggatcgcgactgattgcaggccagacagtccagcccagcccaggacactttacggctgttttccgtgacgacagctgcattttgtctccatccatggctactccatcctgcctagcttgaatgctggaccgatcaggtgaggggaggaaccagttgaaggccagtggcttggcgttggcgttggcattggcattggcattggcaactactgactgcatcaacactctaccaagaaacagctttgccatgggcatgtttggtgcacctatttgggttgacgcccatagggtgttcgacgaaatgcctctgcgacaggagcctttgc

SEQ ID NO: 12899 - DNA, 215 bp, Oryza sativa
agctcgccgtcgacgtcgcttagtccgccgccgccgccggccgggttgcagccgcgccgccgcgtcgctttcgccgttgccgcggcttgccgtcaccgcccgtaggtgcgccaaggggtggagaagcctggccgcccgtcccccttcgccgccggccaccggagagccgtcgccgccgttcaaccgagccgccgccgcctcttgcgtcgtcgccg

SEQ ID NO: 12900 - DNA, 715 bp, Oryza sativa
agccggagcttcgctagattttattttccgctgcagttttcttcaagatgaggactaagtgccttataagtaagtatttatcgttttagttaatttgatgaatctgtatattaaattgtcagtttgtgtacctcggttgattcctggacgaggatcttatgcacaaataagttcggaaattactagtgaatttccgggcgtgacaggaaccatgtggtgtacgtgcaggtctaatgacgacggggtcgtgagcggtgaacataagggtattcatagtgcgtcccacacaatacaatacaactatcttaacataccaatacaaaacaaaaagactagaatatccttactttatcaaattccaatacaactatttctcactttatctattcacaatacaattattctctactttcacaaactccaatatactttcacaaactccgatgctacgattactctaaaaatgaacttttattttgggacaaatgaaagaaattaaaaatgaacttattatgagatggaagaagtatatagtaaccaacaggatgttgagagcccaaacgtgtataaaatcctcgtgtactgttttgtttgatgtccatgcttttgctgatcatgaccttctatcaatagaccaggacaccaatcctcaccaggtataatatgcatgtatttatactacccaagtgagagagccatgcatatataattgaaa

SEQ ID NO: 12901 - DNA, 238 bp, Oryza sativa
acgctggcacacatcacaaagggccacgaactctacaatttcccgcttcatactgacccaccagtatttctccttcaagtctaagtacatcttcgtactgccagggtggatggaataaggactttcgtgagcttcctgaagtatcagctgtttaagttctctgttatctggaacgcatactcgatttccgttccatagggttccgtgttcatcctctgtgaaacccgcagctttaccc

SEQ ID NO: 12902 - DNA, 1905 bp, Oryza sativa
  unsure (1)..(1905): unsure at all n locations
tgtaacaaacaataactttcttacactcgggttcttcatcttgtacttgatttctcagctgctgtattggaacttccaaaggtacaacgcagatactggcccctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtgaccttggcggggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgaccgatttctccacaacgagagcatgccttaagttctattttattctggttaaagccttggggagacttcgcatcttcatcatctgaggagacttgatctgaatcttcactaccagacactctacctccattagctaaaagatgctctgtcaactgttgtgcacctcgggaggaatttcttctctgatgttttgtcattcctggtggaggccattctgtgctggtaatgatcatcttacggacttcatcttcgttcgcattcgtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacttgatgttgcatctgactcgggttcaaaattggcatccgatgctgctgtagtatctctataagcaattggttctggttaatcaggtgttggaccactgccacacaactggtgtctggtgcttcattcactcgggagcttgaagtaccaatgtcctgacttctgaccatattgcctttctcattgtcagccatctgttgcaaagtttggagagggagagagggaaaacaaaggggagagacagattagaaactaaggataggaccttaacagatttaagtctttggctgttatgatgtatgttaggcttattctgcaagttgattaagcaaacaacctagcatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctcacttcactagcggatcctgcagtcttccggagcttcggcaaacaattgacgacatcttcttcttcgcaaagctgaccatctagtactagttgaaattccgaagaaggaagaacggagtaaaccttntgcaaatagcattaggggaaggagaaaaaggaactttcgcannatagttttattcataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacaca

SEQ ID NO: 12903 - DNA, 1464 bp, Oryza sativa
agccaaaaggtgcatcctggtccaagtcaggtgaagagaagattccatctgcaacaggagatcgagccaagcagttccgagtggtaaagttttgctggaagttcgtcaagaagacgcaacggaagaagtcagacaagaagagaagaccgcccaacctatcttcttgctagcctcctcgaatctcggggacgagattcttgtaaggggggtggatttgcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggagggattgagcaagaatgagtacaaccacagtactcagcaagccacaccggcggatgcataattaatgcaagggaggtacaagggaataataatagggattaagttttgcagtaaacagcatttaaaagtcacttagttgcccaaagccatttataaagacgatcctagagctacacagtattattaaacaaggccgtgaaccctcacgaacctgccttaacccaaggcctacgatgattcggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtcggtagtgctttgcaacagaggcccgagcttaatccttatagtggccggggtgctacttcccataactggcatgcacccaaaccccaccgaaaacaggttttaggggttt

SEQ ID NO: 12904 - DNA, 642 bp, Oryza sativa
tacccccgttaaacggaatctcgaccccgagattcggaagaactggcgaagagatcgggatgggctgccttcagctcgtcttcacgctcccaggtagcttcttcctcggcgtggctgctccactggaccttgcaaaaacggattaccccggttctggtcctcgcgtccatggtgttcaagatttttcctggctttttccccgagggcaagtctttccgaaccttaatattgctctgagtcggcctgcttcgatggcactcgaaggcatttcttgagttgcaacacatggaacacatcatgcacgtgcccaaaggaggcgggcagctccaactggtaagcaacttctccgcgtcgagcaatgatacggaaaggacccacataccgaggtgcgagcttcccctttgtctgaaacctgtgtacaccgcgcaagggcgtgacccgaagatacacaaagtcatccactgcgaattccaggtcacggcgtcggttatctgcataacttttctgccgggactgtgccacctttagattatcccgaatggttctgaccttcgcttcagcttctctcaggatatcagtcccgaacacttggctttccccaacttgatcccacaatagcggtgtccggcatttgcgtccata

SEQ ID NO: 12905 - DNA, 1041 bp, Oryza sativa
gataactgttgttgtacgaaaattctgcataaggtagattcttatcccaacttccaccgaaatctaaagccaagctctcaacatgtcttccaaaatttgattcaccctttcggtttgtccgtctgtctgcggatgataagcagtgctaaagttcagcttagaacccatctcttcctaaagtttcttccaaaaatttgaagtaaactgactgcctcgatcagacactattttcttagggacgccatgcaaacacacgatccttgccatatacaattccgctaaccgacttccggaataggttgtctttaccggaatgaaatgagctacttttgtaagtctatcgactatcacccaaatagagtcatggcctgatgacgttctgggtaaaccagtgataaaatccataccgatttcttcccacttccattcaggaatcttcaaaggctgcaacaaaccggcgggtttctgatgttctgccttgactcgctgacaaacatcacatactgctacgtattctgcgatttcacgcttcatacttgcccaccaaaatctttccttgagatcctggtacattttggtactaccagggtgaatagagtataaggtatcatgagcttttttcagaattgcatcttttaaatctttgttgtcggggacacagattctctcgcccaaccatacagttccttgctcatcctccaagaaaccgatagcttttcctcttctcatattcttcttgatttcttgaatatcaggatcccttaatttgggcttctctaacttgatcaattagagtgggcttcgcttctaaggctgcaacgaaacctctactgacaatccccaaatttagtctttcaaattccttgcataactccaatggcaactgtcgtccttccgtagcattgcaatagtcttttctgctaagagcgtctgctacaacattagcctttcccgggtgataatgaattcccatgtcataatccttaattaattccaaccatctcctttgtctcatgttcagatccggctgagtaaagatat

SEQ ID NO: 12906 - DNA, 1556 bp, Oryza sativa
ttctcccggttcggcatcgcctccttcgggttcgcgcgacctcgccgacctcgtccacccctccgtttcgcccgccgaccaccggaacgccgccgtccccgtcaacccgagccgcgccgccgccttcctccgctccggtcgccattcccgtcgtcgccgtcgacccggggtgagccgtggaccgctgtttcgcttcccccttcccacccctctctcggccgccgctccgccgtgcctatggccgccgccggcgaccataggggcgcgggcgcgccgcctcccgtcggctgtgccggcgtggccgccttcgggcgcgtcccgcggctgccatgtggggcccggccgtcagccgcccgcgccctcgggtgcggctgacgcgtgggacccacgggcccggccggcgtaagccgcgtgcacccagtccaccgtggaccgtggggctgccgcgtgggccccactcccgtggacccggtccgcgcgcccctcccctcggctgacgcaatagatccgattttaaattaaaatttaaatgaagaaattcgcaaatatccattaaagagcatataaacttcaaatggccataacttggccatttgaactcggaattggaccgttcaagtctctaatttttccttaagaagtcaagaacccatttttgtgctttgtttctgcttgttgtatggggtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttacaaaattatgttgatttaaattattgcattatcgctttatttaaattcccgcgttatcactgttttatttagccatgcctatttacctttgttatgaccttattattattgttattgttattattaccttattcaccctagaataaacaaaaccccaactagtggacactctactcatagtaccactagtataattttaggtagatgcttcgcaatttaattaggtaacattaggcggtttacaactctagactttgggaatattcatatcacctggacactttggaatggtttggttgttgtggaattggcttcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtgacatctctagggcaaatgaaggctacacgagctgcggcccggtagtcgagatgtcatggcacagggccggtgtcctgctgctaggggctcagtcctgcctgcctgtcccgggggttccggccgtaggtgggatcgggtcggtactcttgtctatggctaggatgggttggaaactatgtcccgtcttccg

SEQ ID NO: 12907 - DNA, 228 bp, Oryza sativa
tcctgctggtttttggtctattctcaatttggctaggaccaaagcattgacttggcccccttggttaaaaagacaagaatgccatctcttggaactctggattctgactgtttaaagatggggtcagttattggcttatctctattagcaacccacacagttgtgaactttgggatattgttgaaccatattcctaggtaccagttgggcaaggtggtgttgtctgat

SEQ ID NO: 12908 - DNA, 707 bp, Oryza sativa
gctatggatgaaacccgtgcggagactgtgttagcagctcaagatcgtgaagatcggaatcgtggtaagatttgcaagctagaagacaaggtggatcgtttggagaaggaactagccgcattgaagggagaagcaccaccgcagaaggccaggattcatctcaccgcaaggaagagagctctatttgtccctcgctaccaattggcgccaaaggttcgtgtggtggagaaagaagttgccccaaccttagcagatcctccgatcatcatcataagtgatgatgaagaagaagaatccaagcgcacccattccaagattgagtgggtagcaactcaaatgatgaagacagcagaacgagccttcaatcgacctccgatgctcggaagaactagagtgacttgtcaaaccgttgtcttagatcgttgtgttagtttgcttgttttaagtttgcgtgtgtgtggctcgcatgtgatttacatcagtgggggggatgtaattgcatgtgtttttttgagtttgtttgctttcgagtgttaggtagttggtgagtttagtggtgtgggagtcttcagtttgtaataatgaaactcacttaagatcaataaaagttaaagtaattctcggtcctaagtagttttccccgatttctcttcttgtgctcctgtccatgccagatggtgctcactcgcagcaacgggaatggcccc

SEQ ID NO: 12909 - DNA, 1268 bp, Oryza sativa
acccgtcgccacctttgctttcgcctctcgccatcggaagagccctagcgccgtgtaacctcgagccgccgtcgtcgccgtcggtccagccgtgcttcgccgtcgctccagccgtcgccgtcgctcggggaggtcgccatcgtggtcgccaagtcaccgccgttctcgtccgcccctccgccgtcgctgttgaccgccggagcaccgtcgccgtcgtcaagccgaaggtcgccgccgcttcttcctcgacgccgtcgccgtccgttgattttccaccgttgctttggtcgccggtgagttcgtcgtgcagtccgctacccgtgggtgccctccgttcgcgccgccgcgccgtcgttcgcggcgagcgtgtgcgcccgagctgccgagtcgccgagccgccgccggaggtgacgtcaccgctgacgtcatcgtcgtcgtctctcgtgagccgccttagacccgatcgatctcggccgtccgttttggatggatcgatcttggccgtttcgtttccccgtgaacccgttgccgtgttgcccggtccaccgcaaaacccttagccgctgacgcaataaatcccttttccttttcaaaaataattcattattgcgtcataattcaattaaaatccatataagtgttttaatctgatttaatcttcaaaaattcataactaattcatcttagctcggatttagttggttcaagtctctaaatttttctaaaattgagatctacatgttaaaaatatccacatgtactgttcatgcttgtttatgtgctattttggtgattttgctcctttttgtttagattccgacgtttccggagagtctgttttcgcaggagaagaatttgaagagttccaaggccagcaaggcaagtcacacagatcccaaacaaccctttgagcatgctgaacctgtttaaagctattgatttatttcaacttatgcattgttttctgtcacgcccggaatttctatccaaaattccaaacgctttcatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaataagataaacggcgcagacgactccactccacaggcagcttgaccaaggctacacctaatccttcacaccatcagcatcattgtagaactcttcctctgatgaatgattg

SEQ ID NO: 12910 - DNA, 1391 bp, Oryza sativa
  unsure (1)..(1391): unsure at all n locations
aagacattgttagacccgcccataaccgcgggcacggctattcgaatagttttactctgccagaggtgtaccactgtaccccaagacacagccccacaacatgtcaccatgtgcctcaataccaccacagtacctcggaaaggagctgtgacaatacccttcgcacaacacaatccaccacagggcacctttcctggatcataatcacccccttataaacaaggcatggactccccagcaacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttattcccaatagtgaatcataagttatcccaatagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggatcggcgagatcgatccaatccaaaacggacggccgagatcgaacggtccacgaccggctcacggcggacgaccccgatgacgtcagcgacaacttcagcgatgacgtcagccaccgcggcgactcgggtgggttcggccccccatgctcccggcgaacgacggctctacgacccgaacggagggcaccaacgggtatagggcgacaaggcaaacttcccggtgaccaaaccggcggcggaagacaaccgacggcgcctgcactaggaaaaaacggcggcgaagatcgggtcgacggcggcgacggtgctcccgcggtcttcggcggcggtgaaccaacagacgatgaccgcgacgacttggcgatcccgacggtggcctttccgagtgacgacgacgacctaagcgacggcggcgcaccgctggaccaacggtggcatggcggcgccnaagctcacggggctagggcgctacacatggcgagagaccaaggccagggatgcggccggtagaggagacaccgggggtccttttaaaggggctaacaggcggcggctaaggcccatggcggccggccgcgagaaggaaacttcgggttccgggagagagagaggaatcccattcgatct

SEQ ID NO: 12911 - DNA, 2036 bp, Oryza sativa
tcacatctaatactaggttgattttttttgatggagaaagagtagatcactagaatgaattaatcgatctggtagtggtatgttaggatcaattgattagctaaactataataagttgtctcccacttatacttattaaatttacctttgttttgccgcacgtgaaactacacatgctcaaagccaagttaattggctttttaccgatcaagcgatgttaatttaccgcacatttgtggagaaagcgtttgtagtcccggttcgtaacctctttagtcccggttttcaaaccagaactatcaatccgggactaaatatcgctatctttagtcccgggtgaattgagatgacctttttttttcatggccctgttgctgcatggttaatatatatatatatatatatatatatgaacaaaatatatatttacattaaagaaaatgtgtacatgcgtatagaaaaatagacatgtattatttacaatccattatgatgtcctagctagctacgatttcgatgagtagtagtcgttatctcagaagctaaggacctatgaattgtatttccgtcgtagtagaattcacccttgggatcaaggatttattcgttgatgaatcccatgagttattcttgaaccgccgcgataaattccttgtgtgtgatcagattatccctcatgcgaataaactatatgaatgtatgaaattaattagtaattaaacaacaaatcgatacgaacgcagtgaaattttgaatttatttgtacgtacatcgagctctcttgtggtgatgatttggtctgcaaggcagtggtaatactcgcacacgtagtagccgcacaaattagttctctgcttttgctttgcgcacaataaataaatgacaaacggcgagagatctaattaatatacacttattaatatacacttgtatgtatttgaattggagattgaatataaatgtagagcatgtgtactcacaggaaaattgaacttccgcctaagtctttctctccatttgccgcggaccaaatgacggaaccgataccaagccctatatggagtttaaagctatgattcgtagtagcaattaattataacaagattcttaattaacataggaacttatgacaatacctatctataagttcgaaaaccttgttaaacggtagacttttttttatccattgagtcatatacattgacggtgcaggcctccaggtcgaagagtaaaaggacccaatggaatctgcaatgtgcgtgggatgcattacacatgaaacacttagcatgttcgtacgggaatgaaatttggtataggaagacagtaaaaactaactctgtgttggacggcaatagtataaacgtcttgtaatgctgcgccttcaggagatggatgagattgtcctctgtggcttgcggatactggtcgagcattgcgacatttactttccaagggtcgatgaatccagtatcgaaaaccccccgccgtcgggccctttgaatctctattctacaacgataaaaggaagtatatattatatatagtctacttatatagaaggacctaattaattaaaggaaacataataagaaatctaactgaacgatacttacaaaatccagcaactcataatagagacgtcgagggcgtccagctggtatagttcgtagatacccttgaaattgatccagagaatgtcatctccttgcaagaagtctgtgtccctgatcctcgctccgatcatctctctaccggtggcgctcatctccatgtacagttgatggaacttgtacatttgtgtgggtagggactgcagctgctcaggctagacaagcgatttaccgagttcgtacatgtatttcacttccgccttttcgattggtgcgcctcgtagcaattgatccgtagttagcctggtgtcattacacgcgagtggaaacaactacgtactgcgcagtatatagttacaaatctcagctcagctcagattctcaaaaaaaaaagaaagaaagaaagaaaaaaactgctaggcg

SEQ ID NO: 12912 - DNA, 2914 bp, Oryza sativa
ggccctccgcgacccgctgccctcgcgccggcttggcagtagcgaggagaaggagacgagaagaagaggagaggaatagagataagaatgagaagaggagataaggttgaagagatgagttaaaaatgagaggaggagataaggttgaggaggagagaggagttaaaggagaggaggaggtacctcgatccgatcgtgcacacctctccgatctccgcgtcgatctttactcccggttggttttaccaaccgggactataaatagatctttagtcccggttagtgttaccaaccgggagtaaaacatatggcgatcttttttcccggttgatgttatcaaccgggactataaatagatctttagtctcggttggtaacaacaaccggtcctaaagattgaaaagtatcctgtagcttttaaaccgggactaaagatatttttagtcccggtttttaatacaatcggggctattgtaaaatctggttgaccgactaaagatggtttctccaccagtgtaattagcgcatcttttgatgaatatacacattttgtttctcaatgacacagtgtcacaacgagtagcagccggtgccctgtgacgccgatctatgtacatgaaggtcatgctggatccgatatcgctaattagcgatcgatcacctggggtgattgttcttttttcatcactttattttttttcaccatatagtttttcttttcggataagtttacatatctaaagtttatttataggtcaaaagtttatatatatatacctgatttaaatttaaatttagattttgatgtttttatatagaatatttatataaaaaagtttatacatacatatgaagtttactgtatatatttataagtgtaaagtctaaagacatggatatatttttaagggacatggatatatttttaagggtattattttgttttttaaatttatttttttatttatggtgcagtaggaagggaaaaagaggaagaaacgtacgtgttagggggagagacgggggtgcccgatcgctgtgggcgatcaccagcccattagcccttccccggctggatcgatcgatcgacgaaaatattgactgacgcacgtgcgaaattaagaagcacgacccaatgcaaatgtcgtcgtcatccatcgtcgtgcatgtcacgtagccatctagccgacatgcatagtactaatatactttgattaattagcaaatggattaatttctctttcactaatccatgggcaacagtatacagtacgatgatcgaagatcaaactaccacgaattaatgtagtgtcttttgttcgcaaaaaattaaatacacgcgcacgatcacgtacgtcatcacgtacgtgtgctagctagctgtgacttgatggatcgatcgggattgggccggggagttggtcaagattcgccatccatgcaggcatgcgcgtcgatccatcgtgccgtcgtcggcgtgcgtacgtgcatggtggccgccgctcgtttccattccgcgtcgcatgcatgcgacctactcctccgtcaaaaaaaaaaaataatcatatccataaatctacatacacacgtgtcatattcatagtaagtagttagaatttatctttttccatagcagagtagtagttagcactgtgctactctctctcttcctccccctctctctctccagctcaacatatatcatgcatatttccgccgtgtcactgtcctggccggccggggccctcaccgccggcggctcagctccctgcgcgtactactgcccttgatctccagggctgtcccaagctaagatctgggaccctgtgctaaatataaattaaataagacctcatacgtagtgttgataagtactgtttactgggacaaatctatagtataaaggccagagtgtcagacaacaccgatgactttcgataaaacttatagcgaaattgtttgtccatatactataacaccatgatctaagtataattagcacactatgacactaatagacacgttataacactaacgcatcaatttttttggatccgccaacttagtaatggtgatcttatatgtgtagagctatgccaaataagattaccacctaattaagtagtggcaagctggctagttaagtagaaaagaatcgccgcatcaattcagtttttctaactagtgtaaaagtgaaatccttattacctgaaacgcatgtttacattatcgtcatgaagtaaagttccttaatgtacctatcattatcatctaacacttgctagagccaagaagaataaatctccttctagcctaattcaatgaaaccaaaagagaaaaagaataggttgaaaagatcctaaacattatcgctcatctcgcacgtgcccatggacggtcctgttgatctcctagggattcaccaatcaaccactatacctatgtttttttcctcctcaccccctctctcccctcccaacttcaattacactcgctgccatccctcactctccgtctccagctagctctcccacttggcaatcgctgtctctccccttccctcttcagcggtggcggcgacaatgagctcagttatccctctctagcactttctctccactcttcaaagatggcggcaacaagcttcccaaatccattcttccctagtggtggcgaaggcatggatctaggcaagccagcaacaaggaggcggagtgtcaggggctcggagttggagatgagatctaagcgagtgaggtgtcaaccttagtggtagcgaggatggtgcgatgaactgcatagatcgaggtggcgggtagtgtagattgagcattgtggttgtcgttgctctaggcatccttcagcatagatcggagctgccctctgacaacgagctcgccggagtaggccgctt

SEQ ID NO: 12913 - DNA, 13332 bp, Oryza sativa
  unsure (1)..(13332): unsure at all n locations
aaaaaagcaaaattcaaaatattacgcactatgcaattataggagatcttatgggaaaatcggggcagtagtttgtccacaacgaaattgaacttcacaaatagtttatccagctagtgctaaagtaattcaattgcgaaagaatttttttaacatgaacatgaggaaagctgtctctctcaggcgaaggaatgcttgaacacaacttcacctagactttcatccaccaccaacataacatacaatgctgcagcggaattttcaaaattgatcgttattgcttagacagctgtgattagttccaggaactcattcagttcatcccacatcctgcttctcagaagacattatctagtatcttgtgcaaggaaaacaacgatgcttctcggtatctgaaagaacatagtcatagttagtctaacgaaaaggtaggaaaagtatcttaaagatacaaaagaagaaattgtcatgagcagacgtactaaaccatgtaactactgactgcagaaaatatacaattgcattttggacattcatctaactcaagtgcacggataaattggaaagatgaaaagttaatcatagcattatgccctctgctgtccaagctgtattggagaatttgatggtagaagtatgccaatgatcagtaacttaaccacaagactgcaaggagcattcccaataggcataaacaaaaaatacacatggaagatcaagagtgtataattatgtaatacccaccaaagtcagtggctacctaagcacagggacccagtgactttaagagttaaaatgattcaagtgtaatgaagattgctttaaagttaacatccgctatactcttgagacttcctattttagtacatcagactacaaagcatggttttcaaaaaaaaaacatcagactacaaagcatgcattttttctgttggccacaattacaatttagcaagttcaaataaaattctgatttttactgcacagatggtacactggtactgcatgaatagtgtatcagaagatactgtctttgaagccccgatcttctgaaggaagttatccagttcagaatacacataatttcaagttacgctgtatctagacagaatcaatggaactgatggcaatattacatagggctaccgctctaaaatctgcagcattttctattgataacaggggcggagcacaatggaccagggggggttcccaggcacctggcccaatttctaaatttactgcttaccgttaagtttcaccataggggcaccccccttggcccaactcagtgtaccccccgttggcccatacgcagaggagaaggctgagaataggctgctcgctgagatcgccagcactcgtcctcgatgccaggaccgacgcctcgatcacttcgttcgcagagacccatctctctttctcttcttttccttttctctaatcgccatcaggaccactcgctgactcgtgttaatgccctcaggcaacagatccgccgtcatcccatcaccgtcgacatcttctcttacgtgtagctggaggaaccgatcgatcagcatggcaagaagcagttcaatccacttgctaagatttgctcatctaaatatgccacaaaaattaaaggtatcgatttttctcctcttatttctgatctagttagtttgattaatttgttccaagcaaatctcaaagttaaatagcgttgtttgaactatgtgactgtttataattctttttttttcatattagggtttgaacaattcaggatacatttttcatagatcgattgttttttttatatttttttatgtttccctccatggcttcctttcatcttttatttcggtaagcacttttcctcgctgctcactgatgttgtagttaaaagttgtctaggaatatttaaataccattatctagagtgttatgccaccatacatatggcaaagtggtgcacccccctcaattgtgctccagctccgccactgattgataacaccataaagcatcggtcttctttcaaaaagagataaaacataggtagcgttcttcgtgttgcaatatggaatgattgacaaattttaacgaattcaagttaccttagcagcaaaagttgtccttagagaggcgtggtaaatttgatagccttgagaattctattttccagttcattatcagcaatccacacagagctcttcctgcccaagagctccctgtcctccgccctcttatctgctttgagcttctccttctccctccagttctccagcttctcacctcttactttcatctgtacatcatctcatctcagttataaagtcatttcgctgatatttttaacatatcgtaccagaaaaaaaaattaaattagtagattcatttctacaaacaagtaacgtaattcacttgatcctctaaaaaaacccgcacggtaatcgtaagactcccactccggcaattcaacaagcaactcatgtgcaacgggtgatcaacgcaaaagaagggggatgaagcgggactaggagggatgtttacgagggcttgaaggaagtagtcctcgaaggcgcggcgctcggcggcgcgcgtctgcgcggcggcggccttgcgctcgtcggtggcgaggcgggcggcctcggcgcgggcctccgccctgcgctgccgctcggcgccgagcagctgcgcctcgtaggcgtactgcccccgcagcccgcacgtcgcgcgcgtagcccttgcgcagccgctccagccgcgcccacgcctcgcggggatccccagcgggctccccccagctgccgaggtgctcgctggggttggagaactcgtgcggctccggcctcgccagggcctgcgcggtggcgtggaggccccggaggagagggcggaggaggtggcgcggccgggaggacgagagcgccatcgccgacgaggggacaggggagagatcgccgcggcggtggccggcgacggcgagttggagcaggaagcccttcctgtgggccgtttgatcatgttctgatggccagctcggcccatgtaaagcccaacaattttttccttgatgggcttaatctgagaccaatattacgatactgtttaagtgtagcaattttagtgcaacctatattaagttgtgatccaaattcatttgcacataataaaggccagtttctaccggagtgaagcggaggtccgtcgccagaggcttgttacgaatcgttatccttttagggtttcaccttcatatatacctgttataagccgttgttcggtgttgttaacctcaccccgatataatgaagatattttgctggctggcgcccgtggtttttctctcctgttttggaagggttttccacgttaaatctcgtgtcttctgtgattgatctcttgttatttatcgtttatttgcctatcgcttcctaacaacctgaaaatataagttctaactgaaattggtctcaacatattctggaactgcagatgctgcacaagacgcatgcccatccaagatacccttctttcttttcaggattcagaatgcatcatgtacaaacatactaactagtgcaagtctattttcactgtttcagttctgttccggtgaccttattaaacctgatacgtcttcactaatgaattacatggtaaatttacattaaaatgatcagctgccctacacttatacactaaaatgcaggagcatcaattacagaatagatgcgtgtcataatgccaattgtagggattgaaggagcaaatcagcaaagggaatctgatgctacctctgcttacatatcccaggctcatccaattcagttgcatcttatcgacattccatcctattactactataataatctgtgaattcatcgcgttttccaccacctgacaccaattttttagcttttgcatcaagctctcttccagctttccacaggtagttcaacccaacaagcagctcaactatggcagcctcgctcttcttctggtcagcaaaatgcagcgtctgcaggagcagcacacctgtaccgctcgacgcaacatttctctgctcgaaattcctctccgattgccatcgcagcatgttgtgagccagcggagctaaccatccgaggatgcgctgcaccgtgccagaccactctgcagccatggcaggatcacaagctgaagaagaagatgatgaagaggctgccatgttcttggcgatcggcctgaggcgagctctgagagatgcccgaatccgatcggtgagcatgttgtacagggcatctctctcgtctgggcagatatggcgaggcgcgacggcgagcttctcgatgaagatgatgagattcgcgtaatgcagggccagcgccgcggcgccgagtgtcgtcaccgcgggcgcgttcatcacccagttgtgcgatgacgactcgaacactattgagagattcgaatttgtgtggtcgccttggaacggggaattgatgctggaataatcgtcgttgctggctgacacgtagtagctgaagctgagtggaagatcaccatctccatggatcttccacctctcgctgtccggagacctgctcccactgaccatgcagccgatgaggtgcttcccggccattggccatttgagttgtctcaagctctggctcctggagacaagaaaccgacgaacatgttcgccgccattggagaccttgccggattttgcatcgagcaatgatctccggggagtatgtgtatctgcggcgaaatctgaaggatagaccaaggaatgcacgctgccgacgaaggaattagtccatgagaggcgggtggtggcgagcgagatcatggcgtcgtcgtccatggtggcgacgttcttgggctccaggccgaacacttgggcgatcctcgcgacgatggtgaagagcgacctggcgaggaggcggacggcgtagtcgaagctccggttccacagcgaggccgcgcggaggcggtcgacctcctgcctctgctgcgccacgcggcgggcggcctctccttctccgccgccgccgctcgccgcgcccttccgtcgggtgcctgatcggcgcaggccccccgcggccgcctgctcgagctcggcgagcacgtcgagctcctgggacaggagcgccgtggacgccacgagccgctgcatcttccgcgccttccggtccatcttcctcgccgcggagtaccgcagccggtgcgggtcggcgagacggccgccacggacgagggcggcgaagagggcgtccaacctgcggagcagcgggtcggcgcacctcgcggacagccgcgcgacggcgcgcgagaggtcggcgcaggcggccgccatctcggcgagcgcgagggacaggagcgccgcgtcgtcgtcggccacgagcaggcgcacgccctcgaggcggacgcggtccccgcggagccgccccacctcggcgtccccgagcgcgcgccacagccccgccgcgcgcgacatgagtgccgccacctggaacgccaccgcccccaccaccctcctttccccgccgcctccgctcagcttccgcatgtcgtgacgcgacgtgggtgggtgcgtgcgggcagcgcgcggcgcgagtgggttttaggcgaggcgacgaggcgaagcgaaagcataggtggtgtcacgggttgcgtttgcgcggtgggagttgaaaccgagtgaggtgggggggggggggggggagattattcggtggatcgagaagttggggtgatttgggtggattcggcgtgcgtcccgtcgcccagcgctgcgcagcagacggaggggaactattctaacctctcgaatatcgttttcgttatttgcatgtcattatcttttcaatatttacatgtaattaaatagtgaaaggatcttgatatcgtctaaaggggtgaataggcgatttttaaataaatacggaagctaaaacaaaacagggtcggattgtctgatatcaggtcggatagttctatgtgatcggatagtctgaactgagatcagactatctgacctgcacaacaacaatacaaacaagagaacaacctaagatatctagattcaatccacaagcaaagaggtgagctcaaccaacaacaatattagcatgccacaaagcaatgcaacaagaaggtaaagagagtgaggatatcaccgaggtttatgcgccgatgtatttcccggagttctaatccttgaggggattctagtctccgttgaggggctcgcaaagagccgggtctttttcaaccctatcctcgtgaggttgcacaaatggactcctcctttcactaagggtatctctttccttgcggaggcgagatccggccttcacaaacttctcttgaacaaccacacgtagatcggtggcccaagaacgacacctagccgtctaggagtcctcaacctccaagagtaataaacaccacacaactcttggacaaatcctagtgctcaagatcaaaagaaatatacactagactcccaaactccaaattcacacacaaagatccaagtcacaaagaacaagggggatttgagatagagagggagatagctcaaagatccaaagcacttagcacaaagctcaacccaaaacaagatttgaataaaatgagtttgggcaaccctagaaaaggggttagtggggggtttttatagatcccccaaaatgtgaccgttgaaggggaatctttcagtccacgtcggatagtccgatattttaaacctccaaggcaaggagaaacagagaacgaagtttcatgaaatttcggattttccgagacatcagactatctgatattaaatcggagtatctgatattttagaagcaaaaacttcatcttcaaacagagactcaagttccatgaaatttcggagtctctgtatcattggactatctgatccaacatcggatactccgacacttagaaaaactcactcgaaaggatttttcaaacaaagacagagagtgaagttctgtgaaaaatcagatagtccgatacatcggatagtctgatttcaaatcggatagtctaatgttgctcaagcaaaaatgcaataactttttactctgaactccgatttcgaagatcttggactctatggaaagctagtttcgtgggctatcaaacccaacataaaacatggtccaaaaccttcaagagatattgaaaaacttgcaaagaaacccggtgtaagtgttgtgacaagtgaaacaactcgggattaaaaattttggcttaggtttttcaactcacacaaacatgaagcattttgagcactagtatttaaccaattatatgcatgtggtatccctcttaatagtacagcatcctaaactcaaatttaaaaagcaaagttataccaataggagtaccttcacaccatattgattcttcacttggagggttaccaacgtcaaagtcatttgatcatcgggaagatctcatcttcttgatctttgacatttcatcttccatttctcaaatgattaatgtggataatccatggcttcaaatggcctcgcacggttcatcacgacacagtattcactcgcccttcaccaccggtttcggttcgtcggcgccaagccccttgcttgcccttcaccaccgcatggtccatcgcaactgagcgtcgcttgtgcttcaccgtcttgccataggtagtcacttcatacccgcatcttcaatatcttctctttaattctcatccatcgataagtctatttcctagcttcttcataggactaatcacttgcttatacactcaataagtgcattagtcccttaatcgtttgtcatcaataaaccaaaacccactaggggcatagatgctctttcaaatagttacaaaaaatataaaaaaattaataatatatattatgtgataaattactccacaaatatgcagtataaaatttaacttgtgcaagttacaacgaaaacaaatttaactatgagaatacgttaactgatcgtagtttaatttgttttaatttgcatatttgtggagtgatctatcatatacttcctccatatgttattctataacgtcaatgactttttgacttacatttgaccattcgttttattaaaaaaatattatataattataatttattttattgtgactggattatgatcaaatgtttttttaagtatgacataatatgttcatatttgcaaaaaaaatttgcataaaatgaatggttggtaaaaagaaaaagtcaacggcatcatgcactaaaatacgaaaggggtattaataaaataattttattatttcataattatttgataacatgcacctctggaattcaggatccactacccagacggaggcgatgctctgttgcatggctgtgttgtggtgcgggagggagggttgggatgttcgccgcggcgcggggattccaatgatggagagggtggaagcggacagccggttaatttgttcgtctcggtggcaggcctgccactttgatcgcctctttgactggcttatattactgcacggataattacgagtttatcagtagtggagacgggagagtaccgccagtacaatttacaggttttgatgctggtggatttggcgatttccccgtgtctgtgtcatgcggtatgatgtgatgcgtccaaatttaaagtccggtttaattcctggtgtgttggggtaaaatcccgcccaaagtgggtcaatattggttccttcttactagtacagggtgtgcgatacttacaccgtagtggtcaatatcagtgatctaggtattaataagtccaaatatacttataaatcctcttactcaagtatttggctcaattcttcttcaatttatttaattttttgctatatactttggctcattcgattttnactaacccaatgatgtactttgaattatttatgtcagttttggatcaccttcgataacaataagtcgtatacgtttgtagtatgaagtatcatgaccctttcgaccaattacaataacaagtttgacatgatgctatataaaaaacaaataaaaaatatgttaactctcatgcaagacttagcttttcacatatttcaaagtaaatggattaaacaggtaaagagagaagagaagaaaattaaagacaacattatatatcatctattatacatatcagtttcaacattagtttcaaccttatagctaatagttagctctactattaaactcgttgttaggtgctacaagcctacaacataatactccatccgtttgaggttagtttgaggttataagacgttttgactttgatcaaaatcaaactactttaaatttgagtaagtttatgcacaaatatagtaatatttataataccaaaatagtttcattaaattaataattgaatatattttcataataaatttgtatcgagttgaaaatattattttcttttctacaaacttagttaaatttaaagcaatttaactttgataaaagtcaagacatcttataactttgaaacggagcctcctaaatccgaactgatccaaaacataacgtcactattggccctgataaatgataacgcatcatccttcggaaccatttcactcggtggatgcctgtgcgtgttgttgacctatttgactggctgcagagatgattgcaatcaatttttcaaaactagttttgatgtaagaggatttggcaatttgccggtgtctatggctaatggcatcatgtaaagcggccaaatataagatcatttctaccggcccaagtaggttggggtatagtaccagactggtccagcttgacgaaagaaagaacagttaggacttaggcaacggcaagctttctactatataccagtagggtatatataactataggtatgttggtctgaaaatgtgtgcaatactagaacatttgactacctgttaagagaagggttaaagttttaagcctcaaacatcagcgagctaaaattaagttcaaagtatatatggtaaatcactaacccttccagagtgaatgttgaatggccgaatgattatgatagttattcgagagcggaaatgaataattaagtattatagagttaaaaataaattatatctcagagagtcatatatataaagttattaaaaaatacaccatttagaattttaaaaagcgtgagcattttatcattccattataaggtgagaagagcgtagagtacagaactagctcattcgaaatcaagtatgtaactcgctacagcttaaactaatatagtgatgtatgaattcatgtcagttttggatcaccttcaataaaaaatatacttttttatatgttgctacctacgcttcctaacagatccaaaacctaacatcaccattgtccttgatgtatcatcctctttggaaccattcagtagcggtgcaccgtctcaccggctcccctgctcaaccagaaacttcttttttttttgcgggatttaaatcgttagtgatccaaacaagccataaactaaaactcttcttcgtcttgtttgttatattaaacctcaacaactttctaaggttctatttaggcctatttagcaaggctctaactctaaatttaagttaaagattaggtctaaagtaacctaaaccacagcttcacatctctagtttattttatgatagcactttaaccagttccaattccattttagatagagctagaaatgttagttggagctagagcgctctaccaaacaaacccttagaatagctccagatcttatatccatgttggatttagagtttgtatattaaattatagtgatttaaaactttatattttatataaaataaaaataaaatgatttatatagatattatcaatgatccagatctatgaatttgtagaactaggaatactcagctctaagaaatatttgagttgtgcctaacatcccctaaatcttgattttccatcgaataacgcaacaattaattccctgtctaccctcctcccatctctctcgttttcataggagacattgtacacatatttcacagaaaaaaacacactcttggctcaaaataccatgctgggatatcatcgatatcttcattcttcatgaacagaccatgcaaattttaacatagcatctttcctcccggaaaatttcacgcaccaattcgaaatgaacgagcgagccatgcggcctcctgggcccatccggcccactgggccggagaatcggtccaatcccacgacgcgatcacgccggcgccgccccacccccaccccacggtgaacggagccgcggccgccggcgatcgaggcgggccgccaccgccggaacggcagaaacccaccattgattcgccggcctcgtcaatcgcccggttccgttaccctcatctgcggcggactgtctccgtctcctccccaagtcgtggacggacgcggcgtcgactctcaaactcctcggctaaatcggtgagacggtgaccctctccggcaatcacttcccacaaactcctccgctcctctcatcttcatgcttgatactaacacagtcactcaacattgtagcgaggttgatgatgctgatccggcacgatcttctgcgtaatcttgttctccgatgtctggggaaatcaagctaggtgttgccggtacgtatgctggtctggatttttctttggggtggcagcaatgcagttcccagaattcgttatgaaattctctcgcgccgaatttaaaattcggtgttctgccgatcattttgttgccatattgtgtttgtgtacttagcataatggttcggaaatcacaggttgatctggaaatgcagcaatgtgtttgccaccctgaattcatcatgatgactacatttgtttcccctttctaccactaacctctagagctaagatgaacaccttttgtgacttgttagaagcatgaattttactgatgatagcacctgtgaaaacactaaggattatagaatgaataatggaaggatatattttgtatttgcatatgaaatctcggttctcactagatgcttaattgaagttgttgatcttggaccactctagttcagtagttatgtttgtttatattttaccacacatgttgcttgcattgtgtattgcggtattacctccgttttgttcagcggagtgatttctgaagttttgcgtcattcccagatctgcactatacatagatcagtttatttattttgtttcagatataaaataacattagtttcattgttttgtgtcagtgaaagccgtatcatagagtcctcatcctcattatgttatttatagaccaatattttttcagcttcaagtcagggtgtgtttagatccacgccaaaattagaagtttaaagaaattggaacgatgcgacggaaaagttaaaagtttgtatatgtatgaaagttcgatgtgacgaaaaagttgaaagtttgaagaaaaagttagaatctaaacagggcctcagttggaaagtacaaactactgtatattacattgaagtcactgaaatatttagtaattgggtgagcgcgatcgccacatgtactatatacatcggcaaggtaggaggtaaacaaccttttgcttttactgtgaacatagatgcaaacccacaggtatgtgctccacatttcattgaatatattgtatactcgaccttagcgtgaatctcaaaacaatactaataacattttgaggaaatctataatagctagcgtgatagacatttttttttcacatatatatcattatcataaagaaggtatgcattttctgatctgaagtcatgaaggatttctcttttcttgagttaacatcgatctgttaactcattcagtaatttttgtattgtccccagacctcagccaagtgggggagcttgttggctgggaagggtgcttgaaggtcatgtgaaaggttagaaaaagcatcatatgatggtactctaggtctgaattctctgtttgttttcactttaattattatctggcagctttataattttggttcccgtattgttttcacttctttagcatattaaaagttgtaaacaacagaggtgtgctagctgcttcctctcgtcctgttttcttttatatctacaataggcttgcaaaaaagtttgagatcagaattccccccttccttgtgttaggataaaataccaccatcatgcctaatttaatcatgaaagccttatcggtaatcaccctattagtattactactattaaactttgggcggcgagttttggctccttgtgagtacttatatcaagcaaagagggctatcaattgatccatactccaca

SEQ ID NO: 12914 - DNA, 894 bp, Oryza sativa
  unsure (1)..(894): unsure at all n locations
ctttgggcgatttcgttggttttcatgaggataaacttcagttaaggagtagtctggtagtagacaacaaagtgcacatcgctttgtctgattggtattctcaatgcttgtaaaggggaatggtatgcgttatcagctggagggagcttcacgcctcatgtcatcattgtcgccacaggggaggtaagccataactgaagttttttttttaacagttagcttggcattgtgatttgattatgaaaggatgaacactgactgtttctttggtgcaattcgttggtaggatgtggcggctcgcataatgtccttctcgcagaagggtcctcgctcggtttgcattctcgctgccaatggcaccatctcaaatgttgtattgaaccagcctggctcgtctggtagcaccttctcctacgaggtatgaaatggagttcactccttgcatcgtgtgatagtatgatacttggaaatgttgtgagctaatttgacggctgcctgaacttctgatggagttatgggtatgtctcaagtcggtctattcagtttttttggcctgtctctacctaatctcttagtttcagtatcaccacctttatagtactagatacaataaatggtcttcttgcctaagttgagaaagtattttttctgtaatggtgtcttaagtcttaaccaccttatgcgagccacttttgaagacagatcaagggtgaagtcttcttcccaatttttctatgttcatgatagcacatatacaattccggcagtctgtagtaacatactccctctgtcccataaaaaaaaaagagtaaagtccaccaccggtccctaaacttgtactgctgtgtcatcccggnctttaaactcgcaaattgactgttcaaatcctcaaac

SEQ ID NO: 12915 - DNA, 9310 bp, Oryza sativa
acagttttaattcaaaaacttttcaactacaaagttgtaggtcacgtcgagggatacaattttgatataaagtttgtcttcattagagttcacatgaaaaagttataaattattttttgatataaagtttttagaccgtcctgtttagggaccggggtgacacaactgaacaagttggaggacctaaacgagtgatctgcaagtttagggaccgggatgacacagtcgaacaagtttgaggacctgaacggttgatttgtgagtttagggaccgggatgacacagcggtacaagtttagggatcgatgatggactttactcaaaaaaaatctagaactgtatgtaacatattaatgtgtcacatctggtattatggtgggttttataggacggagggagtatacgctcaagtctgcaaattgtacgcgagtctcaataacgttgtccagaaaacagtcagtgatgcccggccaaaaaaaacagtggtatattactagattagcatgtgatttgtgctaatgtctcccactcccatccccgtttggtagggctccaaactctaactcaagtgagagctagctcctattagagttgaagactcgttgaaaagtgtttggctacgtttcagctctagatatgaaaaaaaaagaaaaaaaattgaaaaaatcgctggccgcgtaccaccagcctaccagccgctcgccgttcccaggcgcttcgtccgccggccggtgttgtcgccaggcgtgccgcgcgccgccggccacacgttgtccccaggcgcgccacccgcccgtggtctccgcgccggcctatcgccccctcccccgctcccgctcccgcagctcggttggcatcgtgaggaagatggggggaggagagagaacgggatgagaggagtgaagggtagttgaatggcattttttataaatagactaaaaaattaaagggtagtaggtattttaggatggagtggagctgtggagcagaaaaacccagctccacccccatagttcattttctaggagtagatctgctagctccactccaaaaaatggaggatctggaccgtttggcacagccccggctccaggtaagttggagttgggagctagagctgtgccaaacagggccctgcctaagagacagagcggctgtatgcctatatcagtgtaggataacaattgaagcgaagttgttacttatcgtacgtgcatacacatttgtgtttacagttatcctcactgaactctaagatggcagcatttatggatatgtggttgccagggctgctttgagattcttcaactgactggctcctttacaattgcggaggaaggcgttcggaggagaaccggcgggctcagtgtctcgcttgccggccctgatggccgtgttgtcggcggtgtagtagctgggatgctgcgagccgccagccctattcaggtaaagaaacaacaacaacaactgaagaacctggacaaaattaatcgatttttcgataacgtaattcagtcgaaccaagtaccatgcttttacaactgaagatagagaacttcgttgttaactctgtcactcatgcatggtagactctgtagccattttttttctctgaagctctaaacacaatatctccatggacaggtgattgtggggagcttcttgcccaacaacctgaagcagcatcagagaagaatgggcctacatccacaaccatctgctgctccggcatttccagcaccgatggctcctcttcatcctcctcctgtgctcacagctgcgatgcccatttctcaggcagctcctggcaacaatggctgccgttcgccgcaggtttcgatctcatccatgcctccacaagcacatgccggtgtggagcagagtagaggcgccatgaacctgaattcatcgagctccagtactggtttcgccatggttgggtggcctgcagctgcaagctcgcagtccatggtgcacaggccttcacctgacatcaatgtctgcttgactcctcaagagtaggatcaatttgtcctatttttttgttgccctcgtgcctgacatgcgttgttgtggcatggctgtcacgtgacatgtgtttgggttcaattctatctaatcacgtgtcttgagtagtttgcagtttggttgggggatgaaacaggccaacataagaacagtttagccagaatctgacagaatgtgatagtttatatgctctcagttagagttggggatgtgtcattttgctgggacatttggatgtgattcattctcgctgtgaccttctcttgtactcctgcttcattgtgttcctcctccgcattgttgctcggtttgtgtccagtatgaatctcatagtctcaaaatctaatatccgtacggttataaacattttactacattatgattacaagatttaattaaactccccacgaaaaaaagatttaattaaacttttaaaatttgagccatcaatcttacaataaaataagttcgtaaaatctactaataagtttttgatactatggtaggtacgtatatcattttcttaaaacaaagaaagcatctgaaaaattattaaatggttggaattatagaagttttatcaaagaggattgctcccatccagcaggtaaccagcccggtaccaaatctcagccattcatttagctcgatcggccggtggaaattatacggtacctccaggtacatatttgcccatgaggtggtactggaatagttagaggggtggaagggtaatgttgtcttttcgcgtagggatccatctcgattcagctctgatccgtgagaggtggcggtggtgctcgacgggagcaacgctcggaggcggcagcagcgacagctgattcgtgggaggcgacgagtaggtggtccatgggaggcgacgagaaggtggtggctggtccgtgggctgcggtggtgaggtggtgttggcggcggtgtgtggtgcttgggcccgtgtcagtgaggtggcggcggcaatggcgtcggcagcgggtggttcgtggtgggcatccttcttcaacctctggttattctgtagcattgcccacagctcaagcactcaactgttatgttgagaaaacgaaggcagaagagataaaatgaagctagagctggaaatggttgaccatgaccggctttcagacatagaaaattcattcaagaagttgtctaagcagaaaaaagagactgatgacattagaaattggttcataggaacagtagttgtagctgtgttccttctcatgaagctatttgataatatgtactatgcttgccattgttgattttgtacatgtcaattaccagaattaatggatggggatcactcagcatgttgatgtctcagcaacctatccatgtgaattctgtttatctatctcccactatttgaaactctaaattacagcttcttcagatgggttgtctaacttatccttcaattttagattcttgctaagttctagttcgttctgtttggctgaaaatttgcagaattctgtttatctatctcccactgtctgaaactctgaattacaacacactagtacgagtatgtttgtttcagtctttcagaatcatgtaaattatactttttttcagtaattattgcccatgtgtctagcactctactccagtgattcctcaacttttacatctatagctggattgctgttcattgaaaacacttgcttgtaaccattgttgtgctgctgatcactccacagaatgatatatattttacaggagatcgagcaaaaacatcagacaaaatattaatggctctcaatacgacatatatatcatgctctgttcacagcagacaaaaattaagtcaaaagctccattcaacgatagatcatgccctgtaaacagcataccaaaaaacggacgacagatgagcttaaaattttccattcaaagattaaagtctccagcaaaagcttgtgcttttctcacaaattcattacaagaaacatggcagattgaattgttaattacaaaataactagaccatatagtggagtagtgtttgagccgtaatgggggcctaggctgcgccatggcagcgggggaggttaggtacttgcttgagctgtcgagggagggggataggggacacagaataccatgacatcttcgctcgtgaatgcggcggcgttgttggtgacactgtcgcggacagcagatggatgggaaaaaatcggcaccggcagaggcatggatgcggggcgagcgcgccgtttctccagtaccgcgaccacggacggcagatggatgggaaaaaaccgttcggcggggcgtggatgcggcgcaactgctccgtttctgcgctcagatggaggaatagatgagaaagaaccgatgcggggagggaggaaagaaagagcgcagcgagggaggaaagcggcggcgtgtgactccggaattgttccgcttctatttgttgttttccaatcgtatcctttcaagttggacggccagatttaatctggtacctcctagtaccagtactggctggtacagactgccggacgggagtaaaactcttcatagatagatgaatctagatagataatcaatatgaatatagaaaatgctataatgacttacattgtgaaatggagagagtagttcgaaagcatgcgcatagaaaagaaagaaataggtcggaaaagtgaaggaaaaaaaaactcagcctataagtagggtgcacgtttatagtttcactaagtgtttatactgtgtttcttgatagaaaataatacgggctttaaatttcccgtgacgctatcgatgcaattcatgcaaccaaccaggcgtgctgcgtgcaacacctggaacaaatcctttcggcgttcgttgcacctggacacacacctgcacatgacgtggccccctatccatccatcccttaccgccttcctctccacgcgtcgccttccgcctccgccacctcctccccctctccacacactcttcttctccactcctccgccgctcgcctcgccgcgcgccgcttatatacccgcgtctctgcgctcatcgattcatcacccagatcgcaatccaaccaccgcaaccaattcgccggagaaagttgtgaataccgacctaccggcggcgaagatcgatgatgtacatgcgcgcgacgcaccgggacgaggaggggaagaaggtgacggagaaggtggcggtgccggagacgcggcacccggacacggccaggcacttcgagcggaagctggaccagcaggggctccaccgcatggagcgccacccggcgaacggctcccgcggcatcggcgcgccgccgcccaagtccggccgcggcggcaagttcacctgggagggccccgacagcatcgtcgacagccagctcgatcccctcccggccgccatcgaccgcaacgaccccaactacgaggaggaggaaggcgaccacgagcgcgaggccgacgtcgtcggcgaggtggaggtcgccaaggtcgccggcgacgccagggatggtgtcgccagggtcgacgtcgtcgcgccgccgcagctgcacgagaaactgcagctgcagccgcagtaggggcgcccagccgccatttgagtggtgttttcgaagtgtgtttgttactttgtttgagtgtttatttacggttttgtatgcgtgttatttatgcctctgtatgaataataatcgagcatcaaactgaacttggatgaactgtggtatctggatttagggattgttcaactcattgccgaaataatgtgttctcccgatcttgtatttggttaaatttatttttgtgtgctgatttcattcaattatttttaaatacacttattttatagagtgatagattttatagagtgctagattgtaataatagactgtagattgtaataatagaatgttgctctgtagcaaatgtcggtgtaactcaatagcattctgaagctctatcatcttactcgagcatcccctttttattttttaggatgctggtctcatgttttaaaccataaagcaaacctgatgggtataaatcctaatagggaccctttatttattttaaagggcaggtaagtaatcttctaatatataaaggacaggtaagtaatctcctaatatcgtttaggggtaattttgatatggattgtttaaataaagggcaggtaagtaatcttctaatatataaagggcaattaagtaatctcctaatatcgtttaggggtaattttaatatggattgttttctttggttcgatcacatcaggtcggactccttatcgcatcgcattaggtccgactccgttgcacgcagtctcgtcgctattcctcccccggcgtcgccgccttgtccaccccctccgtcaccatccgtatcccccgccctctccgtcgccgccttgtccgcctcctcagtcgccgtccgcctcccccaccctcgccgccttctcctctccctccgtccccgtacgttttccctgccctctccgtcgccgtccgtcgcccccgccctctccacctccggcaccgttggcgtctcctccccttcagcgtccttgcctcctccgtcgtcttcctaccacgcgtggcatcaggtcagaggcaggcaccggcaggcggcggcgcggccggcagctagtcctcccggcaggcggcgtcgcggccggtggcacggcgcgtcgcatctgtccgacacaagcaccggcaaaagcggtggcgcggtgaaatcctcaggtgtccactcctccccccccacctgactttctgttccccttcctctcctcagtgttaaacttgtctgaatttttcctctacaaatgcatatacttgcttgtaaatggctgtgtatactagcttgtaactatactagagaatctacatttgcggatgttaaattgaataggagatttattaaatcgattttgtatgttaagttgtaagcatgaacgataaaactgaacaataattttggtcttaagctgcaaatgaaatacacctgtcacttgaaattccactcaaaacagtttgctgaaattgatgtgttactaatataagtccaacattaaacctcagcaaaggtggcaagttaaatcatatcttgtgcaattgatctttgatcttttctaccaaatgattgccttgtcaactggttaaagcatccaacatttcctgctagttcatcagtagtactagtagtacattgaattaatttattagtgcatgccttagttcttttatcatacatacaaaatttgcagccattatgggggaactgtagtaattgttcaatagtttagagtggcaatgaatttatgcagttgatggatctgtgagatggatactcttttatagcaaatcaaacctgtcttcctgaatttggccatctctgcatctgcattacactctgaaactgaaagaataaagaattcagggcataatttggccatctctgcatttgcattatactctgaaactgaggcacttaatttattttagatgtgtacagaggcaaataagctaaaatgctttagaactataaaagaattctttgtcagaaacattacataaatacggaattgagcttgatttaatccattttcagaaaattacagaattgagctgcctcctgtgtcctaacttgacttgttgctgcttggtttctgaaaataggtcctggatgacgatcatggagctgtggtttaccctgtcaggaggtcagtagcccctcctgcagttcagcgttggggcgacgtccctgggcagcataactgtggcgcacctggttaccctgagatgattccggcgcaagcacagttctgttgtttgcgttgcaaggctgcttatttatttttaaaggagtgtaatgaacaaataaatttagttgcctttttaaatattaggattaaatgatctgcaactggaatggtgacttcattttgtgatgcttgtgtgatgctttaatggtgctgtttgctggaatgatgctattgttgatgctggaatgatactgctactattcgaaattgtgctgctgctagaactgcactgttgttgctggaatgaaactgaactgctggtgctgctggtgctgctgaaactgtaatgctgctgctgctgctgctgaaactggttgttttttcatgcagagcctaccagatcaataagaatgcacatgctgctggaggactcattctgtccatatttttctagttccaacttcgaattgcgatagctctattcggagtctcgaagccaccaaaaaggattggtggtgggagatttggcatcctcagccatcaggcctccagaagatgctgattcaggagcgaagcaaaccataggaacagttccagggggaacatgtcgtccccaagaaaaaatgatactgacacatcattttgttctccgtagcatccgattttgatacaacattagcttacacatttgacagtttgacaggatgtaagatgttgcattgagcagcttctttacgtaagatttgcagtgcagaagcacaaaggtgcttcgtcgtggtacgagatgtttctttaaactcgcagaaagtacttatcataaaaaatcatggtttttcaatcgaccgcgcgcatatattatagcagaacattattttttttacaaaagaaagaataagtccccgcatctgacatcgttgaataacgagattgagtatcatttaataaataacagatagagtttaatattaaaaaattaacacctagcttattcgaaatgaacatccgacaagacaaactaagaatctccaaaataaaacatctcaatgataaatgaacatctcagaatttaatgaaagaatatcctcccaatacaaagctgaacatcttagatttcttcggagatggcctgtgcatgattcaaaatttgttggatggagagttgtaaagaatcgctgctagctttcttatgtattcatcgatgccttcctgcatagatcacaacaactatatgttatctttcttattttctacaaatgtccttctgtcataatcaaactttttgtttgctatgatgggcctaccatccagtccgcgtactcatagttcatatttgtatccatttgagaaggagcggtatatgaaaccttacgcttcggggtgactcagggcagtaagcagtcgacgtcaccaacgtgcatctgcttcaatgtcgcacctgaacaccgagaaccccttcgccggcatgtggttcagagtaagtaagtaaaaatgctgttaacattaaccgttctgttatgaaata

SEQ ID NO: 12916 - DNA, 4423 bp, Oryza sativa
atgctcccaccagcatcccaatgccatggcacctcggagcacccagtaagcatgcctctctcgggatcgccaacgccatggtggagttgttcagatatagatggatcatctcatccttcatgctacagattaataggaaacaggtagcctcggaaatcaaatcaaaatttaagaaaaacaaacaacttgagattgaaagttgaggggcggcattaggggagtgcatcttactgcaaatttccgggcattaccttccgctattgtccaatggcaagtcttcctcatgctccgaaggaggtgcttgaggtggcatggggacgaaggggaaccaggcgtgcgttgccattggatccagaggctgcgtcctccgcttgtgggcgatggattgggggctctcccacgcggctgcaggagcgatggcgggcggagatggacggggctggagccgagcgtgggggaggaggccgacagcgagtaaggggatagcgaggaggacgaaggctcggcggcagcgagtggcgcggtgctggggtctaaggtggaactcgccagaaggtgtgccgacgcgggtagcggcgggatagggcggagctctggagatcccagacggagatgcgggatcgccgagaggagtggagaagggggcaggggttgatggggaggaggacgtggcggcggtggcgggtggaggtgacgcggcggagagggctggtggcgaggagaacgtggcggcagtgacgggtggaggcgcgacgacgtgaggcgactcgctggagaagggagcgggggaggaggatggctaccgagggggctcacaaggcggcgtggagatgcgggcgggggagaaggtggcgatggcggggagacgggcttcgacggagggagcggagaaggcaacggcgctggagggggaggagacgcgaggacgggcgacatagatggcgagggagatggacggcgacggaggcggggatggaggggaatggcgtcgggatggagtgaaatggcgacgatgcgatacgaatccataggatagggatagggtgagtaagagactgataatatacgataataccctacgcgaattatttttcctggatgaaaacaccccttcacatttctactcccactaattctggtgggagtagaactagatcttaagccttcaattaaatatgatcaatggctcagattactttctactccgagtataaagcaccggagtgggactctaaaactaaaactacacgatgaagctaaaataatttggtaaatttgacaagataagatgtggtggcaagttttaatatggtcttttgaggagtttctagaattatcagtatagttttgtgtgagttgatgtttctaaaattaccaagtgagtgaccagaagtttaattatcataagattgtgatggttatgtatggtctgctgcgaataaaaaaatgagaaatgctaaaatttggtgccaacaaggccgaacgcataatcattccactgcgtaatttatgcggcccatacgaaagaaaggcccccttgtctgtcactgactggtgggccaatcctctcatgggccaacgcatgctaaagcttgactctccagttgggccaatataggtctcactgagtaatgggcctcaccgagcaactgatgcaacttaagtgggcccatctagaaaatgtggcccactaccaccggcccggcctttttagtggcttcgctaggttttttccctctgcgtgctcggggtcgcggcggctaaccgtctctctcgccgccgtctcgcacctcgcgtcgccgccgccgccgcgagtgtcggagcggaggagaaggggaggggggccatggcgaagggcgacgacgcgctggcgcggaagcgcaacaaggtgcggcggaagcggatgcgcagcagcgagaacgccgtgtcggcccgcgtcgccggcatcatcgcctccaagcgccgccgcaagtccggcaagcggcgggcctgcgagggcatgtgcttctccctccccaccccggaggaccccttcaacgaccgccacggcaagaagcggaagggcgacgacgagccgaccggagacgcccccgccgccgccgccgcaggcagggacgaatccaagaagaagaagaagaagaagaagaagaaggattcgagcgccaagaagcagccggcgagggaggccgccgccgccgccgccgcgaacgccaagtctagggagaaggacggggcggagtacgaccggccgtccaagttcctggtggtctgcctcaacgccatccgagacgcggcggcgtccgaggacggcggcggcggcggcatccacgacaccgggtcgtggggcgtggagctctggaattgctgctcggctgcgccgcctacgcacgtgctcgacaccagcggcgagtgcgccacccgggagaagacggcttggctcgtctccacagcctgcgacatcgtcgccaggaaggagaagctcgctgtggtcgtctcttgccccttcctactctacctcgtcccctcccaggaaaaggccgtgcaagttagtgccgccatttttgctcgtttggttaattcacttaagattgattcctaaatgatgaatcagtgattcatttgatggtgttttgtgcaggtgcgttcgatttgcaagcctctgaaatcacttggtatccattccgtcagtctgcatcccggcgcttccattgaacaccagatttctgggtatgttttggccaaattaattatcagtctaatcctattatcagtgtcattgttatctgtaagcgtataagcgtgttagggtaggggatgttaatttcatgcacactcaattcagattaaagagttgcgaaccggagttccttatatccacgccagagaggctgcttgaactaatagctttaaaggcgattgacatatcaggcgtatcgatgctggtgagttaatttggttgttgaacttctttgtactaagacagatcatctgtaacacttccattcaccatcttagtgattatgtaatttcagtttgcaaaacgaatgctgttgtcatatcaaattatatttgtatctccaagttttggatactcttagcaattatacaacctagaagcctattcccaacaagcctactcatcctacagtcaagtttaatttaaatatggaaactccatttgacaggtgattgatggtctgaagtgtttcacggaccttaatgtcagcgacaagctttgttctattagggatgccatattgagcaaccctcaaataactatattcagtgacccgtctgaccgaagggtagctgcactggcaacaaaactagtcggtggaaaaaagatcacaaggctttgtacgaatgattcagttacttctagaggtgcattcataacacaaaagatacacatatgcccatcaaaggaccaaaaggcaccgaaggtaattatcataaccaataaccactgatgtattgctagttcattacttatttgctccatgtacttgcctttgaaaaatagttttcctttacagtcatcctggcttcataatatcacttaaaggaatctgcttcctgttactgaagattagtctgttagatcaccttgctaagccttgatctgcctatcttactcttgtagccttgttctctgtgttgttaagccttttaacctcatgtactgttttcacggttgtgattttggaacagaaacagttacaaatctcttgtgcgattaaaatatgcctttttgcctgccatggtaagcttatgggcttttccaacatgcaggtgaaggaaattcttgaacaaattctaaatgatcatgctagaaagactgcaaaggtcctactggtaaccgcaagtgatcatgaagcacagcatctgtcatcatccttgaaattgcaaaattgtaccgtgaccaatgactcgcatggcaactcttttaccatatgcagcaggtatggaaaatatttacagtatgtagtttattgccgaacatcctatctatggggacaaaccaagagctgtgcaatgcacctaacattccctaaactcttccaagctgaaaactggtcactaagactgggggtttacttgaaagggaattgtagtcacaccattatcttttgatttgagattggctgcttttcttttactttgacaacttacatttctctggattttcttcagtgttgggctgattaatgtccttgtgaaagactgggagaacataacaacggcaaattttgaggacttcgacactgtgttggttgcagacttgcctccttcagttgacgaatacattgaaatcctcgctggtgcaagctgtcatgtgcttgtgggggaggtgcattgcatcttttctagcgctgatgctctgcttgcaaaacccttgtctgaggttcttacaagctgtggt

SEQ ID NO: 12917 - DNA, 4511 bp, Oryza sativa
  unsure (1)..(4511): unsure at all n locations
ttggatgtagaggttgcaatgattttcactatcggaaaaaaaaaaagagctactgttacctttgcccagctcttttcgctaacctccgcaattgaaaatcacagcacagtggtgcagcttaacttcttgccaaccaaactgtactaatgtactaccaaaaatgtgtcctccccagctcagctacctagcttatgagttatgaaagctttgcttcagtaagagaggacatggccatccagcagtactcctttggcttttatcacccagtgttgagtcttttagctcccacacttgaaacattgtggggcatcaccatctttcttctcaagaacaaggcatagaggagttcattccatgcatcagggacaccaggcaggcaccagtggctgcaatcctgcctgtgatgagatgcaggccctgaaggactcaggtacaccgagaggtgcccgtctttacgcagagctgtcatctgagtcacattcagtatatccagcccgacaagcttggtcgtgatgctgttccccagtacatgatttatgggttcaagcaggtcagcccacggttccagcgatttaattggagttacatctggtagagtttccaagtggcaggtccctccagtcttccagtcaccacctctgtaagaaatatctaatctagttaaagaaatagtttgactgaatatttgaaagatactatgatgtttgttcacaagtccaacaataaataccatcagcattgtttcatgatgctaacaatatattggcacaattcacataaaacaatgaaacaatgtatggtcaaaagcatctgatatcattcgatacaacatacacaatcaatcaagactgtcaaataatgtttgagcaaggaattaaaaccaagggaaacactcactatttgagtaattagagttggtgattcacagacctgaaatgcacaggagcatatgtacggaagatgatctgggtcttgtttgtgttaacttcattgcgaagccaatgaaacaatgtctgcatggatctttggtaagcatctctaacagtcatctccattttgacctcgttgccttcttggaaataggcgccactggtgcaagacataacagtaagaatagcatgatctctcagccataagacattaagtagagaatgctgttcagtcaatagaattcaaacatttatgcttaccctttgattgttttctcatggttccaccagtgccccgtgttaaagatcaaaagatcagcatccttccacttaccccggccagacatccaatccatggcatctactctaattgtatattttacgactgcaggggctccagctggtgcacgaccttgaaggactatgaaaggagacctgtaatactccacagtgcaattgtactctctaaacttgaaaattaagaaacccatgtgttttgtaataggattcccattaacttcaaagatggagctcttgtcaggaacagcagcagcgagcatacaaagcagagactcccattggtttcttgcaatcgaatccccaacaaatacaactcttctgtttctgagtttctctagcatatttctggcattaaatctaagaaacagaaaaggagacgaaattagagtgagacaccagcattgctaatatgggcatttgaatttattgataatggtacatctcagtccacaggtatcaagggagtaccatacaaggtcacaaaataatgaacttacaaggtcacaagcatgctctttccttataaaataattcactgagaaatcaaaaggcatgcaatacattaaaaaacataagtacaacgagattatgcttctaacaaaaaaatgcgagtccttttacatggtactatgtaacacatccctaatgttataatattccacctttgcaaaatttcatacaattagcacttatgaaggatgacaaacttaccctccaagtatagctactgacatttatggtgacaagaatcaagattaaatattcttttcaaaaggtagaaatctaatcttggaaccactttacttttccaaattgaatcaagcaaccacttaactgcaacaaaggcagttagaacacaacaaaacagagccctcaacaattaacaggacaagaccacctctccatcgaaggtaaagatgattgcaacagcatgacagtcgcagatcaagtaaacaatactgatttaataaaatatatcttctgcaggactaagcaataaccatacgggtaacattgtttcctacttttgtaatcatgtgggaagcaaaagggcatcgaatttccaatcgtggcgcacagttccaaagtggagttggtcgttgacagcatcatgatcatcccatgttccaataatctaattttaaccagggtgaagattgtaaaatgcacgcccactgatccaatctcagcaagaatatcccactggaagattgaagtcagaagcactaacccaaacttaatcctcatcatgccagcagagcagcatgtttgggttctagattcaacccaagtttatttaagtccgtcttaatttctttgcctttataagttaacactcaagttgtagaacattccagcagacaaaattaagtagcacggtctccaatccacatctccttaattaatttatactaatcaattaatcattcgccatctccgcaccgttctagatgcttggattgcagcaagagatctcattaaagatttcttcattgatcttcgtcaagctctcgaagtaaacatttactaaaatcgatttctatctaaacctccaaactcgccaccccaatccaacaatggaatcaatggaagcataatatgcaagagtaccaaagatgagaggaagaagtagaaatcgatggaagaggaggaagcaaacccaacctggggagatcgcagcgggaggggcgccatcgccacttggtgtaggagtcgtcggggcggccgttctcggagcagcggaagccgacgtcgaggaaggggcaatccctggaggcgtagagcgggtagccgtcgtcccacacccactccccgtcgaacaggtcgcactcctcgcctccgccgcctccgccggcgccgccgccgcggggctcctcgatggagaccccgccgctgaggagcttcttgggcgccgccagcgccgagccgacggcggccgagcagcggagcgaggcggcgcacacgagcaggagcagcgcggcggcggcggccagcatcgcgaccagccccgccgccccggccttctccagcggcctcctcatcaccccccgcgccagccgcttcgccgccgacgtcgaccccaccatcatcgcatcgatcgatccccccaccgacgaagcagtagcaccggcactagtagtaccactactactacctgtatactacctcgccatggccatggagcttacgcgcgcgggaggaggggagacgagacgaggtggcggagaggaggaggagacggagacacctcgagggagaagacgaggaggtatttatgaggaggtcatttgaaagggaaatgcacggagtttggctgcttccaattggacggaaagcaatgtgattactatttccctatttcataatatataagttattatagcatttcttacatttatattaatattaatgacttacattgtaaaatggagggagtagtactcctctccatcctataaaaaaaactacttaacctaatattgaaagaaaaattttctaatacaacaaatcagaacagatagaaactcatccaatactaaattatttttccaatacaacaaatcagaacggatagaaactcatccaatactaaattattttttttaaagtagaacttaacctattactaatataatatcgtttcgattcaggaaatattatattttatagtagattaatatatttttgagacgaagtaagtacaaattagtagtgtggtttgtggcaattgtgttgtgcgtgtggagaggggaaggaagaagtggatgggagggggagggttgaagttgaggtgtggggcctataaattcggctgtgtttggaggggttaagtatgagtcaagtcaagcacgatctatccctcggtcatcaaaaaatacttgctttaggtcgagcgcaagttaaatttgattaccatctgtctaatataatgtcaaaagatgtactggtattttattttaaaaaaactttgtttaattttaggccgctaccttttaaccacatcgatcattttcgatcggggcagttgctaaaccattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12918 - DNA, 794 bp, Oryza sativa
accaggagtaaagtttatggcgatctttttttccggttaatgttatcaaccgggactacaaatagatctttagtcccggttggtaacaccaaccggtactaaagattggaaagtacccctggagctttaaaaccgggactaaagatgtttttagtcttggtttttaatacaaccgggactattgtgaaatttagtcgaccgaccaaagatggtttctccaccagtgcatgtattatattaacactggtggagaaagggttattactaccggttcgtaacccccctatagtcccggttttcgaaccgggactacgaatccgggactaaagatcgctatctttagtcccgggtaaaaaaaccgggagtaaaaatctatttttagtcccggttggtaaagataaagcatctttagtcccggttggtgttaccaacctggactaaagaggctaatccggttgctctttccggttcctctttattattttcttttcttcattatttttaaatatattgatttcaccccattccatccccaaaatcccaaatcaatcatcctcaaattgcctccaaatccacaaatcgatcatctcaaatactcaaatacatcacaaaatcttaaaaaaaaattacatcacaacctctacaaaattcatcacatattcacatcacacacaaatcaaatacatcacataacaatctcagatccaatcaaatacattcacacaacaatctcagattctgcaaaaaaaaggaaaacgaaaaaacctaaggagaagacgcgcggcgaggcaccg

SEQ ID NO: 12919 - DNA, 8062 bp, Oryza sativa
cctgcagccctggattcatgccactacaaatataccaaattagaaaaatgccaccactattcgcgatatcggctgggtgccactggaattttgggaaattagatccatgccactccttcgcgttttccatccactccctgtccacagtgccaacttcgtcgacgccttctctttcccgtgcatggacgtcgccgctgctgccgccaccgctgctccactcgacggagatgatcagcggcagggaagggtgttgctacctggggagctcgtctctgccgtagatttctaccataggggcgcggtcgtcgtctcccgtgtcgtcaagacctccatatgtgttgacagaaaacacgaggcctgggagatctgcttaactccagtgcaggtccaaagctcaccttcgaatgtatgagcgtgccagttgatttgatcctgtaatcaacaagaaatagagacaaagaattcgtggttaaatctataaataatagccgatcggctaggtgccgatgacatatcatttatctttgagccgatgtcatatatgaatcgatcggcggttataaatagacagtaaggaactaaatctattcgatcggctgtagatattaacgatatatagttcttatattaatatatacttaaatcaagtgattgggatagatcggtcaccatgccgagacagtataaatcacttagatcgaaatatatattaataacatgattatatatgtttatagcatagccgatcagatagatctagcatgtatcggctaatactccgatactactctacataaagatatcaaaacaagtataatataccaaacaaaagcttaatatacttaaatgcagtaagatcttgacataaagggcggatttaacatgtcacttaggcacatagatcgaatatggttaaatcagataagatcggctgaaactccgatactaccctaatcggcaaccagaggacatgctagagattgatattctaagcacgacttaatagatcaaactcaactgatgcaacattaagtatgaaaagaagaacaatatctagacaatcaagacgctggatgtttcataaagtggtagatattttatataatctaggacaacatcgctatttaacctaatcggctgccttctattaacagatgtcagccgattgtaggttagatgacgatattgccaaagctaatgtaagatatataataactcgacgaattatataggcaagattagagtgtcataaagatggaagcactaatctcgagaacacaagtcgtcataacaagttttacctcttgttgaagatcaaaaccgatgcagctcaacccgaaagtaagaactcgtcgaaaacaaaactaaagcaaaaaggtggcgatgcgccgaaattgtattgaacgtgtgtgttaaaaattacatagggctcggggtctatttatacccaagaattacaagatatgtccataccggacacgaccactatctctaacacactctaagataccataagtctttgcggtagacttttgcccaaacatatctctaaggaagttacataaaacatcctaattaatagatacaattgccttctcaggactctatccatgtgcggcaatcatcttgaagcacctcaattcaacccgatgtcatacaccaaattatactgtcggaatcggctgcatcggcttacctagtccgacttagacccatccgatcctaatcgtagccgatatggacttcagtcgattcttgctctgttctcgaatcaatctccgccttcgactccacctcgatctagtctcctcttccgatgctgatattaccaaatttggtcgttaacaatatgtcgtcctcgtggttcctcacctcacacttcactgtcgatgcgtgcattcttctccaacgtggccaccatcctcatcatcttcgcccgcgtctccctcctcgccttctacctccacgccgccgcgcggtgcctcatccgctgcctcgcccgttggcgcgactccggggagtgggcgcaaccacagccacctaggccggcgtccgacgacgacgccaacaccgataggtcagggcggtcggcgcggcgttcggagtcccgatggtcggcgggtgggccgaggtggagtgtgccatctgcctgtcagagctggcggacggcggcgtgctcccggcatgcgggcacagcttccacagcacctacgtggacggaaccaagaagaggaagcaaagaggaagtacgacgagttcatgaggagaaagaggggcaggaactccgccattgccaaaactcttctcgccattggagttgggaaatggcaccgtcgccgagctccttcgccgccgcatcgaggccgagtgtcggagttgggaaattaacagggagtggatggaaaacccaacggagtggcacggttccaatttccccaaattcgagtggcactcagctgatatcgtgaaatgtagtgacatttttctaatttggtatatttgtagtggcatggatccaattaaccctatctttaattagctctcttccctcctctgtatttttgtttttttaacaaatcaaccagcgtcaatttcatttattagaacaggatatcttcgctcctctcaatcagcgggttaatttctatgatatgttggagcataactcagggttaatccttcattcatcgcacaagataccaagtggtgaagggagatacaggttcgtagactgggagaagaattagacagggaaaaatagctaggttgggattcagagaaaaggattttgggaagaggaagcatccagggagaaggagaggctcgttccttggttcagttcatcgatgccttttgccatgtctccctgttcgtttatactcccttattgtccaaatgtttgacgccgttgactttttaaaacatgtttgaccattcgtcttattcaaaaacttttatgaaatatgtaaaactatatgtatacataaaagtatatttaacaatgaatcaaattatagaaaaagaattaataattacttaaattttttgaataagacgaatgtcgacgtttgatgtctcaactacggtatttgaacagtatggggatcgttggtgctaggatatacacgagactgaagtaaaagagatggagacgaggatttttatataggttcgggcccctgagctgtcaggtaataacctgtcacaccctaaaaatcctaaatatataaattgttgtttaattggaatttattttaaaaagcctagaagagaagatctaattttaattaataaattccaatataaaatggggccagataaaatttcattaaatactttgcttaactctataattcctagatttttctgagatttatttgagctaaggaagtatttttaataaatggaattacatttaatgaataatttaaattgtaaaaggttttaaaaatcctcttttggctttgggccgaaagtcggcccaaaaccttttctctctctcctggcccaatccggcccgcagtcgagccgcccgctcgcgcgcgcgcgtccgcccgctgacaggtggggcccacctgtcggactcgtcgtcctcctcgcgtcgtcgcccggccggaaccctagctgagccgcgccgccgtctccttccaaattcgctcacgcctttccttctccggtgaaatcaatagaggggaaatgatcttcgggatctcctctacctttctcttttggaatcgtcggctaaaatcgtttggaaatcgtggattcgagttcgattcggatcgatctctctcctccgaaccctagactttccttcatgtcgccggtcgccgtgggccttcgccgccgcctccttgctcctataaaaggacccccaagcccgccgctacccgccgccaccctcgcattcgcctctcgtcgccggtagagccctagcatcgtgtagcctagcgccgctgtcgccgccgcagctccagccgtgcgccgccgtcgctccggtcgtcgtcgctgctcggggaggtcgccgtcgtggtcaccaagccgtcgccgatctcgtccacctctccgccgtcgtcgtcaagccgaaggttgccgccgcttcttcctcgacgccgtcgccgtccgttgatcttccgccattgttttggtcaccggtgagttcgccgcgtcgccctctacgtgttggtgtcctccgttcgcgtcgtcgcgccgtcgttcgccgacgagtttgcgcacccgagccgccgccggtggtgatgtcaccgctgacgtcatcgtcgtcgtcttccgtggtccggctgtggaccggtcgatctcggccgttcgttttggatggaaagatctcagccgttcgttttcgtgagccgccgccgtgcacccggttcaccgcgaaccctagccgctgacgcaataattcccttttccttttaaaaaataattcattattgcgtcataattcaattaaaatccatataagtgatttaatccgatttaatctttaaaaattcataactaattcatcttagctcggatttagttggttcaagtctctaaatttttctaaaattgagatctacatgttaaaaatatccacatgtactgttcatgcttgtttatgtgctgttttggtgattttgctcctttctgtttagattccgacgtttccggagagtccatttttgcaggagaagattttgaagagttccaaggccagcaaggcaagtcacacagatcccaaagaaccctttgagcatgttgatcccgtttaaagctattgtttctattcaacaattgcatttattttcgaatgtcattgggtggaattaacctattgtttgttatagcccttttgttcttgattactttattccttgataccttgggttattataacttgactagttgagctttatatattggttcagctagatattagatatgattgcttagccatgcttagaaacattagcacactattgggataacttatgattcactattacttaatgatggcttaatgatagttcacgatggtcaatcgtgattggttaattaattacttgccaactaaaacttgataatggtgggttgtgagcacatggttttgagagtcgtgctcatgacaattaaggaccggttcacgagttttggttgtgaaacattaaccgtgccaaccacaagccagcgtgggcaacggctttaccttttgtatagcatggttcattgcggagcaccagactgagaagtggcggagataagcccacgggggtcactggggagtccatgccttgtttataaggggtgattgattatgatccaggaaaggtgcgctgtggtggatcgtgttgtgcgaggggtactgtcatagctcctttccgaggtaccgtggtggtattaaggcacatagtgacatgttgtggggctgtgtcttgtgagtacagtggtacacctctggccagagtaaaactattcgaaaagccgtgcccgcggttatgggcgggtctaacaatgtctttcgtgattagtctcacacttctcatcataataaaagatgctataactggtaataatttgattagctcctggtttggaacggtatattcttggtttggagatagaactgtgcagccgggatggttgttcagaatggttgggcctatgcaacagggtatgttgtatagtgttggattaatattgtttaattattacttaactgttttattaaattctgaaatgtttattaaatgctgtttatgcaaatgaaaccccactgtgccatcctttgttatcctgtgcacttgcatatttgctgcgtggcttgctgagtatgtcatatactcaccttgcaatcattcatcagaggaagagttctacagtgatgttgatggtgtggaggattaggtgtagccctggtcaagctacctgtggagtggagtcgtctgcgccgtttatctttttttttccgctgcttagatctttattgattgagatgaactatctacctctgtaatgacattttattcgcttattaattagagtaataattgtactctattatcaatttgttattgtgtgcctcggctgatttctgacgagggttcacacacatgtaagcgtttggaattttggatagaaattccgggcgtgacataaccctacatcctgttggctggagccggagttgcttttattcaccataatcacaccaatacaatatgtggggtagcctatctaactgttgtcgacatctcggtctgaagatctgactcgtagtcgacaacagggtagccttcctcctcgaatccgtgcccggcgagatcagagatagcgctttcgtctctcctgacggtatccggagacaccgtaggggaatagccatgcctatccctgaagtcgatatccggcgtcttgtcttggagtatgttggcttgtatgttgtggcttctatgtcgattgtgttgggtgttgattgtctcgtcatggtgggtgttgatcgtgttgatcgtctcatcatggttgtccccctgtcctcctaggggggcttgtatttatacccataggtgtccccttgtccaagtagaactagggaaaccaatatggatacaatccgagtagtccttgtcgtttccatgtagaactctggttgtctttccttatccggaactcctcctatatccgcaggttgtttctatataggacatggtatgtggtgcgtcctgccgagatttagtcaactactattaggtatgtagtatacataaccctgacaacgaacggtcaaatatatttaaaatggtcaacggcgtcaaacatttagggatggagggagtagcaggttaaccttccagcctggtgggtcttcatggccagcccacttagggcccaagcccgtgacagtgtgataatgtgaaatgagaaggaaaatgatttagttgtagattaatcatgctaggttaaaaataataatggaggtgatgatgtagcttaatagaaatatcatttattacacttgttgggggctcaatgacgtttggcgttttggtattcaaccacccataatgtgcccattcattctaaaattaattggaggtttctaccgtcttgaaaggtaaatgcattattagtgttaacggggaggtgttatgttatgcaatatttctagaacaatgaggtatggagaaactttcaatgactttaaagtttattcagttcaataaaatggtcattttggttctttactatccaattatatttattggtattatcaataatttcgtaggacatcaatattgatttgataaaagaattggcttcaatccaaaatttagccaaacattattgagtagaggatcaattagtaaggcacattttgatagctatccagaatggtccgtacctcacgatacatatcaactcagctaatatagtttagttttgctatgataatcctaaaaggaagacttagtatcctgatctaacattttttttagaatatgtcattaggaggggagagtttccccacctgtatttcattgataaaagggtgcctagaagtacaagatcattacaagatcgttacagatttagagaacgaaaggaggaaaagaggagatccttccaagctgaaattacaagtctattctcgaagtcgttcagcccagagtagcatccttatacacttcaccaaaaggcgatgtaatgataggggttcatttctggaaaccacaccatgacggtggttcgagaggttccaaaagcagaaaagcagagaagatagaaacacatgataatgcctcttttgctgctgacttctgggagctactgaacatcctgatctacatgccaaagtaacgagtgttatctgatagtatgatccctcaccatggtatgtagtggagtggtttacagcatggtatgtatctgtgagataatactgatacacgagcttgggttgtcatcactttcactattcttgccgggttcctaatgcatcctaatcctaatccctccatgtcaatgcatggacagagttaccatgagttttagattctgcgcggagagc

SEQ ID NO: 12920 - DNA, 674 bp, Oryza sativa
ctccccctccccccccctccccccccacacacacaacaatctttgagctccttccctacctgttgcgccccatcttcctctcttggcggcatccggttatgcatctgggctgcagctcagctcaagtagttgacgggggcggagtggcctcggcagcggcgtggagtggattcgacggtgatgatctgcttccaagccaagtctgatgccgtgcacggccgcctcctggttctcttccgcacgcagccaaggccacgacagcgagcctcgaccttgcgtggcccatgagaagcaggcgcaaggccggttcagggtgacggctagggtgcgtgcatggtggtgctaattctgtgctcgcatcacatgatggcggtgatttgccaaattggtaagccatcaatctgatttgcttagggatttacccagaaatttgagttctaaatttgggtatttttcgttttagggttttgaaatcatgcgacgtgcggccgaagatagaaaccggtgagaatgattctggtggctggagttttgctttatttggatttgggatctaattcgaggaaaatttggaatttagggtttgtgcaaattgggtatttttcctagaaccaatttttgtatttttatatgttgtatatatgcaagttgtcctagtgtaacacggggctgca

SEQ ID NO: 12921 - DNA, 1018 bp, Oryza sativa
atttcagtacaaagacagccactccagatattaggtggtggtagtacttgtcagtactgatagctaaatacagtgacatatattaactatttctttatgtcttattcactcggctctaggcatcattggtattctgatctagacatattgtaaaaggaaaaaaggaaaaagaagcattgctaaggcctagttcgcgaaaagaaaatatttgagtgtcacatcggacgtttgaccgaatgtcagaaggtaatacacgaatgaaaaaaaataatttcataactcgtctgaaaaccgcgagacgaatctgttaagcctaatttagtgcagcacttatagctaatcatggactaattatgctcaaaagatttgtctcgcaattttcatgcaaactgtacaattaattaattagattttgtttttatctatatttaatgcttcatgtatatatctaaagattggatgtaatgttttttttgttaaccaggcctaatactgatattctggccttgaaatgtactagcccatgctgcacagtgcacagctagcacgataaaatataatcttgacacagctgcacgttgcgccattagccatggagtccggcggcttccttgcacgtcgtcccgagccatgcgccgccgccgccgaccccgacgacggcgacgcccgccgcggcggttggcgcgccgccttcttcctcgtcggtaagtggcggcttctcaggctttagtgatgacatcatctctctcagccaggcttaatttgttgctgacgtgtgcatgcatggccatggcgcagtcgtcgggttcttggagcggattgggttcttcggcgtgcaaggcaacctgatgctgtacctcaccggcccgatggccatgtccacggcggcggcggccaccgcggcgaacgcctggggcgggacggtgctggtgctcacgctcgccggcggcctcgccgccgactcctccggcctcggccggtaccgcgccgtcatcgtcgccagcgcgctctacctgct

SEQ ID NO: 12922 - DNA, 1235 bp, Oryza sativa
ggctcgagcaccttcccctgaaatttaagatcatttcttgctttccagatttgccacatgattgagaagattctattaagggaggctttgttagagcaattatttacaatgcaagcaataatgtgagccattgagacattatcagaaaaaatgtcagtgttcagattgatatctgagattattcaggtgattttgctaaaagggcagtccaagaaaatatggaaatcattttcaatcatgccacatctaatgcaatttggagaaatttcactgattctgaaattaagcctggaagcagtaggaagagctaccatcagcaatctccaagcaaaggttttaatctttggaggcatacacttgtctttccaaacctgtttcaagattgttctggcatgttcacttacttgagatccatgtgaggcttctcttttccagatctccttgtatgcacttttggaattgcactctccattgggagtgaatttccatcgaagtttatcttcagagttgtcttggatgattggtacctgcaatatcatattaaccgcttgctgctcaaagattgaattgagcttttgggcatcccagcacttgtcaattgtccaaagatctgcaacagtgttaggagctttgttctatgtgagagtgtgttgaggccttgcagcatttccaaacgcctccagttcctagctagccttgcaaatgctcatggctgacctaatcatcactgctatacatgacagttgtgaagttttgatttttgtcatggaaacaaagagcaaaaaactctataaatcatcgatcacctcccgagtaactttccaggaagctgtgaaaaactactgataagtatttatttcctctcttattttgctaccttccattaatgaagaatatctctatggtcctctcatagttaaggagagtgtagtatttttcacttgacgtagtttaaactgcactcactacaaaggggctgcaatagtagcatttggttgggcatgtactcactaccagggttccgacgaaaaccgaccggatttcgtgaaatttcgacgtttcgacgaggctcgaaagtagaaatcgtctgagatttcgagaagtttcatccaaattaaaatttgaattgataaaaaagaaaaatcaaataaaatcttataaatactatgatattcatagaacctattgggatataaattttcgaaaaaaatgatgtattgtatgtatttactgaa

SEQ ID NO: 12923 - DNA, 14400 bp, Oryza sativa
gcatcaccttcaacagaaacaccaacctgcttgccggagaagcagacttattgcccttcaagcagcgaacaacgtgagagcaaacctggaagccacccaaaagcaggcaacaactaaggagatcttcagcagcaccttccatagaggaccaccggaacaagggagctcgacgccggtgaatcccttgcactacacacaaaaggaaaacggaatgaaccctacacggaatatatccgaccatcctatcgcctaagggtaaggaggccaacccctctccctaccctcatcagcggcgaaccaccggatcggaggaggaggaaaaggggtcaagaagaaagaggaaaaactctcaatggatctcagagtatcgcgagagggatagagaaagtcccgccccagctgatggcttcttctactgctctactacaagtgaactcgtatatcgtatcccatgtcatggatggagccctatcccagtcatggatggagaaccaaggagatataattagaacaggtagcagctaatcataggagaagtcatttggtcctccggcgtaatcttctactccttacattccaaaatataataacatagaactggatgtctcatctaataccaaattattatattttagattggagatagtaggaaatatcaacaaatatgctggttgtgtttgagattgattaaaaagaagatgaagtcacagcaagcaaaacgagaaagacattagcatatgattaattgagttttaattattacaaactaaaaaatagatttatttgatattatatatatataaacaccgtttattagttttaaaatcatgctaacaacaaccgagaataaatctatttctgagcggttacgtgtttgtaacttgaaagactaagctcggaatatgaatcgttatcattgttaacaatgatagagaaagactacacaacggtataccgttgaacagtataccacttatccctcatgccgcggccccgcgtgccggcttctcccgagtatgtcgtgtgctgctagaattatcatcacgcaggtttgttgtgtgtatcagtgtatagtcttgttcctgacagctagctagtacccagcatgcctaagtcatgcctttgatactagcctagctagtaaataaaactggaggtactactagcttgttgtgcatgccaaatccctgtaatagctacctacgttacctagatacggggatacggatatggatacacgatacgtcgatacgggatacggcattttccaaaaaaacaaggatacggggatacgcttttatatatatatatatatatatatatatatatatatatatatatatatatatatatatatatagtaaatttgtttggtgctccatggtgcccgggcaccattgttgaaattgagtatatacccaattcaaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggattgtgaaataaagttaaatttgagttgttttgttgataggtataggtacgaatcaaattcttataactaggtatatactcacaattagaaaattttgaaaaatttgagtgattttgtgcatttgaaaccatggtgcccgggcaccatggtgccccatatgagtgtcctatatatatatatatatatatatatatatatatatatatatatatatatatatatatatatatatatatatatatacacaaaaaaaattaaggaaattgcatttatatataaaaaaaatacaaaaaatcaaggaacttttataaagaaatagcgatataatactagtatcagtgtagcagattccatatcaatattctgcaattttctcttctataagcaattcaaattaacaagcgattaagatcccaaaaaccacatattaatagttcaatcatatatttcttgatgactttgcatcaacattagaagccgcactaagcagtaacctctaggattgctagatgcactagcacttgtatctaataaaaacgatagtactttgtcctaaggaaaacaagaaaggcacagcagattcaagcatgaaacttttgaagataatggattacccggccaggcagtcaagcgaagaaagaaaaagttgctccgtgcttcgatgctactagcctgccactggccaccgctatgcccggcggccggcgtcggaggaagtgcctcacgcagtcacgcggcaagccggcaacagttctggcctcgaggttggcggcaaaagaggtgcgccaccaccaggctggcggcggcggctctgccgtctcgcgtaggggacgttgtggccccgcgcacggcagcgacgcgcgcggctgcagccggcgtccggcggcaacgccgggcacgcacgagaggcatcagccatcaggttgtaagctcgtgaggtggcgcatccctgatgcgagcgaagacggaggaaggtcgtggcgtatcgctggcgtatcgtgatttatttatttttttgcaaatcgcaaatatgtgggatacgcaccggatacgtatcggagcgtatccgataagtatccgtatccgttgccgtatccgatacggatacgtgattatgcagccgtatcacggtaacccagatagctactagtagacctgtaccctagctatgtagggtacttattatggcggagcctagtagcctagctacgtgtctaagatgagttgcatctatttgttgtgtcctataccatgcacggattagaccagacaaataattacctagattatacatggatacaatggattattctaattagatatgtcatgttgggctcttagttataccacatcttagaaactctagtatgtgatacatagatgctagattatcatatctgatatctaggtattgggtcgaatacctaggtaccaggtatgaaacctataaatacaagatctgatgctgagttatccggcctgatacctataagtaccggatccgataactaggtatcgcgtctgatacctgagtactagattggatacccgggtatcgggtatctgatctcatacctatgagtatttgttccaatatctatgtgtaacgggtcggatacccaggtaccgagtatgatacttatgaataccaagtctgatacctaagtatcgggtctgatacctatgagtaccggattcgatacctaggtcaggtttgatacttatgagtatcggatccggtatcgcgcatgatacctatgagtatcggatcggatacccgggtatcgggcatctgatcttatacctatgagtatcagttccgatacctgtacgtactgggtcggatacccaggtaccgagtataatacttatgaataccaagtctgatacctaagtatcgggtctgatacctatgagtaccggattcgatacctaggtcaggtttgatacttatgagtatcggatccggtatcgcgcatgatacctatgagtatcagatcggatacccgggtatcgggtatatgatcttatacctatgagtatcagttccgatacctgtacgtactgggtcggatacccaggtaccgagtatgatacctatgaataccaagtctaatacctaggtattgggtctgatacctataagtaccggattcgatacctaggtcgggtttgatacctatgagtaacggatctaatacctagataccgggttgatacatattagtagaggatctgatactaaatatagggtgtgatggtacgagacttcagatgtgataccactaattctaatatttatgggttatatacttctattcaacaatcaaataaaaagatggaccatgcatagctaggccagaaagtacaaccaaacttgctcacatgccgctgacatgctttgtttaggctcatgctactagctctagtgcttaattctaactttactagttgaaccaggtgtcagacccatatggccctaaagaggtgtagaagtagtgctgtattagagtatttcatagctattttgtcctgtaggagaaaagagacctctcgtcagtcatcactagtcggcagcctccatgtgaaaggacagcacacgacacgcttttagagagaaaaagaatcggtgagtgattggtaagtataaattataaactataccgttgagacagtacaccgtcccatagtttaatttggaatcaaaccggcccactaacatacgagaaagactggtacattggcccgcaaatatatgggccttttatctgttcatctaggcctacccaatctcggagtttttcacaaaaacccctgatattaactctagcaacatataggtcctgatcttttctaagaagccccccttttcagtccagatatttgcataaatatcccttattttaaccgttaacatcctcagcggtcaggattatagcataaaagcccttgatactgctctagagtcccccccccccccccacgacgccttcagcgacggcgtgcccatccgactccgacgacgttcttccgcctcgccgccgatgatccccgccggccagccatgtgtcctaccctacccacccaccagcagccgattgcacctgccactgccgtttcttccctcaactgtagagtggtcagcggagatggccggcagacggcaggggggcaaccttgcctggggaccgcgcctcgcgccgtgcttggagacgacggtcacgtggttggtcgccgtgatgaagcggcttctcgacttcaacccctgcgccccactggagtcccagcagtacacggggcaaggccccggtacattgttcacccctcgcacatgacttgtttgttgaattgcctgagtggaaatcttacgcttacctgacctgcgctatgtgtttctttgatgattgagttggtacatgtgttctcctatttcatcatactttgtttcaaacttatactccatcccattttgcaaatgagatatgatgatgacatgatgtacagatgaaagaacgagctataagctggactgctagagagctggatggagaaggtcaaagcgcacaacaaggaggagctcttgcgcaagcagagctctttgctgggcactgatggtaaaccggaccaaagtattctcgaggcaactatttgaactcattggaaaatttgtcagccgtttttctcttgacaaacttcggccaacgaacgcatcgccagcccagcaaaaagaatgacctgtcaagcattctaagatctaaagccaacactacctattgctttatatcttagggctggtttagttcccaactttttcttcaaactttcaacttttccatcacatcaaaacttttctacacacacaaacttccaactttttcgtcacatcattccaatttcaatcaaacctccaattttgacgtaaactaaacacatccttaatatggtggtagagatgctacagtcagtagggtatgaaagatttgattggaatgaaaggtttcttgaaaggttaaatgttagtcttctgtttttgcgtgcaaggtatacttaggatttcagcttattgaagaaccaaaacttcatcatgaaagcaatatttttttagctttgtaaatcctaattgtagcaacagaaaaatgcactctatacgagagtatagaagatatttgcttcaaaacaatcttgatcacatatgaattcattttatcttttaaagtcactgattccttagcttagtagcccgttcatacccaggctaagatttaaagtggattttagtgcagaacatactaacataagacagccccactgactatttgcatagatacacattgttgatgtgttcctgcgtatttctgcctactgcaatcctttgtttttctcaccgggccggcctacttccatctccacttgggcatgttcttttacattgctgatttatcactttatttttgtactttgattatagtgaacttcatgattgctggcgtacttttaccatcatgttctcccatacaacttagactgcgcagggtgcaatgctacgattgattttcttttttaccttttgaatttaattgtacaatgaattggatgaatgcccaaaaagcaattggaagttttctgcagccagtcttagttttagcacgattagatgtgagctcatgaaaatttcgtcttttgtgatctcaactgctcaaggttcttttgctgccttttctttggactcaactttgactaagttctttgagctactgatgggcattgatgtttttcttggtgcaggatacttgataatgtaacctaaaaaagcaggatggacaatgaaactgaaagaagcaaagttgtgatgatgagatgagttaaactactggctgataacaaagttgcagtaatttctatgatccccctcatgctcctactctgtctttatatctctttatttgttttttttttcctttgcaactgtgcccttgctttggaacaaaactttgataaccatttaacacaatcgtcaaagcagaaggaaagcttatttgcaattcccttttggaactaatgacatctgtttaagtaacaacgaccaacctcaaaacttctgctgcaacattgtgtactttgttgctagactggatgaacatctagctgatgttctgttttagcattgctttacttgagacttgagagagcctgctaccagtttcacttaaccattcgtgtttatcttcccaggatttaatatgctggaattaggaagtctgaacaacattttgtggaggctactttattaaactgcggtgctgctctgtccaaacttgcgctaactgcgggagagaaggggggctagcgtgaaaagaagaggtaaagaaagagaaaggcaaaggcgcgacatgatgcctcgtccaagctttttgttgtcacgctgccaaagaggacaaggatttggccctgcttctcttcttcttcctcctcttcttgcggtaagatcactactactattaccatcaccatcaccgcatcatttgccaaaccatggaccagcttgcctttttccaggttgcagctgcctgacgcagtttagccagccactgtaaagtgcaggtccatttatctgacaaatagagtatgtgagcttaataattgtacagttttttcaaggtcaattttaggggagtaaaacacaattagttttggaggggaaatagcttttgacattgctgtgagatgaggggttggtttggtctgtggcctaaataggtattaccaaattttgtcaatgccaaattttggcaagttttggcatgactaattttggtaagtcaaaattgtgtttggattgaagccaaaatagcctaagttcactattgaaatggcatattttcttaagcatgccaaaatttggattcaaaccaaatagacactaaacactgttgaaattgacaaatattggtaagtctaatttattcctcaaaccaaaccagcccgagatggtttgtgtaggtgaactggtgaacagtttggcctgcatctgcattggtaggggcctaggagcagacaagaacagagcaaaagtgaaaagtggaagcatccagtactgtcaatctgacactggcgccacagctctcgcgaccactcctcatctcacacttaccgaagcaacaataaaaccgttctatcctcgcttcaaaaatcgatcaaaaaattcaaaaatcaaaagtgaaagaaaggaaagcacacgatgcttctcttcacccaatgcagatcgatgggggtcgtaccagtagcagagatcatggctgtgagcctgtgattgagtgatccctttcctccatgccaatcttgaatctttctagctaaaagaatcatctgtgctcttgtgctcgcagctagctgcacagtggtgacaatggcgatgctgctgttgttgcgttctttggagttcttggcgatcatggcggttgcatcgagcttggcaatgccggtggcggcggcggcggcggtgccacagccggagccggaggtgaagccgagcgacaccgacgcgctcaccatcttccggaacggcgccgacgcgcacggcatcctggcggcgaactggagcacctcgaacgcctgcgccggcgggtggatcggcgtcggctgctccggcgacggccgccgcgtgacgtcgctgtcgctgccgtcgctcgacctgcgtgggccgctcgacccgctctcccacctcggcgagctccgggcgctcgacctccgcgggaaccgcctcaacggcacgctcgacacgctcctcctcggcgtccccaacctcaagctgctctacctctcccacaacgacatctccggcgccatcccggacgccatcgcgcggctcctccgcctcctccgcctcgacctcgccgacaacagcctgcgcggggccatcccggtggccgcgctcgccaacctcaccggcctcctcacgctcaagctccaggacaacctcctcaccggcttgctcccggacgtcaccgccgccctcccgcgcctcgccgagttcaacgcctccaacaaccagctctccggcagggtgcccgacgccatgcgcgccaagttcggcctcgcctcgttcgccggcaatgccggcctctgcgggctggcgccgccgctgccggcgtgctctttcatgccgcgcgagccagccccgacgtcaccctccgtcccgtcgtcgccgcagtccgtggtgccatcgaacccggcggcgtcgtcgtcgtcggttgcttcgtcctcgccggcgttggccacaccggagtcgcgcgacggacccggcaagggggggttgagcaccggcgccattgccggcatcgtcgtcggcaatgctctcttcctgttcgccatgctgtcgctgctcgtggcgtcctgctgctgcagcaccggcggcgagagcggcggcgagccacccaagaagaggaaacgaggcggccgcgtcggcctggaggatgacgacgacggcgggatgttcggccaaggcaagggcgtgcagccaggccggccaggcagcgccggcatgcgcagcgacgacggcggagacagcgacggcgcgcgcagcaagctggtgttcttcggggtggacggcggcgaggacgacgacgacgacgacggaggcggcagcgacagcagcgccggcaggagggcaaccggcggcggctggacggcggcgccgcaccagcctcacgggaggaggagcaggttcgcgctggaggagcttctccgcgcgtcggcggagatggtcggccgcggcagcctgggcaccgtgtaccgcgccgtcctcagcgacggccgcatggtcgccgtcaagcggctgcgcgacgccaacccatgcgcccgcgacgagttccaccgctacatggacctcatcggccgcctccgccacccaaacctcgtccccctccgagccttctactacgccaagcaggagaagctcctcatctacgactacctccccaatggcaacctccatgaccgcctccacggtacacatccatgtctgatgtctcctcctcctagctgtgaatcgccatgagagtggcacgatgagctcgatctcgccattgattgtgtttgtcagggcaccggatgtcgggggagtcgccgttggactggacgacgagggtgaggcttctcctcggcgcggcgcgcgggctggcatgcgtccaccgggagtaccgcacgtcggcgatcccccacggcaacgtcaagtccaccaacgtcctgctcgacaagaacggcgtcgcctgcgtcgccgacttcggcctggcgctcctcctcagcccggcgcacgccattgcccgcctcggaggctacatcgcgccggagcaggaggacaacaagcggctgtcgcaggaggccgacgtgtacagcttcggcgtgctcgtcctcgaggcgctcaccgggaaggtgccggcgcagtacccgcagccgtcgccggtcgtcgccgccgacgccgccgcagacgcgcagaggaaagacaagaggtgctcgacggcggtgagcctgccggagtgggtgcgatcggtggtgcgggaggagtggacggcggaggtgttcgacgtggagctgctccggtacaaggacatcgaggaggagatggtggcgatgctgcacgtcgcgctggcgtgcgtcacgccgcagccggagcagaggccatccatggccgacgtggtgcggatgatcgagagcatcccggtggatcagtcgccgttcccggaggaggacagggacatctccaccatgtcgccgtcgatcggcattaccactgacgacggagatggtcgtctcagctgctagctcatcatcatcctcctcctcattgatcttcttttctgaattctgaacaactctgcctgctgcattttttctgatttctgaaatgatgctctgctcgatcttggcattctgaagtctgaaattgctactgcagctggtattatcttgagctgcttttcacttctgctgaaatgtcgaattgtcgatgtgcctgtgcttggaagatggtgcttgtgttcttgtaagataattttggattatgatgtcgaatgcatgctcctggagaacgctggcagttgctgctatactctgtttgcgtttgtcatactcctctatttttaactttgacacagtcttcgagatactagtttgatcaataatatctatataaaagtaaaatattttaaataaaaagtaaaatgttttaaataaaaagagttgtatattgttatagtttatttaatgataaattaccatcaattacattattgatttttttattttttttgctattaatagtcacaattataaatatttgacttgatatatgctaaaaatacttacttatttttggatgaaggaagtagtcggtatggttgtttctttgtttctattagcgaatgtcgttttgtgacatactaaaatgctataaaaatgagaatatgggcaatcttctactactatcacatcatcattttgttctttttttttctttgaagcggattgcgtatgttgtacaacattttggggtgtgaagttcatggcatgctcacgccagacgatgactgtagactatagtactatttcggttgaaaattagcatttgcattattattctattagttagcctgtgttcttcttgaggaggttgggaaccatccctctacacgcaaagtggtgtgatagagtaacgcatgattaaaaagaattaatatgatttttaaagcaattttgttataattgtttttacaaaacatactattaacacgaaacggaaggggtgagttgagaacataagacagatgctttccgaaagaacgattgagctaccctgattaatcaataccagtagcaaaaatgaccagcaatcctgcctcataaaacaatgacatataggtttgctaatgccaactgctaagccaaatacaaattcgtatctgttctagaagactaaaagtagtctattggaaacagaacaatccggtcaaacagaagcatcttgtatgaaaatggtagtccaggacgaaaaagaaaaaaaatgagccgacaactacgttgacatcgttaggtaaacgtaaacaaaattccttacgaaaaaaaaaaaacaaaaacacatgtagacactgtagagaccgatcagtggtccccacgagaccacgaagaccatgtccattggaagcgtagaagaaaagcggaaagagtttgaccgatgcatcggaacacggcccgccacgctggcaccagacggttttgatgggccggaccagtctcggcggctcggcccaccaccacccatccatccatccatccatcgcggcgcatcgtacggtccagagctaacccagcggcgggtccaaacccgcgtgcggcgcggcgcgtcaccatccaccgtttattcgcagctcgttttatcactacttaaccctttcttcgagatttcccttttcttggaggcgccacgtttaaagggcggagtcgctgtaattagagaagaggatttaaagagagagaaggccattctctcttgattgcttggagaggaagaagaacaagagccgccaccgccgccgttaggtttttatttattttttttctcgatctgatccgaggaggagcgaagcgaagaagggcaagatgcattcgacgaatctgctgctggaggagcccatcaggatggcatccatcctggagccatccaagcccgtaagttgctcgaatgctttgatttcgcttcagatttgtttggtttttttttgttgatgaaccctaaattcgattgatctgcggggaaaaaaatgcacagagcttcttcccggcgatgaccaagatcgtggggacgctggggccaaagtcgcgctccgtcgacaccatctcctcctgcctcaaggccggcatgtcgggtaaccaatctgcttgcttcgccatctcctgctcgatcgagctgttcttaaccttcttgtgttggtgttggtgttgtgtggtgcgaattgcagtggcccgatttgatttctcgtggggagacgccgagtaccaccaggaaacccttgagaacctcaaggtcgccatcaagtccaccaagaagctctgcgcggtgagcccccctcctcaccgccttcagatttactgcaattcgattcgatttgattcattcacggtcatggtctcttagtgtttgcttttgctgtttttgcatactgacattttgggtactctactccattggcattggcaggtcatgcttgacacggtcggcccagagttgcaggtggtgaacaagagcgaagcctccatctccctcgaggagaacggcactgttattctcacccctgaccaggggcaggaggcctcctcacaagtgctgccaattaacttcgctgggcttgctaaggtaatactccctttcagttcttttttttttccgaaatcttattacgctgtgcatgaatggttgcaagcgcataggtaggagtacctttcagtgctatttatgcaaaatcttattatgctgtgtatgaatggttgcaaatagataggtccttcttttatggaacttgctattttgtcactgcgatttccagcatatgctctgtttgatatataaaaaatgacttattgttttgtttgcaggctgtgaagccaggtgacacaatatttgttgggcaatacttgttcacaggcagtgagactacttcagtttggttagaggtaaaaatattcggcatactgcgcttagcgttctgcatttttttttcttatgtcattgtcagtaggatttgctttgtgcccacattttccgataccaaaactctaatttgtctggtttaggtttctcaaattaaaggagatgatgtggtctgtgtgataaaaaacacagcaactctggctgggtcgctcttcacattgcattgctcgcagattcacatcgacttacctaccctatctgatgaggacaaggaggtaaggaactcatttcagaatagtgatatgtatctccttatgtatttgtatttgatgtcttcctttatggaattaagtaaaatgttgtatatttttccttttggagcaccttactcaaaatctgtcctttatggaattaagtaaaatgttatatatttttccttttggagcaccttactcaaaatctgtccgatgccttaaatgcttatgagcatgtactgctttcaggttatcagaaaatggggtgccccaaacaagattgacttcctctctctttcttatacaagacatgtagaagatgtgcgacaggtaatacatttttttctcaacgttcccggtgttttgtccttggaagtaaccattcattgaaaacatggcattgctatatccaaatatgtgatctcctgtatgttttcatttggtacttgaaaaggaagttctaaacagtgctgacatctttcgtttcaatacaggcacgtgaattcctctcaaagttaggtgaccttagccagacccagatttttgcaaaaatcgagaatgtggaggtatttacaacatgcacttttaacatctctgagccagcttctgtttgttgtacagcctatcaaccccctatctatttttgcaggggttgaataattttgatgaaatcctccaagaagctgatggtatcatcctgtcaagaggaaaccttggaattgatcttccacctgaaaaggttagtatttctagcttacgtcgagcacatcagaaggcactgcttaattgtacatccgctacacttagtaccttattaacaagaattgtagttttctcaaattatggtgcaatacttgt

SEQ ID NO: 12924 - DNA, 1796 bp, Oryza sativa
gctgttcacacggaacacattttctcatattcaattgattaaagtctatgaggcaagcattcttttttagtctgaactggttccttcactattttctaggtgcgagctgctattaaagtgaaggcgtctgtcataatttgcttcacatcatctggacgtgctgcaaggtagaaagactgaatataagataagtttgtatcttaatggaaaactaatatcatctctaatctggcatctgtactatctgcaggctaattgccaagtatagggcaaccatgcctgttctatctgttgtcattcctcgtctaaaaacaaatcaactgaggtggagtttcactggcgcatttgaagtacgtgatcagcctttctttttctactatgtccatgatctgtttctaactttctatacagatgtttagcttgtcttgtttggttaacgcttagctgttgtagctcatatttcttgtatccttgttctgcaggcaagacaatcgctcatagttagaggcctctttccgatgcttgctgatccgaggcatccagtaagtttggcttctttgttgactacagaaattgcaaaaatattcatgcaaaacatacttggtggatttattttcttgcaattgaaaggcttggccttgtcatgggggctttttcagattttctaatacattcaatataacaaagcttagtagatagaagcgtcaaattttaacatgatagctttcttgcttgcatcatgttccacaattattaacacttcatatatgataaacgtaaaaacaactggtatgcttcctgcattgttaactgaaatattcttgaacttgataagctgatttgtagagaccatttaggcgcaataagccagcttattaagtgctattattctcgggtgcaaattttgtaatcatctttcacttcgtctttcaggctgaatcaaccaacgctacaatgaatccgttttgaaggttgctcttgaccacggtaaagtttctggtgtgataaagtcgcatgatcgcgttgttgtctgccagaaggtgggagattcctcggttgtgaagatcattgagctggacgattagacaagcagcttgtgctcgtcgtcgatgatactatggcatgttttgccagattttgactaggccaaaaacgttgcttcttggctatgtataatcctatagcttcaaatgagcagtttttcctatggtgtattcataggatttgccttacagcttgaaaccattatgatttagttaaggaaattaaatttgcgcagtatttctgtatcgtatcacttagatgggcaaagggaataatgaattttggtactgaaaccttttaaaggtcgatgcgacctatttttcatggatttttcgtaatgctacttgacgtccatcaaagtgttcatctgagtctgacaagggacaatcgatggttgatcccacggtcacccaccatgtacgaaactcgagcatttcaaggaatatgcagtagtattgtctcaaaagcacatgatcacttgcttgatcctttacacatttcataccaataaaaaaattgccttgtaatgccaactctcgagtacaatcctgccatggttccgcagatcaaattggaaagagcaggcagctagtcaatacaagtaaatttcatgctccacagccattacagaaaaaaatctacggaaaacagctgacatgattgtaattagctcctacaacttcatctctgtcctataccaacttttgaagtttccaatctacaagtcgcgggttttacacttgaatgtgctg

SEQ ID NO: 12925 - DNA, 6509 bp, Oryza sativa
tgcagccctttaatgatagattcgagaagaactttagcaacaggtgcatctaagttattgctgtcaacaaccattctaagagccgttcctagaccattattagtccatgcattcaggcagccgtcccaacaaaccaacattttactcaccattccaggatcagcaagaacccagggcttgaaggactgcaaggataaatttagaatctgtgcaactctgtaaatctccccaagagcaataaagaattggccacctgtgaaaccagcagaaagcatgttatagtcaatcttcttttaaatgatcagtgagaaaggaaatgataagctctgctcattgttccaagtttttgcaccttgggaaattactacgctgcagacatttgattgacaggattcttgccaaagcaccacaccatgctgcaattcttgagcacagaacagaagcattctgtaccaggcacggacgtaatcacgttgctcctccttggatgcttgctccaaggtatgtaatgttgacacgctgtgcttgtagagttcaactgccaaactcatgtcttccagtgcttatatttgagtatcagataagaattataaaaatttaataacccaagaaagatcgcattatgacccacgaaaacaagaagcagaaggtagaatggtaaactgcaagattaactgcacatattgtatactgaaacaaagaaaaattagttgtgtgccatctacagattttcgttgttttgtataatctacagatcagttaggaggcaattctaatgcggaatatggaaaagcactaatccattcatttccacataattatgtttatcacttatagaaaattgtgcatgtgattattacatgctatccacctaacaaaacaagtgtattgatctcgagtaacttgagaataaattgcaagatttgaccatctaatgaaatagtttattttgggtctagctcaaggaggtaattcctaacaagtactagtaataagataggcagtgtgccgaaacattatattccccataggagaatgcataccatcggtatcttttctattaaatgatattcttcctcaaaatccttcaaatgaacctctctggcactgtcaagcagttcagaaatgaatacatcctttgcagtatgttcctctatacaaaaaccttcaggtagtttctcacagatttcctggagattatggaaaatgtttaaatgacggactatattaaattcatttttttttgtgccaaacaatagtttcaagtgcttgagtgcggagcacacctgaatctcccttgcaattgctgaacttccctgttttcattagaaagcatagaactcttctggactccatgttatcaaatgaaaaggcactatcttgtgttgttttccgttcaaaaaaaatgttatcaaatgaattgcaaaattacaaacagaaaaataccagtgatttatcaactgaatgtaatcagtggttactgaccttaaaatccttcccattccgaaatattactgtcagtgtttcttccctcagcttatggtagaaatcaatcaaagtcctatcgcttgaagatttaattgaatgattttcatctgtttcaaatgaagagttctgatcactgatcattagtgtacatcacatgaaattaaaaagaggggggtgatagcaaactcaaaatagcaaaaatactcaccatttcattatttgagaacatatcagaagggctctgcacactttctgaagaactttgtgtcatgtgtacagcatcaaccagctcagtttctttgtacaggtcaagtatggctgcatcattaggacctgtggacttacaagtttcaatgtggtttgtagttcgaacatggttcaaattttcatccacactagtaaatagtgaccagtcttctgtcaggaatgatggtgatgatgctctgccgcaagacaatggcgccaagactctgtttgatggtgatgagaacgaaggaggaaggaaggacttatcaccacagaggaagcgggccaggtttcctaacaaacttttgagtgggcctgaatgggctaagtagctggcaagagaggagaggtggcgtgagtgagtggtgctgtattaatactcgaactcttgtaacgaattacttgactaatagaatctggaggcaattggcggcggaggatgcaatccggttggattggcgtgagagaaatctcatctgtgaaaattgttcttgcttgcaagttaggtagctaacatcttcctggtcacttcccaatgattttggtacatcctgtaatgacgaaattattcagaccaatcaatggaggaagccatagccatatcaagacttaatacaaagagaaaaggtttagaaagaagtaatgataggatttgcaatgctagaatatactatcaaagaagtatattcacttgtttttttgcgggaactacaaaaaaagggttatttgtgaattaaaaaaatgaattcctgcctaattctacaacacctataacaatttccaagtagaattaataagttgctaaggcagagcttcacacttgatacagatacagaatgtaagaggaaaaaagttatcacatccctttaggaagcttgatcattcaatttgaacattataatcatgatttattgattcagttttgtgagactggtcgcgacgtccgtttcagcaaaggttatcttcatctctgcaattttctaagtgggctagactatctgagcctacctttcctttatcaccagtttgcctttggtaaaatgccttaagtaaacagtttccacataatactatctcacgcgggcggctcggggagcgaaaaaccctagccgcccgcgcctccatcccttccccccccccccccacctcgccgccgccggagcttgccggcggcaaagccggcagcgagcagggaaggcggcggcgaggccttctttgtggcgttctccctcctcggcgcgacgtggacgagatgatgacgaagctccccaccggcgtggtcaaaggcggcaacggcggggatgtgtggggaggcggcggatccggcgcccccaaggccggatccggccatcccccgcctggagctggcgcggcggcggcgcgaggcggctgggcggcatgcgaccgtggtggcggcgcgcggctgccgagcggcgtggtggcgtgcggccgtggtggtggggcgcggcggctggcgttctccctcctccgcgtcagaggcggcgacgacgggcgttctgctcctccacgtcagaagcggtgatggctggcgttctgccgagcagcgccgtcccaggcgtggaggctgctaggcgacgtgcggccgtcgtggcagcggtgcgcgtagccaagcggcacggcggcggtgttccgggcgcggcggccgtgcctcgccggtgtgagcgcgagcggccaggcctcggtggctgggcaaccgatgccgccgtggtggccaggtggggagcggcggccgggcaatgggagcgccggcgggtggcaccggagccaaagcggcaatgtttccggcgtcggcgcaggcccagatggttgtgctaagggagctggcggcgataggtcgtcttcctcgttgccggtcagcaccctcacccttcctagagctcctccccttctctgtggggagtttctaagctggattgaggcggcagcttgttagcgggagaagctcaggctgctgaagcaatgccatccaatcccgggttctccttcggccagatctggcgaggaggccggcgggtggtggaacggagaggtcctgggccagttctcagggatggtggttcgatgaagccggccgacagaggggcgtcggtcgggtatggcggaagccatgtgctgccgatgttcagatggtggattcggattgggtgacgtaccatggtggtagggggttccgagcgaaagcttagcccaattctttgggccaacagtgactttgccttcgggcatagtaaccctcttgagggcactgttgaggtatccctcctccctcggcaaggagctctgggtgaaaaccttgtccagtctttggatggatgacgtcggcgtcttttggcgtcgtgaccctcgtgagggcgttgttttggagtcttcgtgtcgtagtggtgtcgttagctcggtggcgatcggtctcgcatagtgatggccggttcggtgcttggctttcctctctgtagtgtgtgtttggacggttgacacatggtttggggcgtgtgctctggtgcacatcctttctcgacagccagctgtcgatgtaaaacgtacatcctttctgccagctgtcgatgtaaaacttttcttgtaactttttctttccatcttaattacattgaatgacctttgaatgacctcctttggtcattccggcaatataaataggcacagcattatgtttttttttcttgttaaattgaactgtttcgtatgattttacatttgagtattgatcatgtacgtttggtgggaatgaattttgcatactaccccgggtttaaatatacggcatccttaacttcttttaatttattttcgtttttttaaaaaatatttatataaattagacaaatataaaaaagcatgctaaaagtacttttgatgggtcatctattatcactcttttcatttttacttacctaagtaattaaataaacattgtcgatcaaagtttaagaaaaaaaataaatagtgctgcatttagaaagggagtgagtgtgctgttcctccgatgaaagcaaatggatccttgacgttgagtgaaggaatcccttgcattcataggcaaacaatgcttatttcaaacttcattcgaaggtaatttgcaaaagataaaaaccttcccttcaaggtattcctaatggactaaaagttctaaacatcaacgcaaataaataaatgaaatcaagggacgccttgtcgttgtcgcctactcgccttgagtagaaactatagcatcaagccacatattgttcaaaaaaagtgtacccacaagcaaaaggttaaaagctctatacgaaccatagctccaatgctcacgaagcacaaaaatgtcaggagtttctaacaacaatatttgacaccgattgcgtgctgcacaactcgaatttccaacctacagtacaagatggtcaatactgcataatttttccagtaaaacatgtcctatccctactcatccttgcgtttgaacagtttaacaagatagccaattaaggagaccagccatcgccagaagagaactaggaaatttgacgccttcggtttgggttcaggccttggcccgaacagacctttgtatagctccttttgtttctggtacagagctttatcctgctccgcgagcgaccgaagctcgcgctggatctccttgtcttctggagaatacttcttggccttcaggaagtcctcccttgctgattctgtttgaccaagttcagctctagcttttcctcgtctgaacaacgctttcacgttgttttcatcctctgacaacacctgaagaatgagattatgcagttgatcatgatcagcaattctttgattcttattcaaatggtcaatcaacaggtccgtgaatcaatacaaaaccaaaatcatggttgttttacacaaatgagttggaaaagattacacaagtacactaagatcagaagagtgtctttcatgaagaatcatggacaaatatttctccctgctttagccatatgcctgttttccatatttattttgcaaatttttagtgtctgaatgacaaatcaaattcagttttttcttgtgttatacatgtaatgttaaagcatgagtgtaagagtaaattttatgcaatgtagaagaataacatacaattgtacactgtgcgatagcttcatcaaatctcttcagtttgatcaggcatgcggccatgttgagatggcagggatttttcacagctaaggccatgtctctgtacttcccaaacaattgaaacatgaaatcatcccccatgtatgcaattgcctgtaaagaagaacagctagggggattatgattgagcatcttacaatagctgaagaatgacatcagtagacaactaaccatttcatattgctgcatagcctcctcgaacttcttttctttgaaatattcattgccttcaatcttcctcctgtctgctgcttcaatcctttcttccactgtcatatcacttcgggcttttccctgtagttttacattatctgtaagcttcctaggaacctttggttcacaaatatttttttaaaaaaaatcaaaatcaagggtgataagagggatatttatcctacctctttgacatcatcaaacccaataagttcaacttcatatacaaggtctgccattggagggacatttgggaatgaaaagcttccttctttcccatagccaagctcccagttaacatgtaacaatgcacgctccccacttctcatgttactgacaccaatgcctaaaccagtcatttcctt

SEQ ID NO: 12926 - DNA, 659 bp, Oryza sativa
  unsure (1)..(659): unsure at all n locations
ctgcctgtgacctttgtctgcctctgaacaaattttatattactccatgaccatacaaccttcctagtagctcactcactgaagaacagctactactactagtactgtagtatttgtttttctttaaatttctccaagacaaccaatgcgttcgatctgtcaccctgtctacagtgctagctaagattatgggctttatttttttttaagttgcaacaaatctgttccctaagattcgataccatgatgatccacatagagatgataaaaagtcaacaccgtgcagaggctacagcggctttgataaatctgaccctgaccatgaaaagagagacaccgaaagatgctccctcacatgccctgccaatgattcacacaccataccaacagtaagtatatagtactcttactatcccattgcaaactgtaattaagtatcaaatcaaaataatcataaccatgcattagctagggtaattaagcttttattttctgacagagatatgtcatatcgtatgtgtatctgtggtggtagctagctgagaaagatctcgagccttgagtagtcaaactgatcatagatactcctactgtctaaactaaacaccaagctcggttannnnnnnnnnnnnnnnnnnnnnnnnnnnnnnnnnnnnnnn

SEQ ID NO: 12927 - DNA, 541 bp, Oryza sativa
tgttttaccaaactctagtaaatacataaaaaaatcgtcccaaaacttgataatattattaaattatcaaaattctgatattgttaaaatttaatcagatttattttggcgataaactgaacgggcccgttcatctcgatcgtgggtgggtacgtgatcgaatggactgaattgggtgtacgactagtcgatgtgcctgttcaaccgatcgtaccagtcaacggctcctgcagctagagctatagtagctcgatgtccctcttgttgctgtgcgatgctctgtagctttcagcttgtcactgcttcactggtgactagtcagcatgcatagctagtcaaactattctatatttaattgaatttatagagaaaacataatatttgtgatatatcaaataaacaccattacatacattatcaaatatttttcatagtttacttttcagatgtggtagacattaattatctcgttttctataaatatatagtacgtaaaacttaagagatacgatggtgttttacttgcgacaaactcagaatc

SEQ ID NO: 12928 - DNA, 5140 bp, Oryza sativa
ctaattaaatattttatacatgtttattttgtttagcaaatacttcctccgtttcacaatgtaaaactttctagcattgtccatattcatttaaatgttaatgaatctagacatatgcatgtgtttagattcattaacatctatatgtatgtgagcaatgctagaaagtcttacattgtgaaacggagggggtatgttataacaggattattatatttagaaaattatttcaattttgaaggggaaaatgtttgtgacagttataggagatcttgcttctttgcaaggtacctattccaaaaagatttggaatagacactaaccgcttgatatgaaaaagctgaaaacaataggcaaatgaatatttggtaatgtggcctgaataatgttgtttacatgggctgtgtttagttcccttcaaacttccaacttttccgtcacatcaaatgtttggacacatgcatgaagcattaaatgtgaacgaaaaaaaccaattgcacagtttgtatgtgaattgcgagacgaatcttttgaacctaattacgctatgatttgacaatgtggtctacagtaaacatttcctaatgatgaattaattaggcttaatagattcatctcgcagtttacacgtggaatctgtaatttgttttattattagtctatatttaatactttaaatatgtgtccgtatacgtaaattttttttaccaaaacaactaaacacggccatgctcaagtatctgaaatgttgtacatggaaaaactgtagtattcattctgaattgtttgtgcatgttccagtatctgaaatgcaataaatgcaacagttattactagtgcattgcgtatccatccttttgatctgcacttcacacatttccatctttcgcagtagatgccggcatgccgcagtagatgctgcagaaaatttgctccagctgctgtacagctccagagttacagctgttgacatcattgtttccaagtaaaattaaaggaaactgaaactccctctcccatgctctcttatatacaaacttccctgcaatttctagtgtagagcatatgttttgatactccagtatttccttttgcttctttgccggaattatcgaaggaggtcattcaatataattaagatagaaagaaatgttacaagaaaagttttacatcaacagctggctgtcgagaaaggatgtgcaccagagcacacgcttcgaaccatgtgccaaccgtccaaacacgctacagagaggaagccaagcacggaaccggccgtcgctatgcgagaccgatcaccaccgggacaacaaaccaccacggcgcgaagactctacaacgacaccctcacaagggtcctgactccgaaagacgccgtcgtcatccatccaaagaactggataaggttttcacccagagctcctttccaaggaaggagggggtacctcaacaatgccctcaggaggcttaccacgcccgaaagcgtggtcactgttggcccaaagaaattgggctaagctttcgctcgaaatcccctactgccgtggtccgtcgctcaatccgaatccaccatctaacaccggcggcacatggcttccgccacacctgacctacgcccctccaccggccgacttccagtcctgccaatgacaagactgccatagcaccggtcacctccgccagcgcgctgacccaggctgcctccgccacgccgctcgccggcctcccagtcgaatccggcccaagggtgcctggacaaggaacaacattgcctcagcaaccagagttttccttgtagaccgaccaccaccttcatcctgccaagaagctccccacagagaaggggaggagctccccaaacagggttagcctgcccgaccgcaaggaagacgaccctgccgccagcgccctttaccacgccgctactccctagcacgctgacccaggccacctctgccacgccgcctgtcggcctccacgtcgaatccggcctatgggatctgaccgggaacaacctcgccttggcaacctgagtcttccctgtaggccggccatcgcctctacccgtgcctaaaagctccctataaagaaggggaagagctccttaaatatagtggtaacctggccaaccacaaggaagacgacctcgccgccaaacccaccgccggccttgtcgatgccaccactccgccgccaccttgccgcccaccaacggccactcgggccactcaacgtcgtcggtcgagcctccaagccacatcgcggcggccctaggccgccgatgtgggccgtcgacatccgtcaccggcgccaccgctgccatctagccgcccggacactacgccgcatccagcgccgtcgacaccgacgccgtccagcctcagttgcctagctgtcgcaccaccaccaccgttgtcgtgcagccgcggccgccggccctgcagcttcccggctagattcggcccagggaggccggatcccgccgcgtgggggccggatccgcggctgccctcacttggatgcgccgtcgccgccgctatccacaaaggttcgtcgcgccgcccgagcctctgaccgctgtcgccgcccccaccatcgtggacaccagatccgctgccggggggtggatccaccgcgccggctgccagatccatcgcgccaacgcccgaccgtcgcctcccgcttctcgctgccgctaagcaaccccgatgtcctcgccggctgggtatcctcgtggggagagcgccccgcagccgccgtccttgcaaccgtttgactttgctggcgagccgctcgggcggcggcgagtcgaagggggggaggtgggaaggggtggcgggggagagtttttcgccgtccatgtcgcccctgggacgggagcgaggtggatggaagcgactcagagaatccttactttagagcaagtttaatagtatagccaactattggctccaaatcatctatagctaatctaatagaccattcatataataattaactataaaaatatactacatcattaatacccaatcccacttgtcatacacacataatgtcttggagtccatgttgcagctaactacaaatttgtagcccgcttttttctcttttcttctcgatacgtggttatagctagcttatagcatgctattgtacatactcttagtggttcttccttttgcttattagagcaggtacaatagcaagctataagccagctgtaaacatattttaaagagataaaggaagagagagaagagcagcgggctatagatttatagccagctgcaatacggactccaagacgtaatgtgtgtatggcaggtgggaccaggtattcataatatagtaagcaactattgtatgaattggctattagattagctatagatgaattagagctagcagcgggctatactgcaagtttaatagtatagctcactactagctccaattcatctatagccaatctaatagctaattcatataataattgcttactactatactattagtatatggtcccacctatcatacacacattgtgtcttggagttcatgctgcagttggctacagatctgtagcccgctacttttctctcttatcttttatctcattaaaatatgtttatagctggctaatatatagtctactattgtacatgctcttagctcttagagttgtagtctggtcttttgattcctttagcattttctttctatggatgatactagcaggtataataagggctaggatggcatcagtggccttgtttactcagatcatttcattcgttttacagcaacgaggatttcgtgcttttacagttgcagcacatcatggatttgactgggattctttattgttcactttgaattaactccagttttactgatcaaccaaatgaactttcggtcttaccccgtcagaagcctaatggacagctgtacaggcagagtttaaacaaaaacagaattgtttcgctttgtcaattgatgttctcataaagtactacacttttaacagttctcgtactgtacgagagtctcatttggagactgccctgaaggtttactgtaaccgctggaaaatgaatgagggcctatttgggaaacagggacttaaagtccctgtcacatcggatgtttatacactaatttaaagtattaaacatacactaattataaaacctattctataaccttggactaattcgcgagacgaatcttttgagtctaattacaccacgatttgacaatgtgatgctatagtaaacttttcataattatggattaattaggcttaaaaattcatctcacagattagctttcatttatgaaattagtttttttattagtctatatttaatactctaaattagcgtcaaacattcgatgtgacacggactaaaaagttttagccccatctaaacacccccggagtaaacaagaatctgcttttgatgcctttttatgcaagcctgggaattttaaagaggaaggagcatagggaaagctgctctccttgaggtaagaaaaatgtgtggatcctttacttcaatttcatttatatatggtcccaccattttatttcttcacacgtcaatgtctgtaaaccccacatataccaatacaaaataagaaaaattagaatactcatactttattaactctcaatgaaatcattttctacttttataaattctaatacaatgattacttaaaaatatatatttatttcgagataaatgggatgaaccacaaatgaacgaagaaagtaattaatagtagtctctctggtactgtaatttcttaactttgactattaattttttttaaattatttagtttgaacacactaaacaatacatacagacgtattaaaaatatatccaaaagctttgtataagaaggaggaaatatgttttggagaccatattgttcgggaatactctctctgcttcactactaaagtctgaccactaataaaatgaaattgtccagtcaagattgattaatttttatagctttatcatgcaagatgcttagttttgtactttcaggtatttatttattaataaaagttttagaatagataatacaatacgggatgtgtttgtactgctaagaaacattgatc

SEQ ID NO: 12929 - DNA, 910 bp, Oryza sativa
tgtgtgtatgagttctcatcgtactgttcattaagatgggcggaccttatgctgtagtactccagtacacttttgcagtccaagtgtccaactaatccagctggttggtcaaaggagagagagatagagacagtcacattaaccccgccatttttgtgcagtctccacctccaaaatctcatttttattcatgtcatctccccatcttcaaattctttttcccagctactactatacttgctgtgctgcctggtgataaccagacacaaagcaaaactagagtgaggtgtctcactgtctcactgttgtttgtcttcctccttggtttggttgtgtccaagcaagaaaaccaagaaaaacaagcaagaaaaccttgtctctctctctctctctctctctctctctctctcatgcttgtacatggagggatcaagatcaagggagtgcattgctgtggcaagtggccatgaagcagcagcagcgccagcaggctacggcctgttcatcagaacagcagattgttccatggctgaagcagctgcacaacaagaagccgcagcagcagcgaaagggtaccggtcttctccctcctcgccgtcgtcgatgtcccccactccgtcacctccaccggcggcagctgtccatggaggaggaggagcggaggatgccgccgccgccgccattgcaacgccagccgcgcggagtttgggtgcaggggacagcggcagcatgcaggtgagtggccatggcgagcatgctgggttgagctccagacggcgtcgtggccggccgaaagggtccgggcggcgccagatccttgccaatctaggtcagtatatattgcttcttcagaaatgcagagttcattacatgattttctttggatttggaaaataccccgtttccattt

SEQ ID NO: 12930 - DNA, 1207 bp, Oryza sativa
tcctgcagccccaattgtatgaagagctctgtgtacgtctcttgccatacccttggcatcaccgcacacatatatgtaaccaccttgtgagacgatgttccaaatttctgtggcctgatatcagcagaaaacctcattgagtatagccatgtgtggggaaattctgtatagaagttcaagaaaagcagcatagtgcggtagaaatgtggagcgtgtatcgaactaaccttctctgtcatcttatgctgcacgtattctttggctggtccttcacgagagaaggcaacaatcagctcagaaagtgcaccctcctgaatgaagttttgcaactcgtcttcatatatgtagtcctgcaggttggtcattcagatgaggtccagtaagagcaacatgatcataatatgtatctcatgaactatcttttgatgcataccatattacggttcctgcatccaaagaagagaactgaattgcccagttcaactccagattgttttagagctaatctttcctgagcaagcataaataacagataaagttactagggccatctcaaatccaaagtaaacagaaatgaagatttgggaaaacaaacctgcaagaagcctctaaatggtgctaaccctgtaccaggaccaatcatgataattggagtggtcggatctgcaggcaacttaaaatttgactgcctcacataaattggtgcccagctacactcttcactatattctgatgggattgcgttctacaaagtagatattgtggaggaggaataagtcaaactgctgtaggaaaccttctcattgtcattgcaggcaatgcaatatagagatatatagagagagagttataatttgtacaagaaactcaccttcatccatgtcgaacaaactccttggtgaatccttcccgttggtgtaggtccataaactaacgcacatgttacatgaattctggaaggagccatcctgtagggacatattcaaggaccagatcttgcagcaagagaacaaatagaacagcaagtcatatcctcaaaatgaccacaaaaaatacattatcagacagtgtccaaaatctaacatgacaccatgatgcaacaatgcagcagtgtctgaaatcgaaaatgacttcattacactataatgcagcaatctagcagttgaagaattcatgctgaccaaggcatgaaaggcactcctaataa

SEQ ID NO: 12931 - DNA, 13734 bp, Oryza sativa
acttagaaagtaataacataaatctagacatcactttgtcaataaaattcaggcaaggagcaataaattgttttaacagaacatttgccaaggaataatcatttttggtggggtttcaacctatagaccagaatccaagttgatattgttagtatcaatttaatttagtcgcaaaaacaggatagatttaagaacaataaaggggagtattaaagaatctaactacaacaaatctaacttgctttagtaaaatatatttctgttgtaaaggaaggctcaatatatccaaaactatgcaggtacatgtggaagcctaagctctgccccataaatagttcaaaaaatataccatgcacacttatttgtatcaatgtttctgtgtactgaagaaaaaaaaatggtgcatgtggtatatttgttgaactagatatggggtatatcttctacatccattttccagaaagcggaaacattccacattcaccaaaaagacaagttgttgtttcacatatgacaaaagaggtttttattcagtatccaaatccaggaccaatcaaagagaaaacttggagttcaagcctagattttgcggatatagaatcaggcaaatcagatatccaacccacttttgtccctacacgacagatatttacatagaaaagagaacacaaagatctccataccatgctgtgaagtcatcctcaatgcactgatcatcatctccaaggccaactgggacaagacgcttgccacctatatgcagcataaattagaataattacacccaataaaggatcaggctgcaggaatatatgtcaggaaatatcactttgttacgtaatgcacgacataagaaaagttcaacatgattttactacattcaggaatgactaactgatgaatatatcaggcagcaagctcaaaggtttacatcagaacaagatgtaaaacagagtaaaacctatgatggaagcataataaggaacaaatataaacatgtattggaatggtcatactatatgccaaaattaaattgctcacaagataactaaattccacaatagacttgttacaaaagttagtaaactaattagaaactgctacaatggaagtgtgccccatgcctgtgcaacaagttgtttcaatatagcaatgcactcgccctattttcccaacttttctccaaatgaagtgtagagcaaagagtacttaccctgctcctctagcagttcgtccaccacctttgcaacctatattttcaatataaataacccagcatcagttaccagaacactagtcaacctttaccaatttatactagcatttcatagtcaataaatttaaccttattaaagtgctcatactgcctatttcccaggccaaaaacagcatacttaagatccttaagccagacttccttttccttcccctgcttcaatgccaaaaattaataaggagatcataaaataatgtagttagaatatgtcaacgaaatggagtcaaaatgactttacacacctcagtgaaccatttgtagaatcttgcagcattgtcggtaggctccccatccccatatctacactcgatgaaacataattagctacagaagtcattgacacgtagcaagtgaatatagccacaagagatacagtatgtgcaactcatgtaaaggcaaagattgattgttgttcataaattctagaatgaaaggaaattcacccccaagctagttaagttctttcaagatgccattcaatggcattagttcataacaatccggacaagaataattgagctagctcccccacaaaaagcccacgtgttcaactctcacccacaaaaaacccacttgttcaactcttactcagatagcaatgaatccctctaccattaggctcattaggctgctatataattcatctgaattgcgatgtttgctaatggcatagctgattgacggcatagcgatgttccctatgttatagacttagggtagcttttgtaactatagaatctcaacaatttttgtatgacatacatgtcacttgagctttacaacaaaggtaggtgaattatgtaacccccgctagcgacaaaaggcacaattcagcaatcgaccaatcaaaatagcaaggggactcacgttgctaggaagagcaacacgatagtttccttcctgagcttctcctcgtactcctcatcctcagctgcatagtcatcctacatatgtcccacacatatctcagattcctaacaccaaagctcagacaggcgatctagcatacacatacacacaaacacatgcagatcaagatcatcacaattaccagatccacaactttgaacaccgccttctcgtaccgcgccctcgcctcctctgccatcgcctgcagcaaagcaatacaaaccgaatcgaatcgaatcgagtaagtacacgaagattaaaaaggcaaaatcgcgcaaaaaaaagaacaaaggaggggaacttttggatcggaggcggatcggatcgaacagcgaccttagcgaagccctcggcggtgccggtctgcgtgccgaagaagacggtgacgcgcttccggccgtcgtcggcgtcggcgtcggcctcgatcttgaccggcggcgggcgcggcggcggcgcggcggccttgggcggcgcccctccaccggatcggaaccacacggcgaggatgaccaccccggcgacgagcgccgcggccgtggcggcgagggcggcgagcgggtcgccccccgccgcggcggcgagctccggcggcagcacggacgccgcccacgacctcgccgcctccagcgccagcgccatcgccgcgccgcgcgcgagggaagcgagggtttggttggggaggaggcgcacctacccccaacaacaactgctgctgctgccgctgccgctcgctggcctacgctgctggagaggggaggaagacgagttgttgcgggggctaaaagtctcgcctttttctgctgttttttataaagtcgctgtcttttgcaacggaggaggcgagcggcgtgatcttgacgtgctttgcgcttgttgttgcctttctcgcctgattaaaaactttttttttttgccccagcagaagaggagaaagctgcctttgtctgaaccctgcactgggatctcttttcagcatctgctgccgtcctggatgatccatcttgtgatgcaaaaattgctagatgaaaagactttttcgtttttttaaaataattataagcctactaaagaaagttgaaaacatgccattaatatttttgctattgctttcaatttcgtaccaacttaaacaaatatttttttcctgcgatgtgacagctacaagagctttagtacagcgtctatttttttctccgttccgaatataagaggtttttatggaagtaagaaagtatgtagagctgtgatgctctatttgataaatggaagtaagaaagtatctggcgatgcttgacagttgttcgggctatctagcagatctcgataataagaagatgttcattttttttttcaaacgcgtaaaaggattgtacgtcgcatcgaatccaaacagcttatgcccaaggggggagggagaaaaagaaaaataaaataacccgagctaggaactactatgacggctaaaaacacaactccaaacacgtgggagggggtagagccacgctacactcccaagaaatccctaaaaacagcaacaccggctaaagaacacagctggccctctgagcggatggactccagaaccaccaggaccgaagcgagcgcagagtcgaaaaccctggagtttcgttccttctacagctgccaggagactaggagaaccaaggagtcgaaaccgatgcggaggtgctcaggtaaacaggccctggaggatgaccactaatcctggagccagctaccacgagggggagagagggcaactcagccaggaggggacatcacacggaattagacctgtcgagcgaacacgcagttaatgaggatgtgattcgtcgtctaaaaaaaaaagatgttcgcttgcttttatacagtgttttaaagaaataataatgatagtaggcatctatatttgcctcgtgctggctctaataagttcttatacaagttaaccaaccgaaccgatcaatcgaatggtgaggagcggatatgctatgacactagtggttgacaatgctgtatagtcaagaagtacaagttagcattgttgtgtccactctatatcacatactctcacctttgatcctgcttctagggcggtagttagattagagaaacgacgagaagagttgatgtgatggcagaatttaaggcgaggaagccaaccaaatggcatgcaaaacgaacatataaatagcaagtagtgccgtggaagcaccacttgagaattatgttatgtacttccatataagaaagaatggttatgtgtgctttgcatgtctcatcaagggagatactatgtgctgtggttacggatgggaccagtccgttattgattagtgatcacttgcattaggttatagtaacaaccaaacatagaaaaagaggagttgcaaagtttcaggtgtaaattatctgaaccgactgaataaaaaggttgtttgttccctacaagaaaactctaattctttagccagtacttgcatagagtggattatttttttgccagtcttatatatgagcaaaagagagaaccaaattaaactgccggttgtcattttcttcataacaggttaccaattggtttcactgtcactgtgtacatgatcttcagaaaacacctgagttctgaacagagtgcttgcaagttgcagttgtaaactattcatcgtactatcgtgtcaacgcgatatgtatatatatacggagagaagatactgcgagtttccaaagctagatatatcgccggcactgacaacacccagatctcaaggaagagtacgtacaaacgcgaagggaacttcaggtgcaggttgttctcaaaaaaaacttcaggtgcaggtgctgagaagctactgattactgaatacaagcccagccgcccatgtggaaagaggtgaaaactgaacagcttagcctcatttggcagcaatacgactgtgagaagatcttacgagaattgtatactcagataatcacatatctaggatatgaatgttcaacgttgactgccattggttaattgatccagaagtaattaattaatcagagatgcagagcctcgatggagaactctgaactcattcaagatgaatttgaggagaaaataatatatcagacaacatgccaaaacactcaatcggtttgcacgaagaatttatggaaggatgatcatatccggaaactgaatttgaggcaacaaattaaggcgaccatggtctgcatctaaatcagcaaaaacgactgattcatcctgttgcgttccaggctttcagagttgacaagtgagtgagtgacaaatatatctagatcggtgcaaggcagatgcgtacgcgcatcccccgctgtctttctcaattctcgtgcgtcatgactccaccgagttccaaccctgaacgtcactgacggccactgaacagtactgactcgttcgtatgccttgagtttctttttcctctctgtcccggctaatttggttacaccaacgacggtacacatgactgaccctgaatgtctgcatgagcatgaccctgactgatcctatacagtttctgtctaatctgcatatgttctttcctggcttagatatcggcatatcgctaggtgcatcagaattaccctgaagaagatctgataaaaaaggggatccatccatgccatgcatggacgagcttgcatgccgtcaatgtcacatccatctgcagtaaccactagtcctccaatgtcgccgatccatctgcctgtttttatcacgaaaattcagtaattaatggagaccaagtacatatccacgtactccttacgtacgcaggcagtaatagaacgctgttcatgacagttatgcttctggacacagcggccatcccaatctcagtctcatccattgctatcgtcaactcgatcgaccaaactgttcttgtgcatacgcgtgtaaatcgatccaatctccaaattaacagaagcagacgcttaattgaaatcgacttttatagcatagtacgtagctgatgctacactgatagattcgatatcatcgagatcgacgagtactgatcgagctggttaactgacggctacttgtaactgcatctctgtatatatgtacctgcatatctgcacgttcggacaaagcgtcggtgttcaagaagctatcgagagactgatcgatcgatcgagcagttgagaaacacaagcaatcagtgaacacaagccctcactttcaaagcaagaacacacaagtcaatcgcagacgatgactcacgagagagacggacacggcacacgacgtactccacgtacacgcacagttaagcatgtacagcgaacaagatgtgacacgagcagcgatttgattaactaacctgtaatgaatcgattaattaaccttactaatttgcagatcaattcaaccgtacgtgcacattaccggtcacgattaaaacgggattataataactaactgaattttcttaacgacgttacaaactgatgacaaaaacacaaactatttcgatttcgaaaggaggaatactggatctagtagtagctagaggtttatgtggtttagttacaagcgagcagattaagattgaggcctcatccggctagatggcttcgccgggatgatccgaatcctcctcgccacacggacgaaatccctgacatggatgtattgcaggagaatcagatcagatgaacagcacacagaaatgcgtcaagaataattcagacaaagcacgagatgaacacgaagtgagattaacaagatgagtgtgaagctaattacttccagttgaggtcgccggcgaggaggaggtcgttctcgatgtcctcgtacgcgacgacgtgccctggaacggcattggacaggtcgaggccgccacggtcggcgtcgctgcagctgctcctgccagctgcctcgtcggcggcgccgacgtcgtcgtccgcgtcgacgaacatgcggcggagcgcggcggcgaggctgcggtagccggtgtgcttgctgaggtggacgcggtggcagatggagcggccgtccaggacgacggtgaccggcggcaccacgcccgcggtcacgtcgtcgccctgctgcaccgacagcctcagcatcttcccgcggtgctgcttctgccgcctctcctgctcggacgtcgtcggcgccggtagccgccgcttcgtgtcctgctgctgctgctgctcaccgccggcgccgcttatcatgggacgatggcggccggcgcgattgatcgaagagctcgccggcgcggcgctcgtggcgtgtgggcggcgcggttggttgtgcgtgtgtgtgtgaagagaggcacagacgcacagtgagagggggtgggttaaataggatgaagtggagtgattggagcaccgttctgtggaaggttaattgtgtctttgccgtgtgaagcgtgtgaccgttttgtaggagaagatggagtcatagaggctagagtggagctcactatttgtatgttatccaattgattaaaatttagcttgtataacttagaaaaataaattaaactatggctaactaacgtatacttacattcaaatttattttttcagttgtaacttgtagaagttaaatttgatattagtgatttatcatatattaatctatcttattaaatttttttataattatttagatgacatgtaaataacgaggagatatccctcgaaagttaagtttagaatagttttcgtggagtgtggagctaaggtatggttgcaaattaacgagatcactgtactgcatttaatacaataccagtattcttttcagtttttctttttgtcgtaatgaacttggtttcaattcaaaattatatattgagaattgctagtaattaactagggacgacaataattcatttcaattgaagaaagacagtcatgggtgcgctacagtgctagtacgtgcacggtgtgtgttatatatatatatatatatatatatatatatatatatatatatataacacacacaaacacacaagtaaattgccagcagggacgaccggtgggacgtcgatcgggttgcttgcaagtgagtaaaggggtcgagcagtagtgcagtgccagcaaccaaccaaacccgagacaggaattaaacaaaactagccttcttgccattttctttccccctggggatcgatcgatcgggttagccgcccggggcgtgcgcgcgcgtccgcatgcagcggcgtccggagagaaacgaagaaaaaacgggagtctgctcgtgcaatcccggaggtcgtggtggggggcgcgcgcaccgcacgagaccaccgcggataccgtgtgccgatcgatggaccttcgtatacgtgcgactcgcgcagctggccgctgcaggtcgcgcgggggcttctcgcatgcgcatgcagcatctcgatcggcgccgcccgcgcggcgaccgatctagctagctcgcgtacgtacgtttctccggtctttgcacccgtcgtggtagctggaaaaacgggcggccgcgcggccggggagacgttggattggagctaagctacggagtactatgcgcggttgatttggtgcgagaaacatgtgagttacagttactgctgcctctatcgttgtggttggttgaattgtgctcttaccaggtctgtgttagagcaagttcaatagtatagtcaactactagttccaatttatttatagttaatctaatagctcatttatacaatagttacatactacactattaatatctggtcccacctatcatacacacactgcgctttggagtttgtgctacaactggctacaaatctgtagcccgctgctcttaattacatgaatattgcgtctgtagtaaattaaaggtcataaataatgtccgtgtggattaaattcgtgatcgcgcgcacgtacggtcgtgtgcgtgcagatcgatcgatctgggtgtgatacagtgtacacctacagcgcgtaagttaacgtcctacgtccatggccgtgtggctgccggccggccggccatcgatagcagcatgcatgcacagcacgtcgcaagacaacgtgtgcgcgcgcgctataagctacaggaccacaaggatcgacgaattaatgctagcttcggctgtacggaaccccctgtttcgatcgatctacctagccgcccgcaatggttatatatagattctctagaagatatccatgtcagcatatttttctatttgaaaaagattaaatgaagagaaagagagtaaagctatctactaacttggagatagtctatagagaaaaacgaggcaatagatgagagagctatagatacccatgtagacatactattgaggtggtttactattaatctagtatattgctgagatgtacatgttttatagagagcaccttactttaccattgcgggtgctcttagtgcaatcccaaccctccacctagaatgatatttatggcattaaatacattgtcacgtaggacttttaacttatgtggcactatattaattaagaaagagagtgaagaaaggaagaaactggatctcatgcaagacacagcttcaacacaagaacctatgcactagacactatcaagttttgcattgggagagaataatgtcttcataatagatgaagaataaatatgattggtagagaagagaggtgacgtatttattaatgtcccactttaagaaaccatgggttgtagagtgtagtttctattgtgatgtcttattgacatggcaccatagacactgcttatggacactatgggttgggactgcccttaggccctgtttagtccgccaaaaactttcgcaaaaacatcacatcgaatctttggacatatgtatggagtattaaatatagataaaaagagaaactaattgcacagtttacatgtaaatcgcgagatgaatcttttgagtataattagttcataattagccataagtgttacattaacccacatgtgctaatgacggcttaattaggctcaacagattcgtctcgcggtttccaggcgagttataaaattagtttttttattcgtgtccgaaaacccttccgatattcggtcaaacgtccgatgtgacacccaaatatttttatttcaccaactaaacaggccctcatgccccgtttagatcccaaatttttttcccaaaaacgtcacatcgaatctttggacacatacatggagcattaaatatagataaaaacaaaaactaattacacagtttgtatggaaatcgcaagacgaatcttttgagcctaattagttcatgattagccataagtgctacagtaacccacatgtactaatgacggattatctagactcaaaagatttgtctcgcggttccaggcaaattatgaaattaggttttttattcgtgtccaaaaacctcttccgatatccggtcaaacgtccgatgtgccatctaaaaatttcttttcacgaactaaacaagccttacaacgatgcacatgaacatatatagctagatctatgtgtatactctacgtacgtagtacaattcaattctctgatctatatttattacgacctgtttgtgcatgtatctttgtgctatttgttacgacggcaattgacaggtcatgtatgtgtacgtgcccgcgtgcatctatgaacgatctctctctgctatagctcgtactatatgctctacatagttggcagtttggcaccaaaaactaaacaacgtcgtccgacggtacgtagcacaataaaataacgcacgtaacgcgagtacttgtacgacatatagatgtgtgatgcatggtgtgcatgtccgataacaatgaggactgaacgcatatatatagcttggacatgctctcgatcgatcgtctcgagaaagtgggtacatcccttctttctatataaagttaagactaaaagctcaaacctcatgctttcacgtcatcatcaaattatgaaccgttggatgaatgcaatagatcgtttctcagacgttggatggaatgtagcatagagcccaacccattagtcaccgggtgagtctcttcgcctcctcagtgtcaaatgtagctcacataaacacattggcccatctccacacacatctacatgtatctagcccgtcaatccgtataaaagagctttgtggctgaacgccccttcagttgacatgtgctacctaatttatctataaattttgaatatgactgctaaaaagaatttctccaagaaagctattagtttcttcttgagattgtaccttctatttaacaaattgatgtaaaccaaatcccgtggcaaacgcgcggggcatcctctagtactgtcaagagtttcagagcctcaacatcgatcaataaatggaattgaaagggacaattaaaacaggcaagaaacggaagaatgaattgcatgccttaattttcttgtccatcgcatatgcatggtaatctcatgcatctattgcgactatgcgcaaaaatgtactgcatatgctctttcttttatacaattaaccaacacgaaagtgtccattttacgtacgcagctcggcaggcattgcatacatccgatccaaacgtacatgcactgatgcacgccggccgcatgctttcctaggctgatcgatgtgctctactatgcagcacgcacatggatggtgagctaccaaagctagctaaagttatttctagctctgtccctaagtcaccctgttcccgcactacacatgataccagcagtactcaacactgtttacttgggtcatggttaaaaaaactaatccatgcatcgaaccggtccatgcgcgcattgcgtacgtgcgtgggctagctgttgcagctattgcgctgctggacatttttaggcagcgaattcaagtgctagtactactagaagtacgcgtacactagttacccactatccggcaagtactagcccgatcaaatttaagtcgaacaagacgaatgttctggcctgcatgcagcagtgcagtagtaggcagtagccaactggcaaaatgtgcgtacgctggcttcttcaattcggttcatccgcccgtccgccgcccaatcgccgatgcgtgtacgtgcgacgaggcggacgcgcgcgcgcacgcacgcacgcccgcccgaccggcgccgtcgcgcgtggctgggcgcgcggtgcattgcgtttgcgtcggtgtgtcgcgcgcgtgcatgcggtgctcgggatcggttgcgtcttgcgtggttgcctcgcaatgtcatcgagagcttcgatgcaagcgtggtttcttttctgaattccatgcacgcgatggtcgcactgctgcgcttgttgccacggctgttcgcctcagttgtaaaaagggagaaaaaaagggactatccgaaaaaccactacaagttttttaaggaagaactttcaactctaactacagtataattgtaatataattccactatagctaattataactataatactatctccgttttatattataagactttttacctttgtctacatttatatagatattaatgaatttagatataatatttatgtctagatatattaacatccctgtgaatgtgtgcaatgctagaaagtcttataatatgaaacaaatgaagtataagttatatataagtattaaaataatactacctccgttttttaatagatgatgctgttgactttttctcacatgtttgactattcgtcttattcaaaaattttatgcaaatgtataagatataaatcacacttaaagtactatgagtgataaaagaactcataacaaaataaattataattacgtaaactttttgaataagacgaatggtcaaacatgtgagaaaaagtcaacggcgtcatttattaaaaaacggagggagtaagcatttttgactctgatacagtctccgagatgcttctttgactaacaatatctataaaagtaagatattttaaataaaaaagttactcctttcgtttcacaatgtaagtcattctagcatttcccacattcatattgatgttaatgaatctagatagatatattaatgtgaatgtagaaaatgatagaatgacttatattgtgaaacggatgaatacatattattatgatattttgtttaatgataaatctagtaatatcaattttacaagattgattttttatttttttattaataatcaaagtttaaaatatttaacttgtcactatattaaaaatgcttatattttagaacggatggtgtattaattaacaaaacacatagtcatcatgtgagtttagtagggtagatatataaccatctctcctaggctcctagctacagctttttaataattgagtgcgtgtaactcaagtaaaaataagaaagactatatctagaaggtactgtgtacattatgcactcttgtcaccttgcatattttacggtggaatttaagggcttaatttccacgtgaactctttgtttacactattttaaaatttccatgtactacctcacgacaataaactgttcacttggatgtactaa

SEQ ID NO: 12932 - DNA, 1709 bp, Oryza sativa
agaaaaagtcaacggcgtcatctattaaaaaatggagggagtatatgtacagtgcggttacactgtagttacaatgtaactacttcctccatttcataatgtaagtctttttagcattatccacattcatatagatgttaatgaatatagacatatattatgtgagcaatgctaaaaagagttttacattatgagtatagtataattatacaactatactatactatagttacttttgaaagtttttttcctaaaaaacttgcgagaaaaaaaagcaaccaggaaaaaaatatgactaaaatttttgtctatatgttattagtgctttaaaagttaaaaggctagaaaataggctacgataaaagaaaaatcctagagcaactaagtttcataattcagttacaggcttacagctttaatctaaaataatgtttcagaattcagttatggctgacaagccaacaagcagatgatatgagcctgcgcattggcaactgcccaggtcggttatttagatctaaggtatcttctgcatttgctagttcaatagatttcccattggcacaggatagcagcacaagtgcacaacacggcaattaagccccaaaaatgacagcaaccaaagcagaacaggagagaacgggccagggccacattaactgaattaattgaatgcaactatgcaaggagactttttacatgggcgacattgcattgcatttccttgtttctgtaatctgtatacattacaaccacccctcctcctagatgcccttcagatcttttgactattgcaacgtgcaataattgctgctgcagatcatggacaaactaaccgacaccacgtgattttcccggccgtgtcaacattctgccagctcctgccagcaggctgagctctgctacggaggagcaactcaccagaattaagattagtaaaggcttcaagggtatttggtacaataattacagtgtccgtggcatcaatcatcgcctgcaaaaaaattgggagtcaacacttaagatcacagcgtatatctgctcatatgccttccagagatcaaccatctaatatagccattggttgatttcaactacatgccaaatgctactactagtactatcaaaccatggcaagaacaatttcttacatatgaccaccacaaaacatgcatggagtaagctgtcaatgtcggagttcttctcttttcatgaaattaatgaagtttgattgtgacattgaaatgaagaaaaagtagtctgtaactctacttactggattgtggatcaacgtgaacgaagaaactggcggcaactattagataacacaagatcagcataagtcctttcaagtagttcgcaacaccatcctgtggaaacatagaaagagcgtgtgatcaactggtgatggttgagatatcagaacctatgccaggtaattcataagagagctatagcagatagtgtgaaaatgaaataacaagaaagcctgatcagcatattactattgaaggtttactgggctaatattacaagcgaggtgggacaagataattaaagccactactgaaggtaaaaagtattacataaagtaggtcagttctagttcctttaaagagtaagcatttgttcattggataatatgaacattacaacactaaccaatagcaaccaccgaccattatgcttgagaaagacttgactgtata

SEQ ID NO: 12933 - DNA, 597 bp, Oryza sativa
cccccatagttcattttctaggagtagatctgctagctccactccaaaaaatggaggatctggaccgtttggcacagccccggctccaggtaagttggagttgggagctagagctgtgccaaacagggccctgcctaagagacagagcggctgtatgcctatatcagtgtaggataacaattgaagcgaagttgttacttatcgtacgtgcatacacatttgtgtttacagttatcctcactgaactctaagatggcagcatttatggatatgtggttgccagggctgctttgagattcttcaactgactggctcctttacaattgcggaggaaggcgttcggaggagaaccggcgggctcagtgtctcgcttgccggccctgatggccgtgttgtcggcggtgtagtagctgggatgctgcgagccgccagccctattcaggtaaagaaacaacaacaacaactgaagaacctggacaaaattaatcgatttttcgataacgtaattcagtcgaaccaagtaccatgcttttacaactgaagatagagaacttcgttgttaactctgtcactcatgcatggtagactctgtagcca

SEQ ID NO: 12934 - DNA, 1291 bp, Oryza sativa
ttctttgttccaagttcctacgagcagttgtgcttcctagttgcatttatttttaccttgaaacattgttagtactcccttcatcccacccactaagacactaagggtctgtttgacacagctccagctccacccctcctgagctggagcttagccaaacagtttcagctccatcaaaattgggagtggagttgggtggaactctgtcacaaaatatacgagttgtggagctgggtttagacagctccacaactccactccagactcaactcctggagttatatttaggagttggagctgtaccaaacatgccctaagatgtactccctccgtttcaaaatatttgacaccgtttcaaaatatttgacaccattaactttttagtacgtgtttgaccattcgttttattcaaaaaatttaagtaattatttattcttttcatatcatttgatttattgttaaatatactttcatgtacacatatagttttacatatttcacaaatttttttaataagacgaacggtcaaacatgtgctaaaaagtcaacggtgttaaacattttgaaacggagagagtatgtgtattttaatagtcaactctttaaatatttaactaataaatattttattataaattatattttatttgatgaaaattatatcattggattgttatttaatttacctttaaatgattatgattctattgctaaaaaaatgtagtatataagaaatttaaatataaagattagttttaaagtctgtgttaagtttaatcgtgttttattgagttggagggatggagtacttgttaaaatactggtaagtcaatgctgtttttagctacatccaccagcctcgttgaatgttgatccaaacagttgttctgttccattttatatattactctctccgtccctcagtagatcggatcagagttgagatttcacaaaagaataccttacgattggggaaagtaggaagcggtttgggcatgcgctgcacatgtgagcagttgtcagttgagcaccatgtttatgatgataagctcggacgtactttcttagtcccaaaataaaaatcaataaagatgtaacatatttcagtactgagaatcttcacgtggagatgttaagcaccataaatctagacagatttgtgatagttgtacgagataatctcttatatgccactgaaaattggtctgattccttatatgccactgaaaattggctcttcccttatataccattggtctaaatttgtgcaccatctcatgccactaccatc

SEQ ID NO: 12935 - DNA, 8878 bp, Oryza sativa
tttcagtggcatataagagattctgcctagttgtatatagcagcgcggcagtattatctgttcagtaggcccgaactacaaaaaccacattgaatctagtcccatgaaagttttcatatttttttcaaaacttctcaagttgttgaattttccaggccccaaaaattttcaatacaacttttttctaaaaaagataatttctactacctccatattttaatgtatgacgccgttgactttttatctaatgtttgactattcgtcttatttaaaaaatttatgtaattattatttattttattatgatttgattcgtcatcaaatgttctttaagcatgacataaatattcatatttacacaaaatttttaaataaaacgaatggtcaaacattgatcgaaaagttaacggcttgatacattaaaaaatattgagggagtactatatctaaacggcgacgtggcagcgggtcgcgtgagcgtgaccaaagtgttttgttttaaaaataatttaatttttggaatgtttttcttaagaaaagttatcgatcgaagagttcgattttaaatcttaatggcataaaatttccaagatgttatcaccaatcatcccatggcataacggatctgaattaaggaatctactactaaaaaaaaaacttggccattagttaaccagtcgggtataaataggagcaagaaagcaaagagaagaggaaacagagcagagaagcagagcaaccatggccgcgcgcgtgctccccctcctcctcgtcgtcgtcgtcgccgcggccatggcgagagcccccacggcccacgcgtggggcaaggagggccactacatggtgtgcaagatcgccgaggtgagagatcgatcgatcgagatggattccacctcgtgctttgcgcttgcttgattggtggggaactttgggtttgcttctgcagggtttcctgacgaaggaggcggcgacggcggtgaaggagctcctccccgggtgggccggcggcgagctcgcggaaacgtgctcgtgggcggacaccgagcggttccggtaccggtggtcgagccccctccacttcgccgacacccccggcgactgccagttcaactacgcccgtataatctcctcctcctcccctgattagcattgcagtttcagtttcagtttcagatttccaagtagatcgattagctgtcgcagctgattagcagttggataggttgatagaaacctgacatgtgtctgatgacaagttgctgtcataatgagtatagtaagcaacctcgttggagcatcttgatgatgcttagtagcttcttggtccggttaacagccggccagttggagcccatcggttggcttattcgtgcagcatatttaataatttgtgaataaacttttatttatatgtttttagcgaacggaaaataatttgtgaataaaacttttatttacgtgttcctagcgatctaaaagagataaacttcgatgaaaaaaaccttaaaatcaactccgaatttaaggttgaaaatttaaattttggctcataagaataagtacaagcaaaaaaaatgagacggcagtttggactgccaaactcgacaggatgcgtctaagtataggttgcgtcttgcttgtttgattgggcaaagcaaaggcaagctcgttaggctcgtgtagccgtcgtccatatagatggcatgacattgtgctggacagaaaaaagggaactagtctgaactctgaagcctctgtttgttcctgggatcagtggtaaccgtttgcctgaattatctgttcatgcaatgattgataaaacgcttagaaccatcatgtatgggtatggctatggtagttgaactgttaaagtccataaaaggggtcaaacttagattaagaacaaaaacgaatcgaatgcaaactgtatcaaaaattcagggtgctgtcttactctcttatgcctagtgcgctgaattttgagaaaatgagtaaatgatgagacgcgtgattgtgccatttctgcgcaggggattgccacaacacaaacggtgagaaggacatgtgtgtggtcggagcgatcaacaactacaccaacgcgctcgaggactcatcaagtccatgtaagcatcactagtcacacttctgctcctgtctgtattttcagctgtaatgaagtaataaactgaacacatggcatctcacatgtttgcttgtgataactttcagatgatccaaccgagagcttgatgttcttggcacacttcgtcggcgacgttcaccagcctctccactgcggccacgtcaaagatcttggtggcaacaccatcatcgtccattggtacacaaggaagagcaaccttcatcacgtacgtagagcctaacacagatcgaattaatccattaataatttatccaattttgttctttgtgaacagctaacttaatcttagcattgtaaacttgtatcgtttcaggtgtgggatgtgaacgtcattgaaacggccttgaaggaattctacaacgaggacgtgagcacgatgataaaggccatcaagatgaacatcactgtgagcaagctcgacacttcactgccttgagctgcatttcagttttctcctcatctgtagactgtagtggttttgattggattttatgccgtgcaggatgagtggtccaccgaggagaagcagtgggagacttgccgtagccggacaaagacttgtgccgataagtaagctcatggcctgcatgaatgcatgattttggctgaatcgaactgaaatataaatattcagagattgacagctgaaagcaaatgcaggtacgccgaggagagtgcaaagctcgcgtgcaaagcgtacgagggtgttgagcaagaatccaccttagaaggcaagttcttcaaaacaccaaacttgctttcacacattcttaatgactgatttgtgatgccattaacattaagagcaatttgatgtgatgcttgttcttgaaaactgcagatgactatttcttcgctgccctgcctgttgttcagaagaggattgctcaaggtggcgtgaggcttgctgcaatactcaaccggatcttcagcgggaacaaggttcagagtagttgatccaatagagattaaacagatgaaagattaagaaaatagcccgcattctgaattacaataagattatcttgtttgaccatgttaacttcacggttacgattagatgtatcctcatttagccatttgtcaaagtagcttagatagctacagaacattgtaattcctgtaagcaagtggtgatttatcaatattgcactgtctttttgtatcattgatcatctttcaggctgaagttaagctacagccgaaacagtcaatctatatcgggtagatcagatgcatcgaatgcttgatgaaatgcaacttgaggattactattcattaatcatctcacgaggagaaaattgtgattttgctatcgcaaaaggatcgtttcgctagaatactatcccttcaaagtgattcattaaaatgctatcctaaactgagggtattcaccaaaatgctatttttggtcttttttttaatagaaatgattttgctctactttagtttttcgtctgaccaaaatacccttctctcagccgagaccaaatcgaagccattctctgccttctcttctcgggctctcggcagcggcgagcgccgtcgccctctgctcggctccggctccagcgccggcccccaccgctccctcacctgctcctccccttccccctcccctttctgctcgtgtcgctgccgcctgtctgctcacgccgtcgccctccgcatcggctccggcgccggcccccgacgatcccccacgtgctcccccctcctcccccttttttgctcgcgctgccgccgccccaatcattagcgccccctccacagccgccggcgccgccctctcgccctccccgccctccgcccgctccgccgcggcgcgccgccgccaccgaggagcaatcggcggtggattcgtcgtcgtcggtgacgaggttagtcccgcgccaccagcccaccacgcccgccccaccctcgccatgcctgccagccggccaccctcgcgctcccgacggcgtcctcgagagagaggaagaggacgcccaccaccgcctgcatcgccggcgacacgggctggggcttcatcaaccctgtcgccgctctcttcttcggggacgcggccgccggggagttggacgccgcggcggagcgaaggaggcggccgggcggggcgggcagagggcggcgagctgggagggggagagcagtggccggtggccggtggccggggaggcggagcgccggtggtcggaggagagcagtggccggcgctcccgagagagagaggaagagaaggaggagagagtggagagagtatgacaggtgggccctcaggggtattttggtccaggaaaatgttaaaattgaggaaaaacatttctatttacccaaaagagcgaaaatagcattttggtgaacacctctagtttaggatagcattttagtgaatcagtttggagggatagcattccagcgaaaccactcttttacgatagcaaaatcacaattttctctctcacgagtggacttattagttaaatcacatgagttgcctcagaaaattcagtatcaccgcacgcgttcacaacgaagagtactgaaaaaaaaaaagtaaactcgaccgattggcaattgttttaagagaaatccttgacaaactcaactctcgtgtttctatcaaagctttaatctattttagcaacatggggcaagggcaactctcgtgcttctatcaaaactttaatctattttagcaacatggggcaaaggtcgataagccatttctactctcgtgtttctatcaaagctttaatatattttagcaacatggagcaaaagtcgataagccatttctactctcgtgtttctatcaaagctttaatctattttagcaacatggggcaaaagtcaataagccatttctatcagttgtcagttgaattcgtccccatagcgacgatcaagtcttcttttttttaaaaaaaaaaaaaaaaactgaatcgacggtcaagtcttgtaagctcattcgtgcaaatatcatatgtcattgtaacaatcatcagttaagctgaaccggtcccaagaacctgacgcaggcttttcaaattattaaacggtgatttgaacaactttgccaatttcactctttcgttttctatgcacacgctttttaaactattacagtgtttttttttttttgcaaaaagtttctatagaaaagttgtttttaaaaaatcatactaatctattttttaagttttttttaagctaattctcaactaatcatacgcttataaggtatcccgttttccgtgcgaagggaattaattcccaatacaaggaaacgaacacaaccgaggctaagataagtaggaagtcttttacccttttgttatctaatatgttacagaaaaatttaagagttcagacgtccacagcaacaaatgcagagtggaaaactgaagaaagaaaaaaccattgctccgaagacagttcatacaagtaaaagtgaaattaagcctcttcactggtaaatactcgaacaacaagattgagtgagccgatgagtttcagggttcgttcttcagcagccaatgtggtttgtcaaatttaagcgtttgtcttcaaattcctatgtctgaggataccgagaacaagaatttatagaagcttcagaccaccggtgacatcatcgaccatgtcagctggccctgctcaattaaaacagtacgacaaatattagatagcacaaatcactgaaaactgtggtacacagtgatttgaatgtagcttaccaagaatagccatgactgttcttgaatctacaggaagcagagatgggaacataattaatccaacagcagatattaaacagatgctaaattgaataaagtaaagcctgaagaactcacttggtgcgatctgtgttcttccagcatcaatagttatgtgtgttgggatattcaaagactttgctcttccctgcaccaaaagaaattttaattaaacataacagaaaaaatgcaagcattaacaacgttttatactattatggaattgaaaggtaacatattagctatataaaagatctcgttgaatgcagaatataaatattatgatgcataagtgtcaagtgttgggtttcaagaagcgcggtgatttttcttttttcacagccaatgtttcagagtgagttttccaatcgaaatttcaagttgttttaaccaattgttcgttgatactactaatgctctagtccacttctaatgccatgagaatttcctttttatttattaatatgcacaatttgacaggtaaaaggggaatattttctgtttctgttcatctgcaggtattatactattccaactcacaaattacctttatagatgtagtaaaaataaaaataactttcaacaataatgagtcaacaggcaacagaaaagggtatttacttgtaaaacaagcatatcttcctcgctttcaattttcacgaccaccttaacttgaccacacctctcccacctagcaaagatagtaaattagtttccttcctgttgttatcatgcaatgacaatcgaattgcttacatatgaacatgaacatgtggaagaaacttcaaacataattggaaatgttaaaaaaaataccttcttaatgattttggagctctctgttggagttttttaaacagacccaacgttgcatggctgagatgacagaataagagataatcactgacatttgcaagataaaaagaaatatgcacaggagaaaagttataaagcatgacaacactccaatgctgaaggtaaagattaaatgcaggagctggacatgaagataagcaatttgtttgtgccaattcatttattccataacgacaagtgtatagtacaactgtataagaggcaaatttagttatggtaggatatataacaagttctctaaatcacaaggtcaacgtgccagtcccaaaaatatgagttctacctcttgtagcctcagataacaatatgatcacaaaatttcccccttcaaaaaatgggaaactctattcgaaaggattcttcctattttaacattggtttcaactttcacattcagacacacaatacactaatagcctatcactatgtgctaattagtgagctcagttcatcagtaaaataaactctactcaactgtcgaaacgaagatacagataaactgagaagtattcacctgcattgcgcggcaatcttccccttccccatcttcaaatcattcctcacaaccagcacctgccaccaccacagcaacagccaacggaatcagacatctcactctctgcgcacatcaaagaaacaaatccagcagaaaagtagaaggggattttgagccaaatttccagtaccatcttgaaatcctctataatctcagcgagattctcgacctccagggggctagccgcggtccgtgccttggccctctcggcctccttcgccgagtcggacttggtcaccacgttgcgcgcccagaacagcagccggagcccggcgcgcttgggcgcccgcttcgccgcccggctgcggccggagttttcgtcatcatcatcttcttccgaatcctcctcggaatcctcgtccgaggtctccccggaagcgggggaggcagcgacgacctggcgggggaagcggctgagggcgaggaagtagccgagggcgaagcagcccgcggcgccagctatagcggtggcggctcccgggatggcggccgccgtgggaagggagaggacggaggccgaggcgcccatcggaggatcgccggcgccggtggcggcggcggcggcggcgcaaggcggggaggggttggggttggggatgcgcgatactaccgcgtgggggtttcgggaggaggcggtgatttaggtggaggggatgattctgacaggtgggcccaacggctcagcgaatgaacggtacgtgcgtccctggaccgtccgatgggggattggcgtctgggatctcgcgaatcgaggcgcgacacgtggcaggtcgcgccgtgggccccactaagccacgtgtaccgcctgtacgggctacagcccggcctataaaggccagggattcgaactagcataacccggcggaataagttcactttgggtccctctatttgtcgccgagtccgattttcgtcccttgaccgtaaaaccgggtatgacccgtcccccaacttacaaaaaccggataaacgtggtccctcggcggttttgaaggcggttttggatgacgtggcgcatacgtggtttgtttgactaggtctccgtcgcacgtggcattgacgtggcgcttacgtggcaattatatctcggaaaaataataaaaagcgtggccccacatgtcagctgcatataaaaaattatttaaaaatggtggggcccatgtgggcccacatgtcagctacacaacaaaaaccccacgtgggccccacatgtcattccctatctcctctcggctctctctcatcttccccatcgtcgccacaacacgcgccaagatgtcgtcgccatccatcgccgccgcctccatcgccgcgcgcaaagaggagggagcggcgcggcggctgtggccacaagaggaagggacggcggagcggcgcgaagccggcggagagggaggcggaggcggagactgcggcacgcgaaggaggagtcggcggcggcgggtccgaagtcgtgcagctccggccgcctctccctcctctcccgtcggccgccacgggccg

SEQ ID NO: 12936 - DNA, 2050 bp, Oryza sativa
ccgtggtgccgccgttgtcccgccagattagggcgctgccgctccggcagccgtcgtgcagccgttgcccctgccggcttcgcgcgccgccgctccgaccgctgtcgtgccgccgctggccaccgctccgtccacgtggggaaaagagaagtaggatagggaagagagggagagccgagagggagagggaatgtggggcccacgtgggccccaccatattttttttatagctaacatgtgggcccacgggggccaccattttaaaattattttttatgtgtagctgacatgtggacccacgatttttattatttttcaaagatataattgcgacgtaagcgccacgtcaatgccacgtgggacagagacctagtcaaacctgccacgtaggcgccacatcagccaaaaccgctatccaaaccgccttaggactttatgtgcccggttttcgtaagttgggggacgggttatacccggttttggggttcagggacgaaaatcggactgggcgacaaatagagggacctaagtgaacttgttcctaacccggcctataaacgtggcatgggcctacatttttgcgaattgcataggcccattcgccccgtgctcgcttcaagattcgtgcagcttacgttgcagcgccgatgcatactgctacctccgttcaaaattaattccatttcacctatcccacacgaaccaatacaaaatcaaaagtagaatactcaaaattagaatgatgtgactgaaaagttgtgtgtgacaggttgatatgatgaaaaagtactgaaatttggatctaaactttggatctaaacacagccattgttagtcaattaagaatcttgaagatcatgctgaaataaagaaaatgtttatattttaggatagaggaggtatttttttatatattaatttttttagaccgacggaattcgtgcagagacagctgcgacatcaaatccatcgatcggtacctacggtacgtaacgtgcccgtcccatcccatcccatccctcgatggatggacggatatactccctcggtcaacaaaaaaaaaaaagaccaacgtttgaccgtccgtcttatttgaaaaaattatgaaaaaaattaaaaagacaaataacgcacaaaattttaatcatgttttatcatctaacaacaatgaaaatatgaattataaaaaaaattatataagatggacagtcaaagttggacacggaaaccagggttcacctttttttagatggagggagcacggagtatgcaacgacgcaatcgcgcgcgagtccgtctgtttttctctagcggtacgtgcaatgtcgattcggacggttggtaatgtcgattacagtagccacgattaattaacccatgtcccatgtgcgcaggtgccggaagcccggaatccatcgagttctcgaaaggtccctgtactagctactccctctctccattaatacagaggattatgctccctaagtttatccagaaatttaagggattccgagataagaagtaaagcagcaatcagaaattgagtacccccatccattcccatcagaaaaggtatatagtgaaaagtacatgtagtactactctgcatgcagctcctttgaatcctatcttagttcatttctatgggccccttcgaatcgtaggacggagaaaacatacgaataggaaaaacgtaggattttaataggaatgtaaatgtataacagaggattgtaaaacgcaggaaaaacacaggaatgaccgtttgattgaaccaaggaaaaacttagaaattagatgagagagatagactcaaaggaaagttaccaagaggttgaagctcttgctaaatttcctccaaaatctctataggattgtccattctataggaatttcaaaggattggatataattcgatcttttgtttcaaagggcttcataggaaaatttcctataagattgaaatcctccaaaattcctatgtttttcctccaattcaaaggggccctaaatatgtattttatactacctctgttttttaatagatgac

SEQ ID NO: 12937 - DNA, 17664 bp, Oryza sativa
aatttttgaataagacgaatggtgaaatatgtgagaaaaagtcaacggcgtcatctattaaaaaacggagggagaacgcttcattcagtttgctaataagttcattttcacactatcacatgctcctccatcccaaaaaagtatataggttgggttttttttttatagagggagtactctgtagcttagatttagcattccgtactcttccttaatttgaactatatttggcataatactctatattcctggacggagggtgtattagtatagaatattcatatcataaggttgtcttcgttctctcactttctcaacttctactatcttgtttccgtacgtatactttccaaaccgctaaatggagtgtttctttttaaattttctataggaaattgttttttaaaaatcatattaatctatttaaaagtttttttaagttaatacttaattaattatgtgctaataggttatctcattttttcatgcgtgagacatgaattaccaacgtccaggttcacccatcctatgtcgatttgatttttggtcaaaatcaaactactccaagtttaatcacgtttgagagaaaaatagtaacatattgaacacaagacaaatatatatactataaaatataatcaattatagatttaataaaattaatttggtgtagatagtagtattagtatatttatctattgtattgaataagagtatatttgtctatcaacttgaaatagtttaatggacgatggagtagctaggtggtagagctagcggtaactggttgatttgattggtacggatgttacgtgtacatgtactccgtacgcaggtatacgtatggactacgtacctgctgtcacgccctgaagttttccccctttgcttgctttaaaaattggctaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaattttaatcccaggaaaatcctttcttctttttctttttcctttttcctcctttttcctcttcttgggccgtcggcccagtccacccgtcgcccgcgctcggcctccccttgtgggccggcccgttccctttccccctctctccgggacgctgacaggtggggcccacctgtcaggtcgtccccttcctccagccgaccgcgctcggccggcaaccgccgctcccacgccgccgcctcctccgctctttccgcgcccacgccgcgccgctcccgcgtcctccccacgtcgccgcctcttcccccgcatctcccggcccgcgcgcgcgctcgagagggcgggattcgagttcgaatcccacccctctttctctctctcctccccacgtcgccggctaaatcgggagggttcccggccacgtcctcccctccctcgcccattaaatcactctcccgagctccctctctcgtttcccccatttcccgtcccctcccgtgcctcctaccgagctcgcgccgcttgttgctagcgccgccgcttgccgtcgccttcggccgcgcgccactgccgctagggtcgccgccgcgccaacccgccaccgccgttagcttcgccgccgcgagagctacctcggccgccgctcggttgccgccaatcgtcgccgaaacgccgcttctctcgcacgccggtgagctctccatttccacccaactccggccggccgctctagtggccgtggtcatcctccccttcccctaacccggtcatcgcctttcccaggttgtgctcgaccccgtccgccgttgtcggaagcgccggccgccgctcgtctcttcccacgccggtcgccgccatcgcctcggtgaggaatcccctttcctccttcctttcctctcccccgtgagcgccgccgccctccgcgcgtgcgccgtcgtcttcggctgccgccgccgccttcgcgcctgacggagctcgtggctcctcaccgggagaccgcgcaggcccccctttgccggttcggccgggggcttagggtgagatctcaagctctctctgtatgtggaaagatcgcttgctcggaagaaacgcgagacacggcggcgatctatacaggttcgggccgctgctcagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagaccgccagccgccacctaacccgtgatctgaccggtctgtgactggtcacagaccggataaaggaacgcactgtactgcgttgcatgcagcgtgacacgcttgaccagactgcaattaatgctgttaggtgagcacagctgtgctcacttatcccatatatgtggcgcagacttccttaaagggtcggggtgcctcggccctcggggccggggcaagcgcaacccgaccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaacccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcaccgagaaaaggatttgctcccttcctttcgccattgttcctcttgccttcgccgcctgagctctaactctttctctgctacgccctactttcgccacacgcgctcgttctcaatcatctcttcctccaccgccatggcacggggctctgctctgcacgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggtgcgcctgggagtacactgggcctgaagactacatgcggacccaccagggagccagatgggattgggctcccgaggacttcaagatcgtggtccaaagggtgctgaatcttagctccgtggaggcgtctcgcattcctcaggtgatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagctttttcttactcattttgttcgtcttctggttttttcttctgcttcagtgatgtcccgtcgcattcctcccgccaccccaagtccggccagtccgaggccgaagatcctacggccgcggaggagcggaggcgagaatctgaccggcgtgaagccgcagaccgccttcgggaagctgaagaggccgcccgggaggccgcccggattcgccaagcggaggaagctgctcgggaggaggccgcccgggctgaggaagccgctaaggaggaggccgcccgggctcgccaggctaaggcaacagctgctgctggcgcgtcaactgggcccaccccttcgggcaaccctcaggcgacagcctccggggaggctcgcgacgaggccgcgggcacatcgcttgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcaacgcccaagtggaggccctgcgcgcggaacgagcggagctcgaggccgcatgggcacgtgttgaggaggggcggcgctcggtggacgccatggtggaggtgggccgtaaagctcaccgccgtcacgtctcggaggttgaagcccggaaggcggcgctgacggagatcgctcgtgaggtggaggaggagcgggcggccgccctcatctctaccaccgcgatggtcgaggcgcaagacaccctccgccttcagcatgcaagctgggaggcggagctgaagaaaaagctcgacgccgcccaaggggtccttgactccgccgctgcccgagagcggcgggtgacggagactgaagcggcgtctcggcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtccgcgctccgcctccgcgaggatgcactcgctgagcgggagcgagctctcgaggaggccgaggccacgacgcaacggctggcggacagcctgtccctccgcgaggcagcgcaggaggagcaggcgcgccgcaatctggaatgcgtccgcgccgagagagccgcactggagcagcgggctgccgacctcgaggcgcgggaaaaagagctggacgcaagggcgcgcgtcggtggggcggctgcgggcgaaagcgacttagccgctcgcctcgcggctgccgaacacaccgtcgctgacatgcagcgcgcactagattcctccatcggggaggccgaggccctccgcttggcgggcgagatggggcccgacatgctttgggactcggtctcccgcatggatcgcgccggtcggcaagcgggcctctggaagggccagacgaggatgcgccccatcaatctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccaatttctctccctggatggcgctggaggagttccctcccgggaccgaggacgacgcgcgcgcgcgcgtccgggatgccgccgaccacatcgtcaacggcttcgagggctcggcccctcggctcgcgttcgcccccaactccgacgaggagggcaacaccagcagtgcagacgatggtggtgacgaggtcgtcgactcgggcgcgtcggaatgagcccccgagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgatttcagctgaccgaaccgaacccccgagggcaaggttgagtacgagtgaccttattttaagtcaagattcttcaaaaggaaagaacagcacagacacaacctttaggaaattgaaactgcttttattgaaatgttgaaaaaagagaaataagaatgtaatgcatgtgtggtagcccccggtcaaccctgcacacccgaggggggtgcggggttggcctgagccaaaacctgacacccgacccccccctcctcaggggtagaagcgacgaaggtgttcgatgttccatgggttaggcagctccgtgccgtcgcccgtggccagccgtaccgagcccggccggggaacaccgatcactcgatacggaccctcccacattggtgagagtttgctcaatccagcacgcgtttggacgcggcgtaggacgaggtcgtcgacgcagagtggtcgggcccggacgtggcgctgatggtagcgccgcaagctctgctggtagcgcgcggctcggagagccgcgcgccgccttcgctcttctaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgcccgcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctgagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccttctgggtacatgccgaagttctatcccatcgaaatggcgctccatacgccgcacttggcgtacgtaggcgtccatctgtgggtcagagctccggtactccttacagacctggttaacgactagctgggagtcacctaataccaagaggcggcggatccccagtccagctgccactctgagtccggcaaggagtccctcgtactctgccatattgttagtcgctcgaaagtcgagacggaccaagtatctgaggacgtcccctgtcggggaggtcaacgtgacccccgcaccggcaccctggagagacagagaaccgtcgaactgcatcacccagtgggtggtgcgaggcagctgaaaggggtccgtgctggcctcgggtattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgcccgagggggtaagacgtaaccacagtgacccgatgtgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcattcttcgtccaagtggcctctcggggcgcactcgccttctgtgccgatgtcctcggggtcggaggatgacaggagcggccttcccacagtggcctcggggccgtcctgggggtcgggggctcctggcgtcgtcggacaagcgggcaaagggcctactccggtcgtcaggggcctcaggcctccgttcggctcgggggcctcttctccctgctttctcccgggtcgagtcagcacagggttagcctcggggccaaagggcgttaggtgcggccttcccgcagtggcctcggggccctcctgagggtcgggggcacccagcaccgtctgacaagcgggcagagggccgactccggtcgtcaggggccttaggccaccgttcgactcgggggcttctcctccctgctcgctcccgggccaagtcagcacagggcgggggtgcacaaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgaggagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaagcacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggacgacttcacggatgaatccggcctccagaagtctcgccacctcctcgcggatgaaggcttgacgttccggggcctgccgccgcactttctgccggaccggccttgcgcccggccgcacggcaagacggtgctcaatcacctccctggggaccccgggcatatccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcacagcagcgaggtggtccgcacgctgctccatgcaagcgagcgcgactttaaggtcgccacggacagagatggggccaccggggcccgacatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcgaaagtgaggcaacctccgaccaccgcgcccggcgcgtcgcctcatgagtaggggccgcggccagaagctctcgcctcatggccttaaaactccggcgagaaacgtgagcacacgctcccccgtcgacagtggcaatggtggccccgggttcctggaaacctaggtcatcatcaccgtcatcaatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataagtgccttgaaagatcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatactcctcggtgatggtgggccggaaccttgggggccaacggacattccgaagactcgccacaaaggctctacagccaacaccaccaaccgggggcacggagggctggtcctcacgtccatgtggaggtgacactctggacgaggaggcgccctccgttgtgtcacgccctgaagttttcccccgtttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataatttttaccaattaaaaatcaccaaagtgaaatttttaatcccaggaaaatcctttcttctttttcttttttctttttcctcctttttcctcttcttgggccgtcggcccagtccaccccgtctccccgcgctcggcctttcccttgtgggccggcccgttctccttcccctctctccgggacgctgacaggtggggcccacctgtcaggtcgtccccttcctccagccacccgcctccgacggcaaccgccgccgaatccgccacgtcgccgcctcctccgctcttcccgcgcccacgccgcgccgctcccgcgtccccctcccacgtcgccgcctctcccccgcgtctcccgccctcgcgcgcctcgcaaatgggcgggattcgaatttgaatcccacccctctctctctcccccaccttcccacgtcgccggcgcaataggatgggttcccggccacgtccgcctccccctccgcctataaatcgttccccgcgtcttcctctctcgttttttcgcactcgccgcgctctcccgtgccgtctaccgccctcgcgccgtcgcacccgagctccgccgctggccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttctcctagggtgtcgccgccgcccgtccgtgcctccgcgtcgccggtcatcgccgctcgtctctttccacgccggtcgccgccatcgcctcggtgaggaatcccttttcctccttcctttcctctcccccgtgagcgccgccgccctccgcgcgtgcgccgtcatcttcggctgccgccgccgccttcgcgccggccgccgccgtctccccgcgccgccggtcaccgccggcggtcgtgcgccgtcgtcgcctcgccatggccggccggcttgagccgtgccgagcatgccgccgcccactccctcccccttgagccactgcccgtggggcccacatgccggcgcctccctctcctttccccttagtgccgctgaccagtggggcccacctgtcggcgcagccgccccctcccttccgctgacgtcagccctgggactattgcgcaataaatatattaaggcttttcttttatagaaataaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccgcagtttctcgaagacgttgctgtgatctcatcagtgcgagagcaaggcaagtcatacattgcaattgatcatattgtacccaatttacaaatgtcccgcatttctattaaatattgcattgttttacaatgtaatgtgggatgggtcctattcctcagccacatattggttaccttatgccattgataacttggggatcaaaatgactagatgttggcctaggaaatgcttagccatgcttagctcaactagcacacaaaaagggatcacattattacatagactttgtctattggcatagctttagattggtgccaccgcaatggtgttagttaattaaaatacattgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatctcttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacacgttgcacggggagtacgccggccgttacgccggcgctcgatgttgaggcgggcatccggctccccatgctgatcctcccgagtcgaaggcgtcgacgagggagtggcagccgaatgacgtgcagccgccgccgctcgccgcgccctccgtcttgatgacacggaaccggtggtggcggcgccggaggtcttggtggtggcggaccgtccaccagcacccaggcgctgctgggccgtcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttctcctgtatcacccgcgaccggtgatgctgcggatttatcaaccctctcgagcgcctccccctgcttaggactttggtgtggaggaggtgggggagtacgagctcgacggcgtgggtttggctccccgtcgtcgccgctcacactcggagagaggtcgtgcacctttgcttgctcggccattaggctgatcaagaaaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagatcgcttgctcggaagaaacgcgagacacgtcggcgatctatacaggttcgggccgctgctcagcgtaataccctactcctgtgtttttgtggatttgtgtatggacaagttacaaaggattaactccctttcccctcagccttccaaaagggaaaaagtccccctctaaatgggcaaggtcctccttttatatctcaaggggataccacatgcacctttctctttccaaactggactgttctttttctctttaatgggcggagatcggtacggtttccatccgggagcccttctgatgggacaacccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacaccctagctccggcttgagacgagtgcctagaggctttcgtcttgacgggatggggcaaggcgtgcgtcagacccccagccgccacctaacccgtgatctgaccggtctgtg

SEQ ID NO: 12938 - DNA, 1528 bp, Oryza sativa
tcctgcagcccgctgttaggtgagcacagctgtgctcacttatcccatatatgtggcgcagacttccttaaagggtcggggtgcctcggccctcggggccggggcaagcgcaacccgacccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagcgccggccgccgccgtctccccgcgccgccggtcaccgccggcggtcgtgcgccgtcgtcgcctcgccatggccggccggcttgagccgtgccaagccaacagccacgcccctctcccgccctgtgccgctgcccggtggggcccaccagccggtggaccacccctcccttttagccgccaccagtggggcccacatgccgacgccccctccctctccccttgtgccgctgccagtggggcccgcttgccagccgccccctctccctcccttagtgccgctgaccagtggggcccgcctgtcggcgccaccccctcccctcgctgacgtcagccctgggacttactgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccgcagtttctcgaagacgttgctgaggtctcatcagttcgagagcaaggcaagtcatgcaatacgtttgatcatattgtacccaatttacaaatatcccgcatttctattaaatgttgcattcttttacaatatcatgtgggatgggtcctattactcagccatttattgtttaccatatgccattgataacctgggtatcaaaatgattagatgttggtttaggaaatgcttagccatgcttagttcaactagcacacaaatggggatcacctttttacatagactttgtctattggcatagctttagattggtgccaccgcaatggtgtgagttaattaaaatacactgaatggtgggctgtgggtgcatggttttgctggtcgcacccatggcggttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcag

SEQ ID NO: 12939 - DNA, 2080 bp, Oryza sativa
caactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatctcttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctccgaacccctttttcatctgcatatgcctttttgcacctggaattgttttgggaaaatttggagttttgcctctttggtttgcgggaaaaatcttggtcgttcattcggatcggatttttttttttttaaaaaaaatgagctcagcctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgctccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttctccttttctcatatttctacctaccccctcagatggagacaaggaatggttcacgcgactccaacaacgccagtggcagcgaagagccgatcaatggagcacgtgccaacggtgcatctgacaacagtccgtccccaccgcccgagaacccaacaattgctcaggtgttggacaatcagactcggatgatgacaatgatgatgcaacagatgcagcaacagtaccatcaggtgttgcagcaggtgcagcagcaagcacagctgcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatacaacgagcaggagaaggttgcttttgctacacaccagctacaaggtcccgcttctatttggtgggacaactacatggtgacccgtccaactggggcagaagttacttggacagagttttgtcatagtttcaataaagcacaggttcccgagggaattgtggcacaaaagaagagagagttccgttccctgcaacaaggaaccagaacagttatagagtatttgcatgagttcaaccgcctcgcgcactacgcccctgaggacgtgcgtaccgatgccgagaggcaggagaagtttctgtctggtcttgatgatgaattgaccaaccagttggtctctagagattatgaggactttgagaagcttgtggacaaggctatccgtcaagaggagcagtgtaacaaaatgaaccgtaagaggaaggcagcccagttcaggactccccaggggaagtgtcagaagcctcgtttcacgatggg

SEQ ID NO: 12940 - DNA, 2715 bp, Oryza sativa
ctgcgatcaggctatcaccagttgaggatccgcgaagaggatattccaaagacagcattcatcactcggtacgggttgttccaaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaagtggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcctaatcctgcctgatcagacgaaagattttcaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatctttactcaacctgatttgaatctcagacagcgaagatggttggagctgatcaaggattatgatatgggaatacattatcatcccggcaaggctaatgtggttgcagatgccttgagcaggaagagctactgcaatgttgcatgagtagagcaactatgttgtgaggttcaacgcgacttggaacatctgaaccttggtatagttgagcacggattcgtggctgccctagaggcacagcccacactggtggagcaggttcgcatagctcaagcaagtgatcctgaaatagcagagcttaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagaaaagttctggtgggtcagcatgagaagggaaatagctgagttcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaatttacttcaaagttctggcaggaattacaagaagaattgggaacccggttgaatttcagcaccgcttaccatccacaaacagatggccagaccgagcgagtcaatcaaatactagaggatatgttgagagcatgtgcgcttgactttggtggagcatgggacaaaagcttaccgtatgctgagttctcgtacaacaacagttaccaagctagtttgcagatggcaccgtttgaagcactgtatggacggaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagggagctcgttttccaagtaggggattatgtgtatctccgtgtcactccgctcaggggagtacatcgcttccaaaccaaaggaaagttggcaccacgctttgtgggaccatatcggattttggaacgtagaggtgaagttgcttaccagctcgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcaaataataatcggaatcggcatgtggaatttttcttggattctacat

SEQ ID NO: 12941 - DNA, 786 bp, Oryza sativa
  unsure (1)..(786): unsure at all n locations
ttcctgcagccctaatggcacccaattcactagtgaactcttcggcgactactgcaaaaacatgggcattaaagctctggcttcgcctcacctgcccacccaaaaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacagcactaagctgccaaacccgtggaacatcgaacaccttcgtcgcttctacccctgaggggggggtcgggtgtcaggtttcgggctccggctaaccccgcacccccctcgggtgtgcanggttagccgggggctaccacacatgcacagccttacttttcttatttcaagc

SEQ ID NO: 12942 - DNA, 1981 bp, Oryza sativa
  unsure (1)..(1981): unsure at all n locations
tatccctatagaaaataaatcaattgtagtggagtggctcccacgcaaagactacacaccagctacccatataactagctaatgctgtacactcctcatgcttaacacatggccaacgtacacgaactcggaacatcgaccattcatgattcatgaatgctagcaccgcgagcatccatcacgcgcgtattaggaaggatacataggatagggagatagagatcgaatcccgaccactcgatcgtaggcatcccatccatccatcccaccatcgatctgtgaaacgtcctcgtctcgagccgcatttgtgctgtggtctcaacctaaatctaccagctacgtactcctagcttagagcatctgcagcgttgggttaaatcgtcacgtgcgaaagggcctgtagcctagtggttacaagagcctcagtagcacctgaggtcctgggcagtggcggatctagaaataaatagtagtggggtctgagcaaactagataaagttacagtcctccctcccatctacttatggtaaaaaattttagtggggtcttcgtggggtctctcatagtcttcacgccagtagtaggggctcgagaccccgccgctcccatgctggatccgccactggtcctgggttcgactccccatgggtgcgaatnttccaggatttaacggcgttgtgctttcagtggtaggcgacgtacccgtcgacagcgaggcgcctgtggtgacttcgtcaatctctccagaatttgccggcccagtcttcgaagatgctcataggggtagggtttgcgtgcgtgtgttcataggggtgagtgcgcgtgcgttgtgagtgtctgcgttgtactgtgtaattctcaacaaaaaaaaaagtcgcgtgaggtaaaaacatctcgaacctaacgcatagtcgattttgccgtttagaaaaatgtttcttcgctagtttgtgcgagggaggaaagattacggctgattctagatgggcccgataaatcgatgctagcgttgtactccctccgttctaaaaaacttaacctcgtactacgacatgacacatactagtataatgaatttgaacatactctgtgtctaaatttattgtaccaggatatgtcacagcctagtactaggttgacttttttttgaacggaggaagtagcacccgaaccaaaattaactttgtttccgtggatggttctcgccgaactcaactacagatgcccttataagtactgcatactacgactagctagctacccgagtcagcaggtgtcacgcccagaaattctcaaaccagaatttctaagctgaatgtgcattaaatccctgtccaggaccagccagggtacacaaacgacaattgttgacatacagatccacgtcttacaaaaatagaaaagattacaaatgcagcggaaaaaaataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactagggatgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatc

SEQ ID NO: 12943 - DNA, 3205 bp, Oryza sativa
acatatatacgtacagatttattgcactatttttttttgcggagaacagatttattgcactataatatgtcacaactaggaatagattgattttttaaggaacggatggagtatctccaaagtcgggactccaaacaaccgaggaagatgtttggacgagtatgtcgcgtgagttcgtggcgcacaaattgttcgcggatttgccatttcgctagcaggctgctccactagctggctcgaataaacggagaagcgatacgcgtatatacatacttgtgggcgtaacgtaaccgacggaatccaataatacgcacttagtaagtctaattttgggacagcaacgtggtctacatatttggggcaagcaaaccgccaccttttcttccccagcccttgcccttttcagggtgacgtggcatccttcctctcttcaaccctttcttcacggggccccacgtcgttgcttgtggagctcgtcaacgtatatacgcacgtcccgtgccttgtcgcccatgacttgtcagtccaaaaacgagacagagtcacggttgaaatcttgcttcaactgcactaaatttcgtccaatttggaccaagcaggacacgatctttggctgtgttcagttcatgtgccaaaaattttttaagtatatggacacatattgaagtattaaacatagactaataacaacacaaattacagattctatcttaaactacgagatgaatctattaagcctaattaatccgtcattagtaaatgtttaatatagcatcatattgtcaaatcatggcgtaattaggcttaaaagattcgtctcacgatttacatgcaaactgtgcgatcagttttttttccacatttaatgctctgtgcgtgtgtctaaatatttgatgtgatggaaaagttaaaagttcaaaaaaaaaattttaactctaaacacggcctttgatcaaatcgataaatttttgtacgaggactaatcgtggtaattgattactagtagcagtagactaccgtggcaggtcgaataatggggggtacagttggcgagattatgaaattggataaagccaaatttaaatacgtaaagagatgatgatggggctcaatttgcggtcgagatttacaaatatttaaatccgtcacaatattcacatgcgccgtttgctgtacacatacgactaccactagtaccctttcttccccaaaccccctcccgatttctcgtttttgctctccaatttctcgcgagaagccgaagaggaagagagcgagagagagagagagagagagagagagaggagaggaggagttggttgagatggatctgttggagaagaagaacattaagaaggggggagaagtggaggaggaggtggcgcgcaagggagaggagaggaaggaggaagaggtggtggtggaggagaagagccatcagcagcagcagcagcaaggggaggaggagctcgtcggcctctcgctcgccggcggcaggtagttttccggctccgccttctcctctcgcaagtcgagtcctattcagctttgggttgatcgattgggtcgcgggagagagagtatttggttggttgttcgggaaatgcatctcgcgcgggattctagccgcttttcagttcatagtatcgccccttctccgagaactcgccgcgggggagccgcttcctgctgggagccgagcggcgccgcagccgcctccgaagtggtttaccggaggggatggattttctccggtactggactcctggtgtttgaatttttgggtggaaccggagactctttttttggtcgggtgaaattccttggaccgaccaaaaaaatctcgaatccactcggagtttcctccgttccagatggagctcttgcgttgaaaattttcctaaaaatagagtcaaaatgtttcgacttcgagttaagagtccaccctacaccgagttgcaactttcccttttttacgagttggtgtaatcatggaagagcccttagctttgctgcagtggatcaaattggtgggggttcttgcctaggtcatgtgaagattcttctgattagtggtagtctcatgcttctcctcggcctgcaatccaaatcccctttattcctttcccgctctcttgcgcttggcgtcagctgtttttaaccttgaacaaattagggtgagttctagttgcacgtgttcttatccagatgttgggagtgcggtgaactgctgatattctactaaaccgatatcaattatatggatgttcaatttggttcacgtcactaggtaaatgatttcccaccttagaccaaacttaacggataggaaagaacttttggcaagtggcagatccaggtagtttttttccttccctttttctgtaattggcagttacttgttctccaaatacttggaactgctgtgaaaagtttccaattgagccttggaatcaggagcaatggggaactcttctaagttacttgcatttcttctttaaagactcagaaataataagcaagaaacacacatagatctggtgaaacttgagttagcgtgcagtttttaacacctccatgtaccaaggggattcaatggtaaaggcctcatccccttgtcttatctttacttcaagactaaatctgtagctggggaccaagtaccatagtttcgcaactcttatataatccactaggctgctgtgaaaacaatagatgcagtgtttgttttgaagtaagtaaggtgaaagtaaaaatacctggtaatggctaatatgaatcgtggctattattaaatgtttcagcattttctgaataggtaaaccacatatatgtaactatgtaagatgtttttaaatctagatgttctattgagcctgtaacctggtcttttagactagattatgctgagactttgaagaaaaaaatttcagtacattccgtccatcttggacaacctttggacagattattaactctgaatcagtcccatcatgctgcacatgttggatatttcagagtggaccataaagttgcaggcctagtttgctatttttagattttagatcttgtgagttttaatcttgatcatgctattagactcagaatgtgtgtaccaaaaacattgataatggtatctatcctgacttgggtataacttgtgttactggcagctgtgggagggctatgttggcgtagcgtactg

SEQ ID NO: 12944 - DNA, 6906 bp, Oryza sativa
ctgctgagggcaaggcccagtaactgtcaacttcgaatggtggaggctgacgtttggagggggaaggaaggaaaggcgtcgcgttcattgtttagatggtgtcgcaccctagaaccttactaataatcgaacctatgcccttattatcgttgtactgttccttatgtgctagtctattctgtcatgaatttgtttactcgaacagcaaactgctatgatagtagtatatcattgtacatcatgcatatcattgcctgacaatgttatcgtgttcgtctagtaatgatatcatccaggttaattgttactagtaaatttcagtttcagcagctatgatagtagtatatcattgtacatcatgcatatcattgcctgacaatgttattgtgttcgtctagtaatgatatcatccaggttaattgttaaggtggtgtttacatccagggacttaactttagtccctgtctttagacactaatttagagttttaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgagttttattaatagtctacgtttaatatttataattaattttcaaacatccgatgtgatagggacttaaaagttttagtcccatctaaacagggcctaatttcagtttcggcactggggttttacagtgccagatgcatgaaagttgaggatggttttcttgtatctggcattccggctgttcctccattttacaaacagcatttgttccagatcttacgaagcttacaattttgcagtgatggattcctatactagcatttttttcgctgcctctgctcgactgccgctccggtaccatgctgacagtgtcaaccggcgaattagcccaacgcggcagtctgaccggccgccggagacgacttgccacctgttgctgccggccgcattgagtattatagtagtactgcacaacataaggtgtgtttagttcacaccaaaattagaaatttggttaaaattggaacgatgtgacgaaaaagttagaaatttatgtgtgtaagaaagttttgatgtagtggaaaagttggaagtttgaaaaaaaagtttggaactaaacacggccatatttcccatatacaaccatgccactgtacatgctgccaaggagtaccgatgttcaatcaaaattcaagacagattcaccaaaccttttattttttccatctagcatctcacatgcttaaccataggccatattgtaccagaaaaggagtgaactacgcccacaacacaggtacatgatcaagaaggagaatgtcacacagttgctgcagattctaaaacacaaaaacggaagggaaacatgaggcttaggtagggagttgcatatagtgattgccacggctactgtcagtttgtcatgcatgagtgctgcgcaagatcccatggatgtaaccaccgaccatgaccaaggagacgagggaaacgacaccagctgggaatatcttcccggacttcttgaagcgagatcccatgaccgacaagagggcagcagatatacctagaatgcaaagcgagacaacatcagggaaagactccatgttgaagtaattccatgccaaggataataaggaccacaaggtccacaacataggtggctcagaaaatgattttgcatacctaaaccaatagatgatgcaaagacaggtctcactgggagttgagtgtggacgaagtacaggaccagggctgatatgcctcctgcggctaaggatttctggcttccactcttcatgtaccccatcgctccaccggctacagaatttggaatcacaatagtcaatttctaacaaaaatgaagctctcttttgatggcaacaaccaatgcttcaatataatctatcctcagatgcaccttgaaggctagaacaggctgtcaggctctgatgtagaacctcacacaggatggtaacaccacacagtcattcactccagtagatcataacgctattattgaaccgatgatgcagctaaaattataacaggactatcatctgctagtttcacagacataatcacaatggagaaaaaataattcaaaattttaggatgatcactcttgtgttaattttcttctttttttttttaggatgttcatttttaggtggttgtttagctgtactccatttcattcttcctaagagaaaatttgtgcacattgtgcttgcctgtaggccaaaatttgtgcacatcctgtgaccagtgatatacagagtgctaatgcaccatttgtgtttgtgtctacaaaaagcacatgctggtagttgtatcatcattgttctgatacaagctggacttgagaaaccaaaactcaaaaagcaggctgctgaatctgaatgttgcataggtgttctggttttctacagttggaaattatcaagtacccagtcaagtccaacaattattgatctcatcaaattagtaataattcgacctgactaataaggatttaattttattcacgagaataacctgacaagtatgtgtgttctaacttattgggaactagttggtgaaccagaagttgaaatgcacacaattaccccaatggctaatcactttgataaagaaatgcagtagctctcattctccaaaatcaaactactcgaatccaaggcgtttgcacactacagtagatcagtaggagtactaaaaatgaactggtcgtggcattactgcatttttacctccgacgagagcggcgtaggcgagggtgatcttctgcgacatggagagcccctgccccatcttctcctcctccccttccccctcctcgtcgcccccaccaccccgcggcttctcgctgtccccgccgccgccgctcccagagccgtcgcctgcgcctccgcctcccgatccgccgagctcgggctccctggccgcgacggcgacgaggaggcgcgcggaggggcggagcgagagggcggccggggcgcgggggcgcagcaggaggagcgagcactgggagatcggggaggatggcggcgcgagggcgagtggcgcgagtggtaaggtcgtcgtcgcgatggccatggatgagctcgagttccaacttcgagtgctcgagatggaggtgatgtgatggggattttttacggggaggttggtggtgtgagactgtgggtgggcccccggttttctttttcttttcttttcttttcttttcttttcttttatttccttttctttcttttctttttctttttggaattcctttttttttccttttctgttgctggatttttgggttgggttgcatctagaaggacgattcgtttcttgtggagcgcgtgggacgcatgactgcatgtgcaccccctgcatcatacgcatgttgcccaataaagaatttcaccacatttctgaattatgattttaaaattaagtttaattttttttccctggttacacggagcacacatacgcacacaccgtcgtacacgtataccagtgaagaatataaaaaccttcaagagtttaggtaaacacgtaccacgcttgcaaacctgcgtactccttccgtttcatattgtaagactttctaacattattcatatttatataaatgttaattaattaaaacacacacacatatatatatatatatatgtctagattcattaacatatatataaatatggacaatgctagaaagtcttataatatgaaacggaggtagtaatatattttgacttacatatttatagaataatttagggaattcttttgatctaacaaactatagagcatcgtgagcacgccttttaagcttctaaacaatacgattgtggtgtaacttgcattatcaatattttttaaacacttttctaaaccaaccttttcaaactttataatactagttgattaattcatttatttgtatcttaaataattaccataagagctatattctaccgtgctactagttgtacagccgcagctgtcagacaaccattgctaccgaacatccctataagctaaggccgtgtttagttcggagtattaaatatagaaaaaaaaataattatatagattatgtgtaaattacgagacaaatcttttaagtctaattgcgccatgatttaataatgtggtgctgcagtaaatatttgctaatgacgaattaattagacttaaaaaatttgtctcgcagtttacatgcagaatatgtaatttgttttattattagactacgtttaatactttaaatatgtgtccgtatattcgatgtgacacgcacaaactttaaatagggcctaagtttcatttacaatactatccccttggaccaaacctttgtaatattcattataacaaacctttggtaatgttcattattggattatgatgcttcacacggctaaacaaaaaagctttcaactttatacatacctagtccaagattgtgactctgaccagtaacaccggcacacttgcaatctttacaaaccggagaaaacgacttgcaatctttacaaaccggagaaaacgaccgtgtttctcacccaacctcaatatcaaaatctctctttttttagtttacttccagtatatacaaaaagcttcaaaatttatagcaacccaaaactgacgaactcgatcgcttcactttccaccaagacttcacctgaccttgccttgccggccagcgtggactcagaaaacagtagccaagtctcggcaaagaggaggaaattgcccaaccaaaacacccacaaagaagaagaggaggagtcgccaagacgtcgtaggcaacacctcccttcccccctacccttgaaccgaggccgagtcgtggtcgccgcgagtggaaggcaacaactctccaaggcaggcacaggcagcagcagcaggaggagaggaggcaggcgcgggcggcgtgagcagcagcggcagcgccgcattacagccttgggagtaggaggaggaggaggcagcggatgatgatccctagggaaggggcggtgccggagcccgcggcggcgtcctgatccccgaccgacgatcgcggctgctgctgttgctattttttcaggttggttttggtgctattcgattcggtttggttattcacgagttcttggatttggggtagtttggatttaggattagtgggtgtagtgcttgctttggttaggtgcggcgtggatctgggaggtcgatttagtatgctctagtttggtatatgtgaattattcagcgcgatttgagaatattgaagctgatttatgaacttgagcatatcatagagaaaggaagggagcgaatttgtggagaaagttgcttctttttcacacttagaatagttttatatacttttaatcaactgattagacttcctgtggtggtggttatagaggatggagaatcctcagattgagatgggggccttcaaggcgaacggtccgcaattgcagaatggtgggctacgttccagcatggttcagtcctggaacctgcagagattcgttgagagcgcgctgcggagcatcaggattgtcatattcacttctaagctcaatctgctcttgccgtttgggcctgcgtcgatcattctacactatactaccagcagacatgtaagtcctgttcacagcaactgaactctattcgaccgcattttgtttatatttatcattgttcgtaggctagaaaccagagtaccctatcgagatgaactaataattgggctcactgctctttagtaacattactagttttgtattttttgttaatgtttcatcaattgaagactatctgatttagtcaataggtttttcttatgatgatctcttattgctactcagtacttgtaactgatttctactttaccaaaattgcagggattggtcttcctattcagcatgctaggaataacacctttagctgagcgcttgggttatgcaactgagtgagttagtgaactctagacctatttttttctgaccttatttcgtttaacctaaactactgttctacaggcagctcgcaatatacactggtccaacaggtatgcatttttatttttatgatttataacctattacaaaatggagaaccagtgaacaataacagacattttcttttaataccgattgcagttggggggcttctaaatgctacgttcggaaatgcaactgaaatgatcatagcaatatatgctttgaaaaatggaatgatccgagtagttcaacaatcattgcttggttccatattatcaaatatgttgttggttatgggctgtgctttctttgctggcggtattgttcatcggaacaaggaccaagtcttcagcaaggtaattttgatgcaacatgttgtgcgtcctttccactcaaaagttcctgatatgaaatcaatttttatttactacaggcaactgcagttgttaactcaggtttactgttgatggctgtcatgggactaatgtttcctgctgtccttcacttcacgcattcagaagtgaggcaaggagcatcagaggtttctctttcaaggttcagcagttgtattatgcttgtggcatatgcaagctatctctatttccaactaagtggacggaataatgcttatagtccaattggcagtgtaagtgtatacctcaatttaattcttcattgatggtgacaaatatgatatgcttgcactttgaattggaacaacaagcaatgaactaatctccttgataacagtcagttacattccctaaaaataaaaatgtaatatccatgttccatcgcc

SEQ ID NO: 12945 - DNA, 10113 bp, Oryza sativa
ttcctgcagccctttcctgctcctaacacttacattttgcaccttgtttcagggatctttggatagctccaaaaccgagagctatgtaaagagcctacagatggacggcaggtacctccgtgacgtatggtgacaccatcagaattatcagaaatagctcgctctagctttgtagaagtgaaggtgtcaagagtcggatttgcctgtaaggccatggtgcatgccaatccaatcgtgagtttttcagaacgaagcgtgccgttgcttagaaaattggagttaaaagtcggtgtaattctttgacatctaacatggttccgatatttattattattatatggatgattgaaagaataagtacctgttgtagatttgtagaacctgaaagttggccctgtcccttcagtttgtagtaagagggatacatcatacagtatgagacaatcagattatatcgtgtatacattgaaagaacaccaagccaattttgcatctggtttatgaattaaaacatatgctttaagtagctaccactgttgttttgccatcctgaattattggaatggattatttgctctactcttcaaaaattatattttcttaaaagctttctcctaccatattgctaagatccactttgtttagcttatttgtttaaatatttattttctataagcaagtagataattagtcgcaataatttgtgcctctttcctttgtgcttgtctacgtcagcacggccaaaacatacatgcccacttgtctccgtgatttttcgtcagagatagcatagcagcttggtcgttttcgccgatcagatttcgcgaaaaccaccaacttgatcagtgtcacccacacgcaccgtcactgagatcttgtccatttggttgaaaaaatcactgcaaaatgctgagaaaattgaacagaataactgcaaccgacaacacagtcatgatgctctgatggtgaggcatcggatctactgctccacaaatccacaaaactaagaccctgtttagatgggactaaacttttaattccctatcacatcgaatgtttggatactaagtaaaaatattaaacgtagactattaataaagctcatccataatcttagactaattcgcgagacgaatctattgagcctaattaatccatgattagcctatgtgatgctacagtaaacattctctaattataaattaattaggcttaaaaaatttgtctcgcaaattagttttcatttatgtaattagttttgtaagtagtctatatttaatactttaaattagtgtctaaatatagagactaaagttaaatccctggatccaaacacgacctaactcaagtcctgagataggatagtacagtcagtctcgatttgatagggacacctttgtctcaatcacttcaatatcaaaacaaaatgcatcgtttttttctcttgataataacaaatatgcattgctatggctagtgacttggtagtgcataggaaaatgtagcatttgctgactatgcatggtgacactccgagaagttagctgcaatatggaggtgacgatgctgtcgccggttggccggcgagtgtgacaagaagcagccacgtcgcctctgcatgtgccaccttctcatcacacttctttctgtctttcttttcttcagacatgtgaagcttagcaccgagctgcaggaaattaacgtgctgcacactaatcgccgggcatgcacgatatgcgcacacacacacacacacatattattatatggtcaacggcaatcagtttataacaaaatcactgtaccatctttgactgtcaatctcggccggtcggcctacgtacttacgtcttcagatacaacggccacttcatgttcatttggctcccagcttcatgctagtggcaattagagtattaatcaagattctgccgaagaccaaccaactaatcatgcaaaatatggcaccttcctacttgctaacatgctgcatgttttagcagttgcaaacttggaaatcagctgcaagcagcttgcattacaacctgctcttcccgctgcaggtttcgtcagagctagcagacgatcccaactttgcaaagggtagtagtagtagcagcagcagcagctgtactagatacggcatattctacgtagacatatacaaatagtgcagtgcttccactgacagatctacacgtccatatggaccatatctgaacagatatactaccattgaacacgtcagaacatacatcagatagattataatttgcctagcagatgtatacaaaatgtctcatcttttctggaggggattgagacgacgtaaggagttacgaaccaagcttagcctttgcacctagaacaccaaggagagaaaaaaagttgtgccaggcacgtgcagacgttgaactttctggcaaatcaggcttagtttaagcctcttggttagcaccggaagcaaagaaaggtagctaagctaatatcaattcaagctgagctgagctgagctataggtgtctggtgtgtttcctttagaatcactcgcgtactgcttaattaaccaattcgatcatcaacaacctcattatcgaccgcaatgagatggccgtagggcagcatgtgtgttaagtactaaccttagctttagttcttcttcgtcgtcgtccctatcctgtttggttcactttgatgacgtgctgcgtgtcccaatgggtaagaggatccgtggttatccgtaggacacattgtttaggttgttgggttgtagacaatatggagtagcatcgctatggttactggctgcgatctctccagttgtattgcatatgtatgaaaaacaattctttcctgaataagacacagggaccgaaggactgtttggttgttatcttcaatttaccatggctaaggttagatatgtcaacttcttaggcaatcgtctgattcattgccacaactgaatttagatctgttcttcagagtgacatagcgttggaggttcagagacaaaaaactattcggcgaagtgcctcgcttctcatcaaatcaaatcgttataaacaagtgtgtagattaatttgactgtacttacttccctaccaaccgcatctgactgagtacttttgtcgtcccagcaattcttttacctgtaactcagaatgaagccgctcttcagttcagagttcagactttcagcgtggcactcacagcgcagtttttcgccgatcgatcgatcgacagcgccgttgaaccgaacacgaatgtgaaacgtaacgcaaccgtggggccatagcgaattgcatgccattctgaattgaaaaaccagtaaaaatgggcatgtccacgtgatgcccaccatcttcttcttcccccgacctgcccggtgatgagtagtcctactactcgtgcgatgtatggatattttgaccagattccccttctcccccaacgacgaccggcacggacggcgcacgtgcgccggggtgcacgcgtcgcagagccgctagctccggccggtcgacccgccggtacggttgcacgcctctctcacgtgctgcctccctgccgacgtgaagggatcgatccggcgtgtccatggcatcactacagtacacgtcatccagccctgctcgaggaatcctgaacgtccgatcgatccgtgcaacgatcggagggtgccgatcgatcgaccagcctctccgtaccctttgaagccttggagtaagatgatacggcgaacggtcgtcgccgccgtgtgaagccaaccagcagcagctagtgcatgcagtgcaggcgtggcgggcggcggcgaaacgtggcgacaccctacacggcggcggtggcggcggccaaggtactggcctactccgtcagctccatgctccatcgattgtcgtcgcacgattagagtaggttcaatagccaactatgaacatgtatcgaggagataaaaagaaaagaagagaccaggtgtatgacaggtgattccagaggcggagttagagtcttcccatgagccggtgaaaaaaaatttgtaactaaaccttacctatttttatcatgtgtgcaccctctcaatataaatttagaaacatgtatcaacttaaactcgatataaagtaaattaaattaaacaagtgacacccccttcatttcgttatagcttcgcccatgggtgactctaagatgcaatgtgtatgacaagtgagaccatatagtatttttttataggtaactattatatgtattgactattaaattgattatagatgattttgagttattagttagatataatagtattaaactttctaaactttctcttagctgaggtagatagcgagcgaggaaaagacgcaatggtgtacacgtacacgtcgtttcctgtcatcggtggctgcttcctccgtgccgtgcataaaaccccctcccatttctgctccatctccgcaccatttttgtcatatatttaccggttgtttgcacgactacaaagtttgctccactacatcatgtttttgtggtcgtactgttcttgaggggacaggatacaaatatactagggtcaatgcgcatacataattaaatacataaatgtacttgtctctttagaggtttttaaaattatctacaatatctaaattagacacacctgtagcgatgtaagtcggtcggatcatatggtgcaaaatgttaatgattttggaacataatttcagcggttcgttgttgaaatttttcggtgcgctaccatatggtgctgccagtaaaaaaaagaaatttatttgtatacagttaaaaaataaaattcagcaaaaaaaaaagttgggggagggtcggagtagtctttaatttttgcattccggagtacaaaacacttctaagattggagaaatatcagtccttgattaataacattaattaggatgtaaaacaaggagggtaatatataataggatgaaaatggtcaacatgggaaaaatgttcaaaccatttccaaaaatatatattttttcttggaaagaaaatcgaaatggtatagtcagagacgaaaataatgttggtcctacgattgcaatggcaacaaaattacattgagaaatatggaaacataattatcggaattgaacacattggaaaatatcacattaacaatgagaagcaaatatttttttatattacaaatttaaatgatatttaagtagatatttaaaatagtaagtaactaatttaaatactttataacgatgttataacatcagcactctacaccacacaaatgttatggttattttctttattttgatgggttgtcagtacttatatgggatattctggcaatttaggttgaaaatggtacttccctctatccaagaaaatcttatatggaacatttcatagtaaaagaaatcttgacaaagagcatattttagattcatagtatgttgctagtaaatgattaggaaaatctaaacgatctatacaaatagaaattatatcatcttcattataaaatgttataatctaggatgacgagatctattctaaaacaactaatctcaacatagatatgtgcggtcagaaaattacgtactccctgtctcgctccgtttcaaaatataaacatttttaaaatagtgccaagtcaaaatttttaactttaactattaaaaaaataaaaatgataaaacatgtaaaaatgatattgctaagtcaaagtagcatcataatatatataacttttttatttaaaacatcttacttctatagatattgctagtcaaaatggtatctcgaaaactgtgtcgaatttcaaaaatactaataatttttaacggagggagtatagccaactactacctccaaatcatatataatcaatttaatagccaattcatatattagttacctataaatatatactacctattaatatccggtcccacaacttgtgttgcagctggctataaatttatagaccgttgttcatctctcttctttcatattctcgatatatgtttatagctggcttatagtctgctactgtacatactcttaccttaaataaagctataaatgtgtagcctactgtttatctctatctttttttcatcttctctctatatatatttatagctggtttaaagtatgctattgtacgtactcttaccaagtaaacatcaactcggcgtgattgttctagggtgacctatcttcatgagcggccgggcatgcagaaccaagcctatccatccatccagatttgaagcgagcattgcccctgcctgcaatgcaactttgcttccaaggcggtcaaggataccgccggcgccgaccgcaccctgccctccacctgtaaaacgccacctcttcaccgctgccaccacacctctcctctcctctcctctcctactagcggccaagctttcaaagccatggaatagtagtactagtaaaaagcatctctctctctctctctacatacatggcgcctcctcgaaaccctcatataaatataccgcgcctcgttgcctgtgcggcgcccctctctctctctctctacagactacagtgcgtcgtcgtgtcttctctttcctctattttatcaccatccaccgccccattcctgctctcttcatcttcaccttcacctagctgctgctgctgcttcttcttcttctatctgctactagtagctcgcagaaaaatactcgcctcgatcgacaagctctcgttgttaccttaccatggacatggacacctcgcaccactatccatggctcaacttctccctcgcccaccactgttagtactcattctacttcgttgtctgttcatcgatcacatgtgtgtgtgttcttggtcattttttggagtaagtgccgtgcttatgcgttggtatgtgtgtgtgtttgtgcaggtgaaatggaggaggaggagaggggcgcggcggccgagctggccgcgatagccggggcggctccgccgccgaaactggaggacttcctcggcggcggctgcaacgggggatcaagcggtggcgcttgcccgccggtccagacgacggcgccgacggccgccgagctgtacgagtcggagctcaagtttctcgccgccggcttccagctgagcggcgcggctggggcggcgccgccggtgcccgcgctgttgccggcggctgctctagagcagaccgacgagacgaagcagctggccttgccgccgcaggccgcggtggcgccgccgccggagcagaagaaggcggtggactcgttcgggcagagaacgtctatctaccgcggcgtcacacggtaagctatagctaagctaagctgagatcgatcagtctatgcatgtgtcggccataaaatctaaaaataaattcttagctagctcgtctaatttcttgcacgcaaactaatcatctcgtgttcgtgtgcatccttcatatatagattcacatgcatcatcgatcgtattaataggatttagtagtagttttttttgttaatgggagtagaagaatcaaatgaccaatatttgttcagagattttaattagggcataaaaaatccttggttatgtataggcatcggtggaccggaaggtacgaggcgcatctgtgggataacagctgccggcgtgagggccagagccgcaagggacgccaaggtcactactcaataattttactactgcattttgctagctatttgcatctaatctcataagtgcatccagctaacttcgattttcttttttgttctgtcgacttgttggcaatgcttcttctcatttatggctgatgtttctggtgtcttcgatctacagtgtacttgggtaagaaaagacacatgcatctagtctcttggccagctactagctagtagtagcagctattgtaactttgcatcgtttggaacattttaaggtgaatgatgcagagagtttgttcgatgattttacaggtggctatgataaggaggagaaagcggcgagggcgtatgatcttgccgcgttgaagtactggggtcctagcaccacaaccaactttccggtaattaactctcatgcatatatataaagatggatttattacatatttacaatgcatgcatgatcaaaatatatagctcctgattgatgcaagtgtgtagtaaaagcatgtgcatcatgcgtatatgtgtgtgtgtttttggttgatgtatctttatggggcaagctgtttataatctttcaggttgccgagtacgaaaaggagcttgaggagatgaagcatatgacacgccaggagtttgtagcttcacttaggaggtacaagctaatgatcactctttagcaatgtttaattatatgttgtgatattccatgcatggccattcatcaaagtatatatgctcccatgcaaagccattctatgcatgcatgtttcatcatgatcacctgtttttttatatgtatgtatgtagctttgttaatttatttgttcatgtcagcttgatgaaaaacttgtactggtgcatgcaggaagagcagtggattctctcgtggtgcttctatatacaggggtgttacaaggttcatatatatattggtcttgtactaatctttcacttgtagcctagctagccatgttcggcctcttgcacgtaagtctcaggtacctgatgttttgtgtgatgcaacaatgtagacatcaccagcatgggtgatggcaagcaaggatcgcaagagtggctgcctacaaggatttctacctaggaacattcggtaattaagtttgtacattaatttccatgttgaatctgtcgtccatgttcatttttttgtttagcagaaatttgttaagcctttttttgttgccctcttcttcaacaaatgtatgacctgataagaaaaaatgatatcaataacccaacaaaacctctcaacatttgactaattatatctgggtgatgtttgcagaaaacacgcatgtaggcaatactttcatgcatgtaggcaatactactttcatactaatgttttctaatactagtggatctactgacaatgcaatgtcagtgtgctcatcatgtagaagaatgctcaagagttttctcgacgctaagctatacataatctttgtcattagaactttcttttatcaaagatgaaattgcaagtaggagggtgcatgcacgtgttgggcccctcattagctagcattagtcattttcttacactcaacattacaatattaagcccttgcacgtaggttccatcttaatttatgctttgcacacacagggcttgtagctagattcgtcgacatattttatgcaggtcaaaaacatctactttgaccaagatgtaagcatgcccacatttgattcgaaatttgtcatcttttgcgcgccatgcatgatggttttggggctttatgcagcaggcaaggaaaaaagaagacacaccatgcttagaccatggacgcatgtatatatctatggctgattgatttgcaaacctgaacactactgcctttcttcgttcactgcatgtagcagcccgtgtttggaatatcattattactgctattaccgcgctcggctttccacaaagcatgtgattggtgattaatttactactgccttgctgaaccggccattattattgtactatgttggatttaactaagcttgatcaccacactgggctacagtttcgtcagttgttgcttggtccaaagtcttactggtgcaacttgctggttatctataaacttactggaaggctcactgcactatgatgccatactttgttaagtacaattagctaattcaaatatgtttcatgtgacattactattcagccattagtaatttacaggtggtgttgattttacttcaagtacctaaataaaattgacaataacgcatcgttcttctgcatatgtgtggtgttcaacagctgattgttgcttgcttccttctttcaggcactgaggaggaagctgcagaagcttatgacatcgcggcgatcaagttccgtggcctgaatgctgtcaccaactttgagatcggccggtataacgtggagagcataatcagtagcaaccttccaatcggg

SEQ ID NO: 12946 - DNA, 1415 bp, Oryza sativa
cttccaatgaagtatgatcaggcagattacctgtcatacctcgcattgcagcatcaccagcaaggaaaccttcaggggctaggcttcggtctctacagctcaggtgtaaacctggatttcgcaaatgccaatggcaatggagccatgtcaaattgctacaccaatgtctcattacatgagcagcagcagcaacatcagcaccagcatcagcaggagcagcagcaagatcaacaggatgatcagtcacaaagctccaacaacagctgcggctccattccgtttgcaacacccatagctttcagtgggtcatatgaaagctccatgacagcagcaggcacctttggatactacccaaatgttgcagcctttcagacaccaatctttgggatggaatgatttggggaggtggcactttgcaggcaaaaaggatgaagagcctgatccctgatcagaggtgatgaggatcaagactgacatagttcattctcacacaacaacaacaacaacaaacataaagagcaggggaaaagagaggtaatgtagtagtagtggtatgatgataaagtatgatgcaaacatagtaggaagcagtatgcaggagagagatactgacaggtcagagacaggaggagaagactctgctaacaaaacgatgcagcgcaagcatattgttttattttactgcccttttacccttttgtagctttgttttcttgtgcttttgtcatcgctgagctttgtttgccgctcagcttcttttgagcttttctttctactgacatgattctgcaagtgccatgatagcttagcccatgtacaatggaagcagggacgtctctttgtagcttttgcttcttttcttttgttagatcgcctttggtagcggcccctgtttactcaagaagttgctctccctccacaagtatacaatgaaatgtactgcaggaactaaacaatataagtttttgtaacattttccataaagtttagttcctagttttcaaacaccccctaaatatttcattcagtactttaaaagaagtaaaaaaaatcagtactcatcacgagttatgcttgtactttctccgtttcacaatattaacattttttatatttatattaatattaatgaatctaaatagatatatatgtctaaatttattaacatcaacataaatttggaaaatgttagaatgatttacattgtaaaacggagagagtactgtttacgttgctgagatctgttacaggctgatggagcattatctccgtaaaaaaggacgaaacaaagttctgtaccaatattttcatcatgggccgaaaaggatgagatggtcggcctgacccacaatccttttttgatagttctcgttgcgccctggcccaagaagaatggccttcaggccggcccaact

SEQ ID NO: 12947 - DNA, 12839 bp, Oryza sativa
cacgaagtgtccacgtcaactcccctcaggctgtcgataagtagggtgactagggtgacaacgacgatcgtcaccgggcctaggtgctttgggcagcgcgaggtggcacacgataagtagtgggacactctagaatttgtcttaatcaattggataacatatattcaaataagtacttcctctgtttcaggttacaatgagttttgacttcggtcaaagttaaactgtcttaaatttgactaagtttgtaaaaaaaagtaaaatatatttaattattgatttgatgaaactaatttaatattataaatattattatatttctctataaatttagtcaaacatgaaacaatttgatattgaccaaagtcaaaacgtcttgtaaccgaaacgaagggagtagtatatgtataataaagtacattttacccataagaaagtataggtagtttttgctaatataatacataaacatgtaagaggatgtttacatatagtgacacataagcaaaactaccaatgtgtttattattcttattccacgactgatgtaaatgaaaaacactgcaaagcaaaatcaaactggtgtgtagatcagagggcatgaaattccataggaaatatcgtttccacaacacgccctctcctccatgctctgttcctttattaacagccacctccgccgccgccacagccacctccgccgccgccacacccgccgccgccgccacagccacctccaccgcctccacacccgccacctcctccatagctgggccgcttccgtccaccggagctgcccttgccatcggcgcagttaaacacgacgaacgccacgatcgctacggccgccacgaagaccagagctatgccgacaacactcctgctcacgtcgggcatggagccgccggcggcggcgaagcctgcgtccacggcgagcctgaccatatatatatatcaagatcgagctgccccgcttgttggtgagatcgggtggtaattaaagggttggagggagctaatagcttagctgtctatatatatatactactccaggtgaaacggacacggaacagcggaactgtcaagttgaaatatcttcatcgagtggtgagctaactatttctacgaaattgctacgttatactccatctcaaaagaaaaagaacttaggagagaatacatgattctctctttctagtataatgaatctgaagaatatcacacctctttctagattgtttttttttttttataaatagagtatacctgtaacctgcatgcaggatgtatataggatcattgccttgagaaatctagctcagaatggtacgttacgttattttcttgtctcctttttttctttgcgagaacaatatacgttacgtgtattacagatatatagcttgattgaccgggaggttttcatatatatctaaggatgactgattcaatcgttgtccatctagaagttagctaattggcaattgttcccacggcggctagttttacatatcagcttaaatgcttaattatctgtattgcgcgtccttgattgtacgtcatgtcgacaacgtcacgaccacgttgctgtttgaccttattgctaattagctcgatatctactgaaattaggctttgttggccgatggggacaaagtacttctacatccaaaacatgagatgcacttacactactacatgataaatttttctgcacgccgtccccttttattttcatgcaatccgtatgtggaaccgcacgagaaaataggggaaccggcgccgggttgtatcctgtacgagaaaatgcattttcccgtgtgggcatcttaatctaaccgcacgggcagtcgacttaagaagaccgtacggaaatatcgattttcgcgtgcgaacctcttaagtggaccgcacgcgaaaatactctcccttctctctaatttttttccctcccaacacttcaaaattttcatccttatccttatttcaacatatcctctcctcttctctctctcacatcccccctctttctctcatttctcccttcctctccccatctttttctctctcaccgcgagcaggggcagtgggccgatgaggaggcgccaggccgatctggcggccgccgccctccccggccttcctcctctacggagacagcagcgatgatgatgaggtggcgcgcaacggtggcggcggcggccacccctcgcacggatccagtggcggcggacctccgtcgcacagatctggcaacagcgacgggagcgggcgacggcggatccggccacggctacggcaacgatgacgaagacgggagggtggcggcggcgacgacgaggtggcgcgcgacagcagtggcggccaccccctgcgcggatccaacggcggcggacctccgccgcacagatctggcaacggcgatgggaacgggtgacggtgcggacggcggatccggccacagtgacggcgacgagagggcggcggcggcggcaacggctagggtaagggtttcgtatatttcaatattgtttttttttcgattttttatttttgcctgcaggcgacataagcacccgcacgcgaatattttcacgtgcgggtgagccacccgcgcgcaaaaatagcgattttcacaggcgatttgctccatacggaccgaagctccgtacgcgaaaatccgattcgaccgcacgggaaaatctatcgtgtagtagtgttaatttgttaactatatattaattatacattgtgttcatggaaattggctcacgatgaccacgcacagtgttaataaacctgtaatcgcgagcgacgagccgtatacgtggatcattacggcgaaacgcacggacacccatctgctgatgattcgccgcgagaagctactctctccatccaaaaaaaaaaacttaacctaagagaagatgtgtcccctcctatgtggagatgtgttccctcatagaaggatgaatatgtactacccttactccagattcatcctcctagaagggtcgtaatccagattcatcctctcctatgtccaacgccgacggccgcggagctatacgagtcggagctcaagtttctcgccgccggcttccagctgagcggcgcggctggggcggctcatgtacaatggaagcagggacgtctctttgtagcttttgcttcttttcttttgttagatcgcctttagtagtggcccctgtttactcaagaagttgctccccctccacaagtatacaatgtaatataatgcaggaactatcagaaattcttaagtgtagtagccagcttcataagctaaatattgcattccgtacttcaaaagaagtaaaagattcagtactcatcacgagttatgcttgtactgtttactgagatcagttacaggctaatagagcagatttatctccgtaaacaaggacgaattgaagttctgtaccatcattttcaacatgggccgaaaggatgagatggtcggcctggcccacaatccttttctgattgttctcgttgctgcctggcccaagaagaatggccagcacgccggcccaactactatgggaattccatcccagccgaaaaaaagatgggctgcgagtgggcgggaatcttattccccacgtagatgggagtcccgtttcggcccaataattatggcccgcactatactaaacttccattctggcctaaaagtagtagccttgggctgcgttcttcagtaagtttccaacctcactctattatttcccttgcgcacactttacaaactgctaaacagggtatagtttacgaaaactctatagaaaagttgctaaaaattcatattgatcctttttaagttttttaaactaataattaattaatcacgtactaatccattgtgttgttttcgtgtcggaggtgagagttcccaaccctcacggactcacctaagaatacagtgcacatgtgaaacggatgaatatgaagattaagttgacgtacgtaaaatgagatggggctataattagtatataattaattaagttttaattattataaacttgacaaatggatatatttgatattttaaagcaacttctatatagaaaatttttcacataacatataccgtttagtagtttaaaaaatatgctaatgaaaattgagataaaatctgaatcttaatcggaaaagaatagggccatgcaccatgtcgactcccctcatgctatcgatagagggcggcgagccagcgactagggtgacaacggtgatcgtcagcggatcgaggtgctttgggcaacgcgttaggtggcacacgataggtagtgggactctctaatatttgtcttaatcaattggataacatatattcaaataagcacatgtatagtaaaggatggacattttacccataagaaagtattgttatataatacataaacatgtaagaagatgtttacatacaatgatacataagcaaaattaccatagcgttcattatttcacgattgatgcaaatgaaaaacagtgcaaagcaacatgcgtcaaactgggatagatcaaaggacatgaattccataggaaatcgtttccacacaacgctatatatatacctacaccgctatatatctctcctccatgctctgttcccttcattaacagccacctccgctgccgccgccgccgccgcaaccaccgccacctccgccgccgccgccgccgccgcaaccaccgccaccgccacctccgcctccgccacctccggtgcgcctcctccgtccaccggagccatcggcgcagttaaacacgacgaacgccacgatcgctacggccgccacaaagaccagcgctatgccgacaacactcctgctcacgtcgggcacggagccgccggcggcggcggtgaagcctcggccaaggccggcgtccacggcgagcctacccatggtgatatatcgatcgagctgccgcttgctagtgagatcgggtggtaattaaagggttggagggagctagctagctagcttagctgtctatataggctgtgtgtttagatcacaccaaaattaaaagtttaattaaaattgtaacgatgtgatgaaaaagttgaaagtttgtgtgtgtaagaaagttttaatgtaatagaaatattggaagtttgaaaaaaaaaactttttaactaaacacggccttcacagacacggaacagtggaactggccagttgaaatatcttcatctggtggcacgaactatttctacgaaattgctgcgttgtactctgtcaaaaaaaataattagaagaggatatatgattcctcctagaacaacgaatctgtacaatattatatctctttctaggttagttttttttttttgactaattgagtatacctgtagcctgtaggatgtatataggatcattgccttaaaaaatctagctcagaatggtacgttacgttatcttcttatctcctttttttttttttgagagaacaatatacgtcattgattgtacgccaagtcgccaacgtcatgaccacgttgctgtttgaccttataactaataattagctcgatatgtactgaaatttggcttcgttggccgatcgggacaaactacttctacatccaaaacattatacgcacttaatttgttaactactatatattaattgtacattgtgtcgatagaaattggctcatgttgaccacagtgttaaccgctcatcatcgccggcgtacgtggatcattacggcgaaacgcactgacacccatccgctgaatgattcgccgaggagctaggctactgccaggacggtgacggagtcgttaggcccatccaaatgtttgtgaaaagaaaatttttagatgtcacattaaatgtttgactggatattagaatgggttttcggacacgaatgaaaaactaatttttataactcgtctgtaaaccgcgagacgaatcttttaagcctaattaatccatcattaacacatgtggattactgtagcacttatggctaattatagacaaattaggctgaaaagattcgtctcgcgatttctatgtaaattgtacaagtggtttttatttttatctatatttaatgctctatgcatgtgtttaaagattagatgtgatgtttttaggaaaaaaaattagtaactaaaccagccaagtgctcgatcgccgtttaattctgaccgcttgcttgtacgccaagacatgatcgacaacgctgctgtttgaccttgacaattgacggtctcgatcacttttgaaaattatcacttggcgaaaagaaaatttttagatatcacatcgcacgcttgaccggatatcggaaggggtttcgaacacgaatgaaaaaactaatgtaacgctccgcttttcgtgagtcgttaaaaactaattcggcaaaaatcctaattgcgaaaattttcgttctttgtgtaagagtctaagttgtgccaaggatctcaatttaatcccgttgttccctctcatcgaaatcaaaatcctccacctcgaaaattcctcttccgattcgagtctctgaaatcaaattccgaaagtcaatcccttcccttgaatcctctccaaataattgttcccattcccgaaagtatcaaactcccactttgtttccttactcgtctccttgaacccttgtgtacaagtatcaaatttagattcaaatccccttttttgaatcccgttggcgactcctccatctcatccaaatcctaattccggaagtcaatctctcccttccttgaactcgttgccaaatctttctctcgatttcgagaggatcgatcctcatccgaatcatttccttgacctcaccctatgctcccttgaacaaatacccaagtattccttttgaatcttttccatgacttctccttgagtttcccttgatacatccctaaaccctcgagttcgaatatcaaatttgaattcgaatctactcctaatcagttttctctgcaaaagtctattttacctccctcgggtgttgtgggccgtattcccccttagcccacctccctccctcagccgtttctcctccctcagcctcgcacgtgcgttgcacgtgctgagccgagccgagctccctctgtttctccttctctctcggttctctctctctctctctcgttctctctgtttctctctctctctccctcgtcgaactccctctccccggcgtcgatttcccgccgtcgctgtttgaatccggacgcgccctcgcgtccgcgcgcgcgcgctcgcgcatggccgaccgcccggtcgccgccgcgtcggccctgccgcgcctgcgccgcccggccccgctgccctgccgtgctgcaccacgcagccgcacggccccgcgcgcgtgcctgagccgctccacgcgcgtcctgccaaaacccggaggccgagctctccctctccctcctactcccttcccgaatcggcttggagcgagcctctctttttcccccttctttttccctttcctcgaccaccgccggcgtcatcacctgtcgccgccttggctgcacgcgtcgatgaccgccagctcgctctccttgaccgccaatgtcggttcttcctccctaaaccgacattgccatctattaaaccgagcctccctatcttcctctcgttcattccctcgccaccaccgtgcccttgccaccttgctaccgccatcctcgcctccctcctccatcgctcgtgctggtgaagccggcgtgcgcgcgagaagctgacgcgggactccaggcgccgtctccttccccttccccggcccgaggccgaagagctcgctcccccgtcgtcggccgctcgtcacagcgtccgtctcggctcggtagtgcatctcccgttctccctcctcgctccctctcctctccttagctctgggtagtagtgcgagtagccttccaatagcaagctggcaccgtcccgaccgccgccgctgctcgccgtaggctcgccgccatcgccgcccaaactcggtagtagccgctcgtcgccggccttcctcggtatagctccacccaatccgactctagaaatgaactcaggaggtcgcgtagatgctcaagtccctaggaatcgagctctcgtcgcatcgtcatcgtttccctcttttgccgccgccggcaagcgccgccgggattcgtcgtcgccggcctccctccggcgaatccgatccggtggctcactccctctcgtccgtcccattgttcagatgtactccctctctctcgaatcgtcgcgacgagctccggtgaactccgccgccatccgccgtccatcccgggcgcctcctcctccttccctttcgcccctgcccgcgtggccgaccacgtggcagcaacctcagccccgggcccgcttgatcgggtcaagcacctagtcagccgcccccaccgccctttcttctgtgcgcgcggtccacggagagcccttaggcttcgcatgggccctccacctcttggtccacccgcgtgccacgccgtgagccgcgaccgcaaaaccctagcaccccgcgccgcatgaacccttcccccgtgcgccgagtcgctgactcgtgggcccgtcccgggacccggcacgatggatccggtccacccggacccatccccctctctcctcccgcgcgcccacccgcttgggccgcgcgcccacccgcttgggccgcgccttgcccggccatgggccgcttcctcgcgcccgcgcccggcccattagctcggccgcgccgcgcttattccttgggccgtacccgagccgccaaaggaagtctaaatcccatccctccttccttttcttatccaaagggattaataaatccttttccctttttcataaatcaattccttattcccaaaattccataaatcatttccttggtcccgcacgtcagtgacggtcaataatattcttgagaatattatttctataaatttcataaatcaatttccccttttccacaaatatcttcctttgcccagaaattccaattaaacttccaaaattcatatctctcaatccgtagctcagattgactccgttcaacttccagtatttccataaaattgagatctatttaatggcagtactaattagtctaaataggatctttcttttggtcttttgtttaggtttttgattgtttgcgtatagttacggttaccagattttcgtcgatcgcgagttttctcgaagattcgtgaagcttcgtgaagaccttgagcaaggcaagtcaccctttgaccaattgctcctataattggaaaatcattattattttgtttgcaacttgcattattagaatcacacacttaacttgcttggcctcggtttgcgtgccaaaccgacggacctacccagtagtcgcactaattcctgtaggttgtactaccctgatttccttgtcgctccacctttgtggtacctcggtatccgtgctctctgagcgcatataccaaatatcccacatacaccgttgtttgtcgaaaacttgggaaatgggtttgagaagccttgaaaacccgacatgtggcgtcggtgtgttggaaaataaaatggattgtgaaaactcgcgatgcgggggttgtgcttgtgtggcactgtcccgtattcgcatataagtaccgattcctgtgggaaattcatccgagcatataacaagtgcgaccacacgggtgcaatgggacgcccctggctgagtaattagttaatcgggggagccatgatgccaagagacatgtggattcaacggggtggtgtcggggagaaccctcgggcttcctggcacagtatggtctgggacctaatctagtgttggtctgggacccctctcgttggcatatggtgaacctgtgtcggctttccaaatgccttgtcatgaaagccttaaggtctcccgacgtggctgatctcacgggctgggtgatccgggttagtaatgtcgtgtgggtaaagtgtaccccctctgcataggttaactaactgttcgaacagccgtgcccgcggtcatgggcggatgtgaggtgtttcctgtagcgtagatttgtttgcctatgctttgtgaaaagttgttgtggtgtgggaatcgttaccagaatcagcctatgtggcagatggacgacctgagtggtcaagaaacgaatctgtgtaattcgggatgtctatgggcatcatagattaggcttcccgagtggaagcggattgttgtgctactgggcagctggactctgggagtccgagaaaatgaaaaaggctctgggaaccgattaatcaagtggaatggctctgggagccgagaagtaatgatctgacccgggaggtcggtacattaccaaatgagctattgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaaattctcgtgacttgctgagtacgaaagtactcacccttgctctatataaatatatatatatatagttcctctgccttaaagagaagatgaagtgaagtgaagaatagggtttcgtcctggttcccagccgtcgcctgtggtgttgggtgttagttcgttggttccgctgctgctgctgttgttggtgttctcctcgtccgtgtcgtcggttgcattctcgggctgtctgagctgcaacctaagttaaggtaaagaagtcatctatttattttaaggattgcaatgattcatatttgtcaccgtggtaccagcgctatgtcctgggactggtactgtgatcgcggtttcgtaggaagcggtttgcgccgtttttcctacgacatgctcctatcaggtgccattatacggcggtgccagattggggtgtgacaactaatttcataactcgcatggaaaccacgagattaatttattaagcctaattaatccgtcattagcacatgtcggttactgtagcacttatggctaatcatagactaattaggctcaaaagattcgtctcgcaatttctatgcaagctgtgcaattagttttttattttatctatatttaatgctacatgcatgtgtctaaagattcgacgtgacgtttttggaaaaaaaaattatgaactaaacaaggccttaacctatcgaagtatctttagggtgtatttaattccacgctaaaattggaagttttattgaaattggaatgatgtgacggaaaagttataagtttgtgtgtgtagaaaagttagatgtgacgttttttggttcaaactttgcaactaattaaacacggccttacccaataaataatttgcacctcatgttcttacattgtccatatatatatctttttaaattaacagcacaaaatgcatccaataattaaactgatcatatataaattcaaactgagacaagaagtaatactcaaccggacaacctcgaggagctatgattttttcacaatctattacattcgtcgtaaaataaatatagccgtggatattcatattcaacgtttaaccgttcgtcttatttaaaaaaatttaaaaaagtgtacatgttttatcatctaataacaataaaaatactaatcataaaaaaatcaaataaaacgaaaaccaaatgttaaacattaacaatgtaaaactacaattagtattaaggaatgacaaaggatttttggaggaatgagattccaaagaattttttccttcaagcctctttgattcataggaaaggcaagtataaattccatatgattgcattcctatgagtggattccaaaggtaacttaaaaaaagaggtcagacctcttggaattcttctaggcgcagattcctttgttttccctatgcctctatcaaagggatcttcttacgtttttctctgttttctcttcctgaggatttcaaaatcctaccacttcaaatcttgtgttttttctaatcctgcgtttttcctatcctgcgaatcaaagggacccttatttgactatgaaggtagtcagagtatctcgtgttacaaaagttagtcaatatagtggaacgacgactaaccttcctgatcgcttttagtagtggcccctgtttactcaagaagttgctctccacaagtatacaatgtaatgtaatgcaggaactatcagaaatttttaagtgtagtagccagcttcataagctagtattgcattcagtactttaaatgaagtaaaagattcagtactcatcacgagttatgcttgtactgtttactgagatcagttacaggctgaaagagcagatttatctccgtaaacaaggccgaaacgaagttctgtaccattatttttaacatgggctgaaaaggatgagatggtcggcctggcccatccttttctgatagttctcctcgttacgccctggcccaagaagaatggcctgcacgccggcctaactactaggctgcacgaagatcggaattccatcccagcccaaaaagatgggctgcaagcctacaagtggaagggaatccattctggcccaacttgtatgagcaccacgtagataggagtcccgtttcggcccaataattataggccggacctacactaaactcccattctgacctaaaaataatacgccttctttggaagccaccgtttcaaaagaatttatgggtgtttgttggtaatataatacatataaacacgtaagacgatgtttatatatatataggaagtctattcactttgatgtcatttttaacattatcaaattttggt

SEQ ID NO: 12948 - DNA, 1895 bp, Oryza sativa
gcactacctccacagacggcgccgacgccaacagtaccgcctcctggattggtgagccgcttccgtccacgggagctatccatgccatcggcgcagttaaacacgacgaacgccacgatcgctacggtcgccacgaagaccagcgcaatgccgacaacactcctgctcatgtcgggcggggagccgccgccgcctccgccggagaagcctcggccaaggccggcgtccacggcgagcctaaccattgtgatatatcgatcgatcgagctgccgcttgttggctgtgatatatcgatcgagcccccggctgcttgttggcgagatcgttcgggtggtaattatagggttggagagagcgagatacctggctacactagcttattttctgtgacacggtgcatcgcatctggccggttgcaatgtcttccatagagtggtgagagctactccctccgtctcacaatattcccactatatgcataatataccttttatacactagatgtgatgcattcgaccctgtccagattcgttgtcataagatgcgtcacatataggacagtgcgatttacattgtagaacggagagagtacgaaatcgctgtgttgcacctgtagcatgtaggtgcgccgcaggcagggttaaacctttcggtttagccgatttgatcggactcaccggaatgccaaaattttagaaatttccaaaattttgaataaaatttagttgaacttgaataaatatcaccaaaattcacggaaaaaattaaaaaaaaataaaaatttcaaccaaaataatatagtatcggaggggtctgaaatgaccgcggaaatttcgttccggaatttccaaccctatgtgctctctctctctctccataaaaaaccaaattctattaatgtatctagataatgtgtctagatttatctttaggatttagtttttttatggttcagaatggatacactacgttatcttcttcttcttctttttcgacaacaatatatgcgttacgtgtattagagataggttgatcgatcggttttcatatatatctaaaccaatcgaaggatgactgattcgatcgttgtccatgtagaattaactaaggcaattgttcccacggcggctagttttatatcagcttaaatgcttaatcatgtgtagtgcgcgtccttgactgtacgccaagtcgccaacgtcatgaccactgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccgcatccatccacttttagttctcgtgcgctacccccttttattattgccgaaatcatgtttcgacagttggcgcgccaggtaggggttgcgtcgagtttcttatcaacaagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcaatatttatcggaatgaatttttaatccaaaattaatctcttgctattttttgttgttgttcgcatataattacgcgg

SEQ ID NO: 12949 - DNA, 2152 bp, Oryza sativa
cgctttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgttgccgccgattggtgcctccgcctacacggccggcctattatgccgccgctgttgggcgtctacgacttcaccgccggcttgcctccgtcgccgccgagtggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacaactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggctgcctttgggccgattcctagcacccgggggctcgttggatggaccgagtaacgcaaggtgctaagtattattcggaataaatcaaaagcatagagataagataaattcattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttacctcttacgctccaggaatggatcagtcagaacatcaccaccggctcgcctcgaccgccgctgactggtgtttccgcctgcacggctggcctattatgccgccgttgttgggcgtctacgtcttcaccgaccggcttgccttcgccgccgccgactggtgtttccgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctcgcctttatgccgccgttgttgggcgtctacgtcttcaccgaccggcttgccttcgccgccgccgactggtggttccgcctgcacggctggcctttatgccgccgttgttgggcgtctacgtcttcaccgaccggccgcctcgtccgccgccgactggtgcttccgcctgcacggctggcctattatgccgccgttgttaggcgtctacgtcttcaccgaccggcttgccttcgtcgccgccgactggtatcctcgcctgcacggctggcctattatgccgccgttgttgggcgcctacgtcttcaccgaccggcttgccttcgtcgccgccgactggtgtcctcgcctgcacggctggcctttatgccgc

SEQ ID NO: 12950 - DNA, 823 bp, Oryza sativa
ttcaacaacttcaaatatttcggtttagacgagttgggcaacaacatcaactctcctccaagtgaagcatctacaacagctataacattaatttgatggattattgtcactgacatcatcaccagcacctctgcttcatcgaccctgacatctctgctgttgctaatggatgattatgttttcgctgacttattatttcaccttcacggttgacctactatgcaaatgctgatgagcgtctttgtcattatcattggttgctacactgctattggctggatcaccgacatcgtcatcttcatcatgtcggttgcgtttgttgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatgttctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattaccc

SEQ ID NO: 12951 - DNA, 725 bp, Oryza sativa
ctgaaggaaaggccgcccctttcatcctccgaccccgaggtcatcggcacagaagacaagtgcgccccgaaaggccacttgaacgaagaacgccccggggatacggcccctagcagagaggatcggccccaccgaaaggtgcagtggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgacaggagacgtccttagatatctggtccgccttgactttcgagcgaccaataatatggcagagtatgagggactccttgccggactcagggtggcagccggactggggatccgccgtctcctggtgttaggcgattcccagctggtcgttaa

SEQ ID NO: 12952 - DNA, 1890 bp, Oryza sativa
cagaaatcctcaaaggccttaaaacctagaccttcaatatgtctcaagaagcacggcgattcatggatgcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacagcactaagctgccaaacccgtggaacatcgaacaccttcgtcgcttctacccctgaggggggggtcgggtgtcaggtttcgggctcgggctaaccccgcacccccctcgggtgtgcagggttagccgggggctaccacacatgcacagccttacttttcttatttcaagcatttcaataaaagcactttcaatttcctaaaggttgtgtctgtgccgtttttccttctcaagaatcttaacttgaaataaggtcactcgtgctcaaccttgccctcaggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcataacaaaacaaagttaacatagaaatttttcatcatttttgattgcagattaagttgatctatacaaaaagaagaaagaaaaagaaaaaattggagattggcgggggcctgggggctcattccaatgcgcccgggtcgctggcctcgtcgccaccgtcgtcctcgccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgtgttcggcagctgcgaggcgggcgactaagtcgctttcgcccgtagccgccccgccgctgcgcttcctcgcatccagctccttttctcgtgtctcgaggttagcagcctgctgctccagcgcggctctctcggcgcggatgcattccagattgcggcgcgcctgctcctcctgcgctgcctcgcggagggacaggctg

SEQ ID NO: 12953 - DNA, 2942 bp, Oryza sativa
ctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgctgtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcaagccgccccggaggttgtcgcctgagcgtcacccgagggagtgggcccgagcgacgcgccggcggtcttgtcgtaaaccgcctcgaaagacgccatcgcctctgcctggcgagcccgggcggtttcctcccgggtgacttcttcagcctgacgagcccgggcggcctcctcccgagcggcttcttcagcttggcgagcccgggcggtttcccgggcggcctcttcagcttcccgaaggcgatctgcggcctctcgccggtcagattctcgcctccgttcctctgcggccgccggatcttcggcttcggattggccggacttgggatggcgggaggaacgcgacgggacatcactgaagcagaaagaaaaaccagaaggcaaacaggatgggtaagaagaaacttgcttttggaatagaagaaaagacggtcgcaatgagcatgggacgaacctgcgagggggtcggttaaatgaccaccttggaggggaaattaggtttccccgggatggttctgtctcccccatcttgcgcagccgcttcttcttgcgctccccctcgggctgcgaggttggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacggccccctcctggggttgattcttcctggcggctcccgccggcgccgtcgtggcccttaggagccacctcctctgaggccccgacccccatcatgatggtcagaatggaggcgcggtctggatcgcagcagagggggaggagtccttgaggaataagagacgcctccacggagctgagattcagcaccctttggaccacgatcttgaagtcatcgggagcccaatcccgtctgactccccggtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatctactggcgcccgccagctggagaccggagccgggggctggcttgggagtcggaggcgcgcttcgttggcaaggggggtgtagaaccagtcgctcttccaatcgtcccacttcttgcggagggcgcaggggatgtagcggttcaacaccggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattccggcatgaagcggcccggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttgcggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggttttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcggg

SEQ ID NO: 12954 - DNA, 3815 bp, Oryza sativa
ggtgatcatgcagatcgctgaactgacacgtagaggacaaaaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaagaaaagggtacatgtggtatccccttaagatataaaaggaggaccatgcccacaaagagagggggctggattttcccgggagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagagagagcttgagatctcaccctaagcccccggccgaactggcaaaggggggcctgcgcggtctcccggtgaggagccccgagctccgtcatactcaatgatgtaaaatagcattgaggtagaggtggataatgcagaatgcatatatcgtgcacattctctctatatcctttaaaataaaggattttataaatagattgtattttcttaataaagtctgcttggtattgattgaggcaattaacattacaaagagactcacaattttaactcagggcagaaagagtgattagctttgtttaattttagacgataagatgatattggtttatttttaatatgaaatcatatgaaaatttaagcaccctctgactatacatactccctccgtcccaaaaaaaaaggcaaaccctgagtttctgtgtccaactttgactgtccgtcttatatgaaatttttttataattcatattttcattgttgttaaatgataaaatatgattaatattttatgcatgacttgtctttttaatttttttcataattttttcaaataagacgaatggtcaaaccttggacacggaaatcagggtttgtctttttttgggacggagggagtacattatcggaaataataaaaacaaaaacaactgcatagaaaaatatttaggagagtttccaaaatccaaacactcaatgatagattgatgacacgcaaacatatagaaggggaaaaaagaaaaatgtatatattagaaggtaggcacaagtatgatccacaaaaacaagataaaaataacctccaaattagaatcaggaataaatttatgtaaccaatcacatgtgatttcatatggtgtttttaattagaaaaagaacaccttaaataaataaagtagatactaaaggagaaaatgactaattggatattttccttaggaaacctcgagagaccagacgatgtcggttcacctcccttggaaattttcatcctcacccctcacagctataaaagcctagccctccgcccctcgggcccctcacgaacacccgcatccgcaattactcacaaagcgagggggcaaaccgagagaactcgcgagagaagggtaaaaaggtctcttcccaagaagaagtcatgcggcgtaagcccgccgcccggagggtggttggggaagcgacgccgaccccgactccgggagctccggcaatggcggtggcggaggttcgccgccgtcgtcgccgtcgccgccttcgccgccttcgccgcagccgctgctgccgacgttgccctcaccgcaggccttcgtggacgcgtacaccggctatgaggttagggttattgaatcgcgtctcgtgctcttccccccccctcccccccccctctcccatttcctgtgttgtcttcgggaacacaccccgcatcgaggttttttttttctggtgatctttgcgttaacgagttggtgggaactggtggggtttttctcgttgcgatgcgaggcttgttgagttttcccaacgcgcggctcggctgctcttgcggtgaaattttggttgggagtagtcctgcggggagcagcggggatgggttttttggggtttattgggtagtttctttgaattgatcggttgttgtttaccgtgtgtttcttgtcttctggttcttggattctaatctgtttgtcggattagtttcgtggggttttgtaccatttgttcttggatttttttccccctctctcagctctgcctctgctgcttcggcttcaccataccgctccttgtgcattggattgtttcttgaaggttttaatcgagtttcaaggtagttcttggtctctatctagtttgattgtcttgacataggcaagaattagggcatttctttctttaacctttgagtttgacgaattgcatctccccactcttgcttgcatgattctggacttgatacttcagacaggtggaattaatgtcagaaaataatacgatctgcttctgctgcttgcgtgttggtttctggtcgatttctctatgttttcagcgacccaaatagataactcagtgtcctaatttagacttctgatagctttgctgcctgtgagttttgatcttgttacttgtatatactattgtgaccgtaatattggattctattgtgatcgtaatgttgcctagtactgtgaaaatgtttgaaagtactacctcaggatttagatcacgtggttttattactgaggatcacatggttttattgaattacaggatcagggagcatgggaccccgattccttgtctctagagttgggacttgcaacgttacgagagttggaatgtatcagatatcaggtgtgaacatcatcaacacagcacaagactgtaaattcactagcagactaactagatttacccaaacatcaattttgaagctaatttttgcattttgtccgttcgtctgcggagcataagctgaccatcccattgccgtgaattttctttaggaagcacaagaagactggagaaagagtgatgataacaagtctgattcctgcaagcaaaaagataaggtgtgaaagttctctttctatttcatcgaacttgctttgcatggctacatggacctgagcttgactaattgcatcttttttcccctcttgcttctggacttggtacttcagataagtaagaaaaagataatgtagaaaagtgatcatctgttaccgctactcgcgtgttggtttctggtcgatttctctatgttttcagcaacccaaacagacaacttagcgtcctaatctagacttctaatagctttgctgcctgcaccttgtactggagagacttctgatagctttgctgcctgtgagttttgatcttgttaccggtttactattgtgatcttaatattggatttttgtgatcgaaacgggcaactttttagcacatgcctagtactgtgaaaatgtttgaaagtactacttcaggatttagatcacgtggttttattactgaggatcacatggttttattgaattacaggagcaggaagcatgggatcccgattccttgtctctagagttgggacttgcaccgttacaagagttggaatggatcagatatcaggtgtgaacatcatgaacacgtcacaagactgtaaattcactagcaggctaactagatttacctaaacatcaattttttgaagctaattttgcgtttgttcgttcatctgcaaaccataatctgaccatcccattgctgtgaactttcttaaggaagcacaagaagactggagaaggagtgatgataacaagtctgattcctgcaagctaagagataaggtgtgaaagttctctttcca

SEQ ID NO: 12955 - DNA, 2099 bp, Oryza sativa
tttcctctgacttctctcaattagatcaaacagtaccatgactcgtgtgcttctcacaaccattgttcctaaaatatccatcttttaatccaccttgagcttagatgcttctcataatcagtgccccatgaaaaccatgtaacctaccgagactggctaactgatatgtttagttttgattgaatacccttttaattgtgtgatattttggtactgcagaaacctatcgtggatttggctgatgaattcgaaaacaataccataaaaaaaaagatcacggtatgttcatatattgtgcacattattttttgtcagtatacatttaactattctgctaacttgaaattctatacacagcttcttagcgaaaaatacgatttcttcagaccagttgacagagatggcagttgcttttatcgagctttcattttcagttacatggtaaatatttcggcccgcttgttcaaactatgctttgttcttgtttgttagacactaaagctcattggtgtacaaacaggagcgtattgtagcaatgcaggatgacttggagcgcattattgaagtttcccgtatcggagaacgtattggaaaatacaagcaagcttatgcaagatttggttcttttggaatacctcaagaagaattcttgaaagctctttctgtacgtacttttagttctcagttttcaacattcaccagtacaatttgcccagtgtgggacattcttttcacattttatattattgatcacaccttcactcttttaatcttgcaagtgcacacttcattgagtttgaatagtaactgccgatgtcctttggccccatttctattgaactgattattttgattagctttatagttcattttggaagtcatttggggcaaaatgttttctgtagtcaatggtacggcacatcacaaatgagctaagcttgtaaatcgttatgtgatttccatgtctgctcaggttaaattaacctgcgctttgctaacagctctggtttgctatgcttgctgatagttatgatttgtagcatttggttttctttataatttatagcccagaatcactgaatttgctgaatttctttgttgcaggcatttgaacaattgatcaacttaattgaaaaggggtatggctaattagcatcctgttggttttcaagttatgtttaggaatgatatgaagatattgtttcttgttatatcttagctgacaaacactgtttgtatttcatagtgttgctgttgaacaactatatcagatagatgagactgacatcacaaaaaacagtgaggatacttgatgattgctagactgtttttccttgttactcatctgtttcactgcatgatttttttttccctgtttaggtttacgcttccttaggtttctgactgagattgagatctgcacacatgaggaccactacaagggttttcttctaacagcagattattcatctgtttttgaggtagaagaattgtgacttcctagcctactaccacccacccatacttcattaccaatattttgctgcatgtgtagtgctttagatggttgttgctaattacgtaatattttggaatctaataagaaaaaaactccttaatttgtaatctaataagaaaaaaaaaactccttgaattatgcttctaatgtaccagatgttaaaatttctaaacaatgctaggattttctttttctttacaggctcatttgatcccacaaagtccaaacagtaggcagaatggattatctttttgtttgatttattggcccctattacagttcaaagtccaaacaatttgctatatgctccttttgactctttgttttagttgttgaagttaccccactttgaaaagatgttgaagttacataaaccacaaagtcaaacataggacataagcgggaagatattatattggatgaatctatttatattaataggtttttcttcgcctagcttctattccttctgtatacaagatttaccagcaaaaggaaaaaaaatatttaggcaattagcatttacttgtgctttgtttcgtcaaacagttttgccaggttgaagtgcgacctgagaatg

SEQ ID NO: 12956 - DNA, 146 bp, Oryza sativa
ttcagccattcacactcttccagcacgtacataccgtagccactgtcttgagcaagtcaatctgctccttcgatgcatctcctatctgttagacaattaagcatagagagttcagctaatgcttacatatttagtctagtatgcat

SEQ ID NO: 12957 - DNA, 1001 bp, Oryza sativa
ataaagctccattgatatgaaccatgcaatgtaatgattagtttttggctgttgcagcttggccaggtttgaggagctttgtgagcaggattgaaatttgagtagcatgttgttacatgctactcgtggaatgaccttctggtaatcagtttatcctttgctctggtctttatgttgtatggtccgattcatgcaacaaacaaatgttgaattaatcttctgttctccacaaggctcatccgccgtttggcatccttgtcagggtggccgctgcaaaatggaggtgcaatcagcttgattatcttctcttgatttactagtatacctttagccctacttttctgggcctaatttcatgttgcttatgagttacatgaaccattagcagtgaaatactcattctcctgtctcgccttaaaactgattgatcattttcatacgtgaacactagcctgccccttgaaacgaatgaaattatcctgtacatgttactttctaactgaactctcctgctacatcaatacatataaggcatttcttgcctaagttttcaaaacaagaaaaagaaaagaaaagaaaatgaatgaacgaatgaatgttacttcactagctagtagcctagtacgaagtactatttatttaactagcgtgcatatactagttactttgatagattgctacaattcgatagagaaaatgtgaaacttcttaattgatttgagagagaaacaataattttgtagtgttctatgtagtgcagcttggtgagcctaacgtattggactggaccagcgctagagctgctacataaatgtcatttcatattggccaagttttatagtcgtatctggctaactaacccgtacgttggtttcgccgtggtgtgcggctaactgttcctactatatgcgccgtgacaagtgactcaaatatgtttcttttattccatttgcaggcccggattgacttggtcagtcaggtacttcgtgcgatagacaatg

SEQ ID NO: 12958 - DNA, 1794 bp, Oryza sativa
gctgcttgttatctgtctattatgaaagaaaaaaaaagaagaagaaagaaaggcgaactatcatcccagaaaggcaggcgatcgagctatcatcttggaaagacgaagaggaagtgtaagtaaaaatagcacttaattctacccaagtgtttatcaattgttcgcacgatagtcatgctagcatccaataagtaaagattgacataagaccaacgaattgtatggcatgaaacacgaagagagcaaaggcggggggggggggggggggggcaccttgttacgtcggtgttactgatcagacaaaaagtgttgctaaaaaaaattgaaggttcggagtgtcccgagaagggcttaaatgggagaaatttacggcatatctccatccatatcgttttcacctgccatgaattttccacattttgccaatccagtccttcacgtataggaaaattgcagctagtttcatgattcaaagcctgaaaaactgatgaatcggcatcacatctccatccagatcgttttcatctgccacggcctttttgacattttcccagtgacgcgttgcccaggcgacaacgagtggccttgcatcggataccattcatgtagactcttatgcacagcgtggtggagaagacgaacgaggaatgacctcgcatgatgtcagcaccccttgtacaaggaacgggtgctccatagggaagaaaaaagcagtggtccacagcacttggatctgcaaggtggagcaatgccgaccgcctgaagttgagggccacctcgccatggatctgactgaggtcgagctgccacagtccatggaccatagttgccgccggcggcctggagcgacgagcacgccatccggtggatcggaggcaggctgggaggagtagccaactaggggaggcggagatgggaagtgcggccgtcggccggaagcgaggaagagagtcggcaatggtggggggaattgggcattggggacggatactacggccggtgagcatctccaacagtccctccaaattagactctctaaacacccacatagccaactctctatctgatttagcaagtcaaactccttacctacttcaacagcctctccatctacgctctccattttaactctatgacagagggtcccatatgtcagccaccttacccttcttcttcacccctcctctctaccttttcttttcttctcccctctctctccactcactccacaccatcggagacaacgtgggggcaacggcgggcggcgtggattcggggagacggcgtagacgacggcggtggcagcggcttgcgacgacgacctcggcaacggtggcctcgacgatgacccaggggtgcggaggccgtgtggcccccgaatccatgccgccgccgtcgctcgtcgccgccgagctctcgctgctcctctctctctccgccgttgccggcgtgctaggtcgcccgtcgctgccgcttgggacgccaccaccccctcggaaccgagctcgcgccgctcctctctctctccgccgtcgccgccgctcgggacgccgccacccgctcggaaccgagctcccgccactcctctctctctctctctctctccactgtcaccgccgctcgggacgtcgcctcgcctcggcgccgccctcaccggcttcgccgcgacgccgctgtccttgtccaccccttcgccgagcctgtcgaccaccggagcaccctccccctcgtcgaccccgaacccctttttcttggatgcggctccaccatcggctctgaagtctgaacagagga

SEQ ID NO: 12959 - DNA, 3925 bp, Oryza sativa
gattcattgttaaatatatttttatgtaggcacataattttacatatttcacaaaagtttttgaataagacgaacggtcaaacatgtgctaaaaagtcaacggtgtcaaacattttgaaacggagggagtagtacagaaggtggtgggacccacatatagcaagtgaatggtaaggggagtaggttggccaagtttggctagtgaggaaaggaacttggtcatccggatggcttggagagtgggatagagagactcttggagtgcgatttttgttcaaaatagctaaattttggtttggagagtggaatgaagatgctattggagatgctttaatgggtttccctcttcctctgtccctgtcatctagcatcaatagataaccctttcgtctatatgaatctatctattatatatcatccatagaaaaagaagccaacatgttcgctctcaaggcctaaaaattctcacattaatcggagaaaaaataagcagagttcatataaaaatacaatttagaaatagctgaaattcgtaattaaaaaataaggattattagaagaggagactagagtccatatagaaatacaattcagatatagttgaaattcagaattaagaaataagaaatattagaagaggagactagagtccatatagaaatacaatttagacatagttgaaattcggaattaaaaaataaggaatattagaagaggtgactagagtccatatagaaatacaattagaaaataactgaaatttggaattaaaaataaggaatataagaagtagagcataaagaaatacaattaggaaataatagaaattcggaattaaaaaataaggaatattagaagtagagtatagagttcatataggaatttaaaactaactaaaatttggaataaacataataaaattaaaattaaaagtagagtttagagtccgtataaaaatataattcacaaataactaaaattcgaaattaagaaaaacatgggaagaagagtttaaagtcaatataggaatacaatttagaagtgactgaaattcgaaattaaaaattaaagaatattgaaatatgagtttagagtccacatagaaatacaattagaaataataaaaattcagaaataaaaataaataatattggaagaagaggagtctatatagaaatacaatttacagaaaattcggaattaaaaaaaagaaatattaaaagacgagtctagagtccatataggaatatatataatttacaaataattaaaatttgatattaaaaataattaataactaacacgtatataaaatataatatgaatattacacattagtagttttgtaaagttattgcaaaatttaaaattatgttgtcattttaatatatttgaataatataatgagaaaacatatatgctattatatgagagaaaatataatgatgctagccgcgcaatctgcgcgggccaccatgctagtttatattattccattccaatttcttcccgaaactttccaagaaaaatcctgaattggatccgaaatttccaagaaaaagtacgaattaccacccccgcgaactattacggtagtatgatttatccccctaaactataataccggacatttagcatcccaaactcttcaaaccggataaattaccaccctaacttgattcgaagcggttttcagcctacgtggcgatacagtcagaaaaaacaaataaaaactccttctctgccccccctctctctctcttggtgaacagaggaggtggctggtgggcaagggcgaggagccgtggccggggcgggcggcaagcggtgggtgagggcgaaggcggctgcgtgtgacgggcggcgacggaggaggctgcgggcaacgggcgacgggagaggagccgaggccgtcgtctgtcctgctgcttccgccgcatcccgatgagcacctgtcccccacgcacgccctcctcatctcgcgctgccgcctccttgtcctgcgacgacgacgcccaacaaatccggctctctcccagagttcaccgctcccgcctccgtttcccacgcccaaactagattataattacgtttttttttaaaaaaaaaagatgaatagtaaaatatgtatccaaaagttaacggtgccatctattaaaaaacttggttcagttgaagagtatttggagaaatacagacggtgtgcagagcagattctggtacagttgctacttatagacttttcactgttaaattgacatttttcagatagtgaatagaaatccggactccatttatacgaattgacatctccaactgacattgagaaggagctgaaactcctccttcggcacacaattgtttcgctcttcaccactccaagtcaagctgcagtatattgaaagcactagtttcaagtttcaaccagcttggtgagttgagtaacattttgccattttggacacaagcacaagattattttttgcattacggacttgttcacttcgccgccaatctcaaccctcacaatatttgatagtatcaattttttggtaggataacaaactaaacaaatcttgacattgccacttcaccaaaatttagcattttcgaaagtttctcctaatacaaacactatcaaattttggcaggaccacaaactgaatacatccaacgttaccaaaatctggtaacgtcaaagtgtgccaaaatttagcaaggctaattttggcgaaaaaccctgcattacatttagggatgcaagcggtgcaacccacgaacctacttatatgttaaataaagggtaatccgcaggttttcgcgtcatgactcggctttgccgcgtcgtagagaagcaagtggatcaacccataaacctatttatatatcaaattattaggtaatccacaagtcaacccgcgggttattcactcattttacctataagcaggttcgcgggttggaccgcttgcatccctgggttgcattgctctgatgattaaatgtgcgggccgagttgaactagtgtgggctttacttgggctcggccttgtttttcactgcaactgggctgcacaagcacaacccgaccaccaccacctcacccaccgccatggcctccgccctccgccctccgccgccggggactcagctggtgacttagctaaggcaagtcacagcgtgacatacgatgcatctcgcccgttcaaaacgaatccaacgaaggtagcgcttggacccgcacgcaggcaaaaaaaatccccgtttcagcctaacaggaagcccgcacgcgcttagcctcgccctcaagtccgcgtacgccggcgcttcacctcgccctcgtccggcgccgccgcgaccgggggaggcgccaggccgccctgccctgccgccgcgaccgggggcgcatggaggcggccagccgccgggcctgacagagcggtggtgcaggcgggcggcccacagcccgagcccggcgtgtggaggaggtcgtgctgctcctgcggcgccgcacgtcccgatttcggcggcctcaactccacgatggatatcagatcgctcaaagcaacagccccattctggcattctcatttcattcacaaaattgctctctttggattttgtcaaccaaaacacaatccatccctatcgtatcaagaaatgaaggagacatacgggcttgtttgcaacacatgaattcgtactaggaattttgcaggaatctcgcataaaaacagctccaaagatgtcctacccactattgatcagggcgaccatgcacaggaactactgaccatgaaatttcacgatagcactacagcaacgacggcactccattcagcatcttcagagagagagattcagagcaacattgctgcataggacaactgatcataacaagacatggaacctcccacctagcatg

SEQ ID NO: 12960 - DNA, 2471 bp, Oryza sativa
cggcgcggcaggagcagcgcggcctcctccacgcgccgggctcgggctgcgcggctgcccgcctgcaccaccgcgccgtcaggcccggcggccggccgcctccacgcgcccccggtcgcggcggcagggcagggcggcctggtgcctctccggtcgcagcgacgcgcctcccagctgactcgtggcggtggccggacgagggcgaggtgaagcgccggcgtacgcggacctgagggcgaggcgaagttgagtccgtctcaggctgcgccggtgtacgcggacgagggcgaggttaagcgcgtcctgtgcgcgtgcgggcttcctgttaggccgaaacggagattttttttgcctgcgtgcgggaccaagcgccatctccattggattcgttttggacggccgagatacatggtatgtcacgctgtgacttgccttagctaagtcactgaagcggagtcccgccgccggacgatccgcgagatggcaggccgcgccggcggcgcaaggaggtgaggtccggcaatggcgttgccttgcgcgatccactgccactactgtctccacggggcgccactatatgcgagcgcgtcccggtgatggaggaggcctcggtttcccctcggcggccgtggcgcaccagctcaaggtaaggctcggtctccctgcatatcatgtttgttgtgcgagatctattcaaccggtcaagactcaagaggagtagccgccgaaagtgattgcattgatgatgatgatgatgatgatgatttttccaaacaaaaaaaatgttgcagtgacgaggattcaatcagcattcagaagcatccatccttgttggtttggttgccttcaatcttatcttaataacaaaatttgcgtttggtcagtgaaagagagcataaatcaactggagaatcgtcctctgttttttttttcttttgttccctctgtcttcgtgctgaacttctctggaacttctgtaatcgttgcgttttcattaaaaaaaactggagaatcacatagtttttgttttttgttttttgataaagagaggtcaagcccctcccgctttcattaatgaaaacgatacgattacaaggttcacaacaaaagttcaggttgctaccccctaacaaacccctgtcaaacgcatctctgcttacaagttcagacaccagacagactggcaaaatgatcaccaaacatagcaccacgccttaccatggctaagaagaacccaaaaaaaacgcattaaaagacatcagattctcctaatgcttccaattaggagaatcacatagtataatagttccaattaggagaatcacatagtgtaatagtaattaaggtgttcttctcgaaccatatgtcaagggttacctaatgtcaaggtgctctcataatcttaataagatttggttggcctcttcttatggccaacccggctaaaaaaaaggttatctaacttccaatacaaccaactttgatttactcgatttttctccactaaagacatggcattcatgctcaggctcagcattcattcaatctagttatcgtgtgctgggtactctctggtgcacctctcagaaggtttcggtttaccgttttcacatacttcaacgcattattagttttcaggaattcacttatctattttttgttttatttgggcatcctgatcgatctattgatgtatcttgctcggcgcagatcagggagagattattgaagatggaagaggtggtcggttctgctatcgttcacgagacggttaacaagatcgtatccgggtttattgataggtgtgagcgaaaatcaagtgcacaggataacctggagaggctggagatggcacaaatcaagttggacttcgcattggagacatccaataagtggcagatcactagtggcccattgctacgttggcagaagaagctgaagcgtgctactgaagagtgcgatgacacaatacgcatgtgcaggcagcgtgtccaggaagaacaagaggccgaacaagtagcaaggaattccttctttcctaggcgaattgcgcatgccaccaagtcactgatatcatccatcttccatggcaatatagacgagccgagtagatcagttgttcgaagatttgagtggtttgcagatggagctaatgactttctgagatctgtggagtatggaggcacaccacgtcattacttgttcttcgaccctcttattgggcatcttcttgcaggtgaaactctagagtacatagtgcagggaaacaggcagcttttgttttggatacaacccaataacatagcggagaggggagtacaagctatgttgttatttgtttacagtgatggcactgcatctgagggtaactttattttgggtatgctgctacaactttcggagagtacaaacatagttggcactataattaagggcttgcagttgtttacccctcatttcaagtctacaac

SEQ ID NO: 12961 - DNA, 14039 bp, Oryza sativa
agcaagcatcatggtgcgaaggtacgtggcagtggaaacacggacaagataggattacaaaacgtttctctagaaccaattattgaagtgagtttgaagtgcgaagtttcactgcgtgggtttggagaatgcggaacgatcgtcgagggcaaaccttctatcaaagaagttccgcacctgaaagttaacattatctatatgccgcatggctcttcaggagacctattcccaacagtcgagagttctgtggtagaggtgattaatgctaatgagcaacattgcttgcacacaaacattgccttacaacaaatggaacagatcatgctgccaaaggctgtagattgttttcatcagaatgcaaaagctagagtgtaccagatgctttggaagtctaaacatggcggtgcatatcttgaggttgtgaaggcaaccatgaacatgacgagcacacggagaaccattcgaggagccaagaaagcaaagctgctgcgtggaatggatcagagaacgcagaggcgcacagttgtgacctgtgacttcatctgtgacttccttaacctctgggctgctcatgcgcctgtccagctgcagggctctatccttgattggattcagaaagaaaaggaaacagagttagcatctccactattgcgtctgaaattttagatcatttacagagactggttaaggagacagggagaattaagaagaatggaaatgtaatattatagggtgaaaagtgaattgtaggtagttaaatttagaagtccttaggagtgtgttgatctgtaatgtgtgctccatgtctccatatgctattgtttgtccagctgatcacttatgttggtgaatggtgataatatgatgttcatactctatcaatctaatgtacatcctcactcattgggcgtgacatattttatttgaattcgcatgcgtttaccatgattgaaggtgatgacaaaattttgtacttaccctatttcctgctatttcatattcccattcactttattttttgtaaaaaaattgtaatttgcatatcagtaattttcatacagtggtatcctcggggcggtttacatttcagattatatgtatttaggatgattccgaaatgaaacattaaaacacatgcatatttattctgacttcatcgtctactgaaacacagaaacaaagggaaacacaaaaaagttgcaagaaggagaacaagttgattgctgggtctgtgaatgggtgagtgaggaaggtggacatgtcaagccaaacaattttaatcatcaagcagacaagcagacaggtattcccttattgtttaaaataatttcagtatttttacttagcccagttgcaaagcttgaggttggttaagccctgtgttccttatttcttctgactgattagtctgtgattgagagtaatcagtttgtcaccagaatggcagaatatatcgttcaatcttaaacttttggttaaggcacaattacagtatattctaagcactagtttcaaccagcttgatgaggttggtacattttgtacggtagattattgcatcgcattcgccgggtcggcacgccgaccgtagtatattgagaatttgaagaatgcacagagatggcgaggcttcgcagccaccacctatttacaagacgccacaccactattgcatcgcattcctatgttacttagttgtacggacaaaagacagttcctagtaaatgccatctgccattttatgtaatatggtgttcgcgttaattcgctccatcccagatacgctccatcccagatatgtacgacattttgctcgcattcaatttcactgctgcttgtcgcgacctgttctgtgcagtttggttactgttcttttttaaaaaaaaactgcaggtaatttcattaccctgttttttgaaagaaagcctcaaacttactgaaagaatcttacacaacagaaaaataaaactaccagatcggaaacatggtaaaccactgggatcgtcagctttcagtgccctttgcccatctccaggaagggagaacagagagtaaaccagccaaaaacacccccacacacccatcttccctaatactctctccgtccctaaatatttgatgccgtgacttttttaaacatgtttgatcgtttgtcttatttaaaaacttttgtaaaatatataaaactatatgtatacataaaagtatatttaacaatgaatcaaatgataagaaaagaattaataagtacttaatttttttaataagacgaacagtcaaacatgtttaaaaagttaacggcgttaaatatttagggacggagggcagggcatctccaggccaaagctgtggctgtgtttagatccaaactttgaatccaaacttccaactttttccattacatcaacctgtcatacacacacaacttttcagtcacatcgtaccaatttcaatccaaactttcaactttggaagaaactagacacagcctgtacatcttatccatcagcttcttaaaaacgttgtccagctctagcagggcgcagtcttttcttgtttggagcaccctccagcgctgcatcagggctatcgatctgtacacaacctgcaaaacagatttaggcaatgggttactgttctttttaggggaaagataagttcagtgagaattggcaaaagatctgttcgaccacacaagagtcaagactagtacccgaaactgattgcagtgacgagtagttactttaaattgtcctaattgcagaggcgtggaggatttatctttggctagccttgcaatgagattggacggtcatagagggcagttttcttgcttgacaaatcatacggagactatgttaattagagtctaaaaagtgatgtgttctcacttctcaccttgtgctatgttaattagaccatacatccaacatgacccacttaacttctgagaaaacacaattttgctttgctaacctttttctccacgaagtcagtcatggacttatttcttctgaccaactagctgtgattgagaccaatcagtttgtcaccagaatctatctttcaatcttagacttttattttcctcagttaattcattttatatttgatggatccttccacagaagaagatttgtcttttttttcttttaattattttgaaacgagtatggaaagaaattttatcggcctgaacatatgtattattccaaagttggttcagttacagggagtatttggagaaatacaggcggtattgagggaagacttgtcatcctgctaccggatgacaagtccccctgccattgtgaatcaattgaatcccctcttcaccacacagatgtatgctcttcacaagtcacaaccgcagtatgtttaaagcattagtttgaagcagcttggtgaggtgagtacattttgttctaagttcttgtacacctctgtttctctagatctgtcatgaacagttctaactagacctttcgttccacttttacaagcaggaaggggtttatcaacaagaacatcctgatgtctgaagtagttgtttccgcggtaatcagcgaggctgtgagcagggtctccaccttcttcatcaacaagcataaacggaaattaaacgaggaagatggcatggagaggctggagatggcacgcatcagaatggaggcagccctggagatatccagcaggtggcctccggtcacagacgcctcactcctgcgttggaggaagaagctgaagcgcacatctgatgagtgcagccaagtcatggaaagatgcaagcgtcgtgccatggaagatgatgagatggagcaggaggtcaggcagtgcgccttccctaaacggatcgcccatgccacaagatcattcttatcatctttcactggacagaagaaagttgatagcctgatcaccacttcaaccattcagaagtttgaaaggctcgctgatggtgccagcgagttcctgagattcatggaattcggtagcataggcaggaggatcaactacatgctcgttgatcctcttaccgggcaccttcttgcaggcaaagctctacggtatgaaatttctcaaggaaatcagcactacctagcagcatggccaatgagtttcgcagagcgaggactagaagccggggtgttgctttggtaccagaaccatgagaggccggagaagaacttcattttcggaattctactacgtttggcagcaagcacgaacgtgaccgggattgtggccaggtgcttggagttgttaccacccaatttcaagcctgttgctgaagctgcaaagcaggagctcactcaggtgcaccatcgagccttgtactgcttcccctttgttgattctaccgatccagagtactcgaggaggacccaccattcagagactcaccatgctcgcccaaactccgcatgctgccaaggacacaatcaccatggtagatacccggagccggtgatcaaattggtcgtacggcggtatatctctgcatggcagaagccatcatcgtcttcttcatcatcatcatcatctggtcatggcgataggaggacacccctgctgcagctaacggccgtgatcgggccgcacgcttggctggaggagctgccgcccagagcccggagcgttgctgtcgaagcaatcgacgggagggaagagcaagccgtgcacaggaatgttggtggaggagcttctgctgcccaacgccatcgatcgcctgtgccgccatgaggcggcgtacgatggatcgtcgtcgtcgtcgtccacgcatgaggtgctgtggcagtccggccatggtgtcgcctacctctgcttgaagaagatgggaagagagatggcagggtgcaggcggactcattggccgtgtcattgtgaaaggttgtggcatcgccgagctcagctctggtgcggcggcggaaacggcgcggtggctggtggtggcggcggcggcgggagaacaagaggatggaagagaaagcgcccactccgcgcagccatcgatctatgagagctatgtaaaaaccaaaactgatagtcaatagggggaagattaattttgatcaattctagtttaagcagtgttcccatgtatatgatctcatttttcaagttacccaaaggagtgaaagaaaaaatggacttcttcaggaggaggtttttgtggcaggaggaccaaggcatcagaaaatatcatttagtgcaatggcccattatttgttcacctagagatcaaggaggtttaggtgttctggacctggacattatgaataaggccttgttggggaaatggatttggaatttggaaaacaaagaaggttggtggcaggagattcttagggggaaatatttgaaaaataaaactatgtctgaggtaaactttaaacagggtaactctcatttctggcatgggttgatggaagtaaaggatgatttttttaaattttgttcaaaaaaagtggggaatgggaaaagaactttgttttgggaggacagctgaataggtggaaaaccccttaacattcagtttccaaatctgtacaatatagctttgaccaaacatgtgacaattgcaaaggtgaaaatgaaaggcttgcaatgcatcaaattcagaagagatctagagggagataaactgagagattgggtgagaatcaaaaacagtctggaaagtctgaacttacaggatgactctgaagataaaatctattggaatttgacaaaggatggaattttttctgtgaaatcgttttacaaagcccttaaaatgcatcaggtgtctttccctcaaaagaaaatatggaaatttaagattcctctgaaaattagagtctttatttggctgtttgttaaaaacaaaattctcactaaggaaaacttgtataaaaaaggttggagaaaggggaatgaaaagtgtcaattttgtgataaaaaagaggatatacagcacttgttttttgaatgccctttggccaaacttctctggaatatcatgtgttgtgctttggatatactgcctactttgaatcatcaggatatttttggacattggctggatagacatgataaaaacatgaaacacttgattgtgattggtttagctgcaatcatttggacaatttggaagtccaagaataaagcttgttttgaaaataaatttccaagagatcctactgatttggtctttatggcttgttcctgggtggattcctgggcatctttgcagaagttggaagcaaatcgaagaagactgcagttgggagccagacttataagacaggtggcaagtgacatcttctgctcaagacatggatggagacctggaatctggaggatagaaggatgaagatgttattagttttttgtgatctgttttatccttttgatgaccgaatgatgttattcgtgttcagccatcgagccctgtgaggcatctggataagctctttagctttctttcctcgtatttgtttttgtttccctgactttgtaaggatatgctcatttctagtaagagaaatgggggctctctggccctagttctaaaaaaaaaacaaaaactgataggtattgatttgcaaaaaaagaaatgccaaaattagggatttcgattgtaaattttgtaatctctatgagtgacctgattgtggtagtgatccaatgacagacctgattgtaaatttgtgggttgctgacatccgttgcaagtagccgggtagggtcatgaatgtaaagagtaaattgcatcgccggtacacgaatttgtaaaatgcttattttggtgcatgaacttgtctggtacgtgcggagaaagatgaaaatgacactacatggctaatcttattgatttaggggctgattatgatactatgtaaacatatactccctccatattttaatgtatgacgctgttgactttttgacaaacgtttgacctttcgtcttattcaaaaaatttatgtaattatcatttattttattgtgacttgatttatcatcaaatgtttttaagcatgatataagtatttttatattcgcataaaaagtttgaataagacgaatagtcaaacgttggttaaaaagtcaacggcgtcatacattaaaatacagagggagtatataagaaggttgtaattagatatacacctcttcaataaaaaaatagaataggatatagtgattgtagaaaaagatttttaaaaataccaagcaatgatataagggttaaaaatatatgaaattcatcatggataaagtaaggatcaaattataaatattgcatatcttatgcatactcactacacgtattcacatcacatcctaatcaacatcggtttcgtataattagcattgccaagttattttgatcctcattcgcaagaattagacaagttcgtgtattaaaacgagcattttataaatttatatacttaattgcacccacctaataagttttgtgtaccaccaatacaaattactcaatgtaaaaaaaaaatagcaaggttggccctgctattacgtggctatcatcaaaataaaattatattatagttcaaaattatctacaatatttacttatttttgacaaatagaatagccagctcaccggctatacctgtcatcggtcatatcgtattagatatatgtaggcatatcttttttttaaagataaaaagaacttataaatcagtgacacgttattattgaggaaaataataaataaagaaaggaactataacaataacaactttttgctccaagagactctgttctactccaaaaaaattagaggattttatattaaaaaatagtcatctaccctttcgttttcaagaaggcccaccagccgctagcacatcgcccaaaaccggcatgccgcgaaggacaagagcaccatggtcagagccatcaggtgcattcctaaagccggccggtgattaaattgtccgtgcaacgacatatctcggtgcgacaattatctggtcggcaacgacgagagtagttgattttctgaaaattccttggcatctatgctgctgatgaaggcggtctaagtgacacatgcgtcgccggaggagttgctatcccgaaacatgaccgtcggccgtcgcggctgtggcgatagatggaagggaggagcaagccatgaacgaacattgggctgtgctgtttgaggtggaggagttctttctaccagtcattgactcgttgtcgatcgccaaagccacaaccacgatgctgtggatggatcgtcgacgcacgaggtattctggaagtcccactatggcatcgcctaccaacttctgcgtggaaaagatgggtaccgagatggcaaaatgcaggccgatttgagatacaagcgggccaacccacgagctcgtttaatttataggcaaaatttagtgggtaactcgcgggttatctattaatttaaactataaatggatatatgggttgatctatttacatatctagatgtggcaagcgggaccacgatataaaaacctacggattatcacatatttgatctataagtgagctcgcaagtcggcttgcttgtgtccctaggccgactcaatggctggtctgatggtagacgacggtgccgcttgcctcctgtgctccaatgtgacggccggtggtgttagaagggggcgtgcatccacccatgtattgacatgcgtgtctaccatactttttgggtagagcaaagttagctagctatgtttggtttgggaccaatataaagccaaattttaataggatggtgaggaagattctaaaatatagccaaattgaacatgggcactaccaattgtttggcatcaattcaaactagcacattttctatttaaattaccaaaattttggtatggcacgttttggcttcaatccaaaacggccctgagggacctggttgtaaattttctgatctcatctgatccgggggctgcgtaattgcctggtgtaagtgtgggcttatacttgggccgcgatggactctctttcgctgacaactgggccaccccttcgtctccagttcaccctcctcgccgaccaccatcatccgccacggccatggcctccgccgccggacgatccgcgaggaggcaggctacgccgcgcgtggacccgcggcggcggcgcaaggaggtgaggtccgagcatggtgttcccttgctcgatcctctgcaaccactgtctccatggggcgccacatatacgagcgcgtccgccggcgatgcggagatggaggagaccgatgtttcccctcggcggccgcggcgcaatagcacgaggtgaggctccgtctccctgcatatcactgcctgatcacgtttactgcgcgagatctattcaaccggtcaagaggagtagctggaagcctggaagtgattgcactgagccagtgacaatgattttttctttaaaaaaaaatgttgcagtgacgaagaggattcatctttagctagcctttctgcaagactggtcagtcaacattcggaagcattgtttttggttaagtcgacaagtcgtgcggtgcgccttatttcttctgactgactagtctgtgattgagactaatcaatttgtcaccagaatctatcgttcaatcttagacttttcttttgcttggttaattcacattatatcggatggatccttccacagatgaagacttgtcatctctttttgaaacaactatggcacaattttctcggcctgaacatatgtattactcaaaagttgattcagttacagagtatttggagaaatacaggcggtgtggagggaagacttgtcatcttgctatcacggtcatgttaattaattaccaaatttctatatcatgacatcaattccagcacagatgtactcaaggacctttcactgtcccattgtgaatcaattgaactcccctcttcaccacacagatttatgctcttcacaagtcacaatcgcagtatgtttgaagcactagtttcaagcagcttggtgaggtgagtacattccgtgctacattcttataaacctctatatctctagttctgttgtgaatataattgtaagttgtaaccttatctttccatccccttttacaaacaggctagggtaatcgacaagaacatcctgatgtctgaagtagttgcttctgcggtagtcagcgaggctgtgagcaggatctccaccttcttcatcgacaagcataaatggaaattaagcgaggaagatggcatggagaggctggagattgcacacatcagaatggaggcagccctcgagatatccagcaggtggcctcgggtcacagacgcctcgctcctgcgttggaggaagaagctaaagcgcacatccgatgagtgcagccaaatcatggacagatgcaagcgccgtgccatggaagacgatgagatggaacaggaggtcaggcagtgcgccttccctaaacggatcgcccatgccacaaaatcgttcatatcatctttcactggccagaagaaagttgatagcctgatcaccacttcaaccattcagaggtttgaaaggtttgccaatggtgccggcgagttcctgagattcatggagttcggcagcataggcaggataaactatatgcctgttgatcctctcactgggcaccttcgtgcaggcaaagctctacagtatgaaaattctcatggaaatcagtactacctagcagcacggccaatgcgttttgcagagcgaggacaagaagccggggtattgcttcggtaccaaaaccatgagaggccagaggaaaacttcattcttggaattatgctacgcttggcagcaagcacaaatgtgactgcaattgtagctagttgcttggagttgctaccacccaatttcaagtctgttgctgaagctgcaaagcaggagctcactcagttgcaccagcgaggcttctactgcttcccgtttgtggattctactgatccagagtactggagcatccaccatgctgagactcaccgtgctcgaccaaactcagcatgctgcgactgcgaagaacacgagcaccatggtcgaagcagaagcagtgacatggttgagccgtcaggtgcattcccggagccggtgatcaaactggccgtgcagcgctatgtctctacgagccagagacagaagcaatcatcgtcttcatcgtcatctggtttttctggaaattcggggccacctctgcttcagctgacggccgtcttcgcgccacacgcgtcaccagagcagctgctgtccggggctgagagcgtcacggttgtggcgatcgatgggagggaggagcaacccgtgcacaccaatgttggattgcatgagttggaggagttgctgctgccaaacgccgtcaatcacctgtgccacgaggcggtggatgaatcgtcggcgcacgaggtgttctggaggtcttgccatggtgttgcttacctctgcatggagaatgtggtaacagagatggcagggtgcaggccgactcattggccgcgctcagctctggtgcggcaacgaagacggcgtggtggctggtggcttgtggcggcgccccagcgggagggccggaagaggggagtgcgagcgcccaaccatcgacttatgagagagagctacatgtaaaattcagttttggtgtggtacagcggcagaagggggagtgtgtacatggagacctatatgttgaaaacaaatcctacaggggtttatttccaaaaatatttatctttagctagcctttctggaagattggtcagtcagcattcagtattgactattgacgattggtcagtcaaagtgggcagaaaccaactggagaacagactagagcactaaccaaacttgaaagagaaccacctttggtttgctcgattctctatccaccgaagacatgtactttcattctcgccattcattcaaaccagttatcgtctgctagatactctgtggctcacctgttttccctcaagatctttcctactaattcaactcagaaggttgggttcacagataattcaacaatgcactttgtacttatcaggaattcactgatctatcttttgttttatttgagcatcctgaatgatgtattgatctaatatattgacgtgcaattcttttgcgatttcgcaaaagattgatgtattgatatatcttgctctgtgctgatcaggtagagattattgaagatagaagaggtggttgtttctgctgtggttcatgagacagaggatcatctgggttgattgacagctgtgagtgaaaatcaagtacagcggatcatctggagaggttggagatggcacaaatcaagttggaggttacacttgagacatcaaataagtggcggattactggtgacccgatattacgttggcaaaagaagctgtggaagagtgtgataacaaaatatgcaggtgtaggcagcacgtcgaggaagaagaggctgaacaactagtaaggaattcatcctttcctatgcaaattgtgcatgccaccaagtctctagtattatccatctataacggcaatatccatgagccaaatagatctgttgttcgaagatttgagtggtatgcagatggagctaatgattttctgagatctgtggagtttggagggacgccatgctattatctgttcttcgaccctcttgtggggcacgttcttgctggtgaaacgctggattacaaattagtgcagggaaacaggtaccacttgtttttgatacaggcaaataacattgtagaacgaggagcatgagctaagttgatctttgtttacaatgatagagacacacctgaggataactttttctttggtttgatgctacaactttcagcaagtacatacatagttggcactataattaagtatgtgcagctgaaactgttaggagtttatgcaagtgaaacacagttttttaagatcatgattaacatgacattgaagcattaccacgaattttcaaggaaaaggattgcggtgacgaggataatttgtcttcaatagctagactttttacaagattgggacagtcaacgaggcagctttttaagttttgtgtgattgtgacaaatcaactgtacattcaaatcatcagacttgtggtgttgtgaagggaagactagtcatcttgctatcacggtcacattaattacctaatgtctgtcaacttcatgacatcactcattgtacagatgctccttcatgacttttcactgtctaattggtatcgtgaagactctgaaccatttccatctggattcaggtttatgctgttcacaatctgcaaagctatcagtttaaagcactagtttcagtttcaaccagtttggtgtggtaagtatattttgtgctgaagtccagtatctctagttctgtgatgaataattgtcacctgacctttaattccctttttaatagagggcagcagtgatcaccaagaacatcctgatgtctgaggtcatcgcttctgcggtcgtcggtgaggctgtgagcaggatctccaccttcctcatcgacaatcataaccgcaaatcaagcgaggaagatggcctggagaggctggagatggcacacatcaagatggaggccgccctggaagtgtccagcaggtggcctttggccatggattcctcgcttatgcgttgcaggaagaagctgaagcgagcctccgacgagtgcagccatgtcatggacagatgcaagcgccgcgccatggaagacgatgagacggagaagatcagtcggtgctctttccccaaacggatcgcccttgccacaagatcattcctctcctccttcgccgctgacaagaatgttgatagcctgaactccacttcaaccattcagaggtttgaaaggttcgccgatggcgccggcgagttcctgaaattcatggagtttggcagaataggcagcatcaactacatgctcgttgatcctctcactgggcatctcctcgcaggcaaagcactgcagtatgaaagttctcatggaaatcagtactacctaat

SEQ ID NO: 12962 - DNA, 18233 bp, Oryza sativa
attccgggccgccgcctctgctgcaggtgacggccatcttcgcgccgcacgcctcgccggaggagctgccgccgtcaggatccgagagcgccgcggtcgtggcgatcgatgggagggaggagccagccgtgcgaacggacatcggattgcgcgaggtggatgagtttcttctgcctggcgccatcgatcgcctgtgccactgccacgacgtccatggcacggtggatggatcgtcggcggcggcggcgtacgaggtgttctggaggtcgggacatggcgtcgcctacctgtgcgtggagaagatgggcacggagatggcaaggtgcaggccgactcaatggcgggagtaaaggtagagacgacggtggcgctcgcctcttctgctaatatgtggtgactgacatgtgggccagtcagagaaacatggtgcttgacatgtagggtttcatgttagaggatttgcttcctgtccacccacaacatggaaaatatacagtgaaaatttactgttggatctaaaaatagatgtatagtaatatttttccacgtcataactgtgagtaaaattacagctgaatttgccatggtttttgcggtgaggatgcattggtgatgcacggaaatttttactcgcaattgtgacatgaacaaatctcaagcgtatatatattttttgaattaacgatagttttcagattgtttacattaaatagtttctccatttgacctgtgtgtaaaaaagtttgtggagttgatttgcaaaaggtcggatcattaccatatagcgatcccaaatggagacctgattgactggttgtaaataaccagatcgttaggaatgatatagcaaattagcaatccatatactccgtatcatttaaacattttttttgcgggggatatcatttaaacattgagggacctggctgtaaaatttttgggttaattggatctatgccactgtaatttgccaaattaaaaaaataccactgctattcatcgtatcggctatatgccactgaaagttattaaaattagaaccatgccactccggtcataatttctatcctcctctcttatgccgtctctattcccgtcctcatccccctcctctccacggctccgccgtctgcgccggccggcctcctccgctcgacgcgcggctctgccggctccatcggccccacgtgccgtgagcgtggcacggtgccgccacgctgctcgcgctccccgtggctgcctgcacgcccacctactgtcagatggcaccctggtcatacatcccttgtagcagcagcgggtctagcttgcccgcccatagatgcattctgtcgttgatgcgcttgacgtcggcaaagtccaccaaccgcgcgaggccgacgtcgtcggtttgcttggcggtgttccatgtcgaagaagcggtcaaggaggatggcgagcacgacggcgacgtcggagcatagctgcgtccaccatggggtagagtgtgggtcgccgtcggtgacgaggcggtggacgagcgcgactgcacgaggccacgtgcggctccgcggcctccgcggccatgcgtggcccctccacctctgccgtccttgcgcggacccgcgcgcctccgcctcccctgcaggccccccgttgcccggtgcacctccgccgcaccaccggccttgcgtgccttcgcgcgccgttgcggcccgacgcggctccaccgctcccatcaccaacaaccgccgagaaggccatgctccatggccgtcctccccctgggttccaattttaaaaattcccagtgacatgtagcggatatgacgaatggtagtaacatttttttaatttgtcaaagttacagtggcatggatctaattaacctaaaaaattttatctcatacgggctgcgtaattattgcctggtgttagtgtgggcttttttggagccgagatcggctctcttttgctgatgataactgggccgcacaaatcctcctccgtctccatttgcgtaagcaggcgacacacggccgccaccgtggccggcagccatggcctccgccgccggccggacgatccgcgatgaggcaggctgcgcgtggaccggcgccggcggcgcaaggaggtccgggcatggcgttcccttgctcgatcctctgccactactgtctccacgtggcgccacatatacgatacgagcgcgtccgccggcgatgcggggatggaggaggagccctcggcggccgtggcgcactagttcgaggtaaggctcgatctccctgcatatcactacctgatcatgtctattacgccatatctattcaaccggtcaagatgagtagccgcctaactggaagtgattgcggtgacgatgatttttcttcttttcactacgtgaaattcaagatttctagcattttttttctgtaatgtgtattaagaggagtatttagaaaccaaaaatagcaagcacgtttcatcaactatataccaagattttacttttaaaatcttatgtaatctggaggaatattaccaagaacaggcttattaccagcggaatggcaagcaaatgccaacgctggagttgcaaacatgtctgctaattgaggaatgcatcctatgcataactttaaaaaattaaatcagcaagcaagccttggcaactcattaccatgattccagcttctggaatgtggaaaattaccattatgttgtggtttcagctagcctttctgcaatattggtcagtcagcattcggaagcatcttttttggtttggttgcggtgaatgtctttgtgaaaccatgtgtggttacagttcttttgtgatgggaaattgacaagtaccggaagtgcaagaagtgtgtgcgtggactaacattggtcaggttgcgacatctgtgccaagacaatggttgtttggttcatgtgtgtgtaggtgatcggggtcgatcttggtcaacggtggatcgggactagactcagggaggagttgaggtccaaagcgatcaaggataccgggtgacaagattggacacaaggttgcacacggtggacgaacaccgtatgaggaggtctttgcaacggactttgcaaggtcaagtgcaagtgccgggtgcgcaaagaaaatggtgaatggaagaagagcttgcatatatgcactagtgtgtgcatatgcaagcatgggcagctagttgattagctagctagcttgtgatgcttcggcagtgcatacgtgcatatggtccaataccatgcatgactgcatgtgggctggctggaagagaggccaaccggcctgtccggctcgggtgttcggtcagcaggaggccacatggccggtcctgactggcccaagatggagacagcccacggcgacgggcccatgaagacaaggcatgcggggggcgggagccgtacgggcgacgtggcgtcctcccgttcgacggaccacggcatcggcaggaagacgtgacacgcggcaggcagcaactcggaggcgagcgcgggagatctcggcgacggcgcgcgcgcgtgagggacacgcggcaggcgcggacttgaccgcgcgctctctcgcgggagctataccgcgtgggtcctacgcagattttggacgggatgcgcgggaaacttcgctcgctggccagagcacgagcgcgcgcggagcacgtggacacatggcgcatgtggataggctcggatggacacgacgcggatcgggggtgcgaggagtcttcggatcgacgacgtggcaagcatctaagaggtttccttcgcatgtaaggaagaatgaacagccaggattgcatctgagatagggtttcgtcctaggggtatttgagacaatgtcttaggggtcttaggctataaatagagagatggatgcaagggtggaggttgctcctttggtaatccttttgagatgcttggtgagagagttttcgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctatgaatgaaatgatttgaaggatttcgtttttgtcttgtccatttaaattccacaatttaaattccgcttgcaatttgaactttgcgatgatgagttttgctcactcctcctcacctctcttctagtttcgggaattccttttctcttcctcttctagtttcgggaattccttctatcttcttttctagatccggcttctctaatagccgcggttctagtaaggattttgagaaatccggcttgatgagtattttcgggggcaagatttgaattgctatattcaccccccctctatagccgttcttggtctttcagtcttaataacaaaatttactattggtcagtcaaagagggcataatcaactggagaataaggcttacctaacgtccacatctttgatttacttgagttttctccaccaaggacatggacctttatgctcaccgttcattcaatccagttatcgtctgctggcagctgccagctgggtactctctggtgcatctgtgttccctcaagttccttcctactaattcaactcagaaggcacctgtgttccctcaagttccttcctactaattcaactcagaaggcacctgtgttccctcaagtttcttcctactaattcaactcagaaggttgggtttgcatatacttcaaaggtatactttataagtacttatcaggaattcacttatctatatgagaaaattgcatcctgggccacttttattgaccattgttgcatgttggactagaggtaggacattcttttcggtttgaaccagaaatctttgcaaaaattttcatattgaaccagtcttgttcttcctctagatctcccccttttctcttctcttccctgttttagttcgagctcaccacacttcctcaggttccatctacgtgtttgacctacgtcagcgcctgagcttgagtgtgtggtagtctccgtcttgagctcaacacggcacacggcagagctccagcttgagctcaattagcacatagccaatgaatcacggtggcacggtgggaaattctaacaccatatgttatcactccacacttatgctccaccaactagtcaataggtcccattctagcccaagttcatccatggcagtactagcttaattggagctagggcacttaatcaaggctgcacattaaatcttgagcacgaatgaatgtggcaggggcagcgaaggctgactggctgagtagagctcgagcatgactgtactggtggagcttgagctctatctctactaaaaccaactagccaggtatgtgaatctcaatctgaaggtagagagagtgaggaagcagagctggaagaagaacactaggtcctaagtgtaacattttgtaaaaattactagcccaaagtgaaaataatagcttgttcctagtccaagctgcgaccatggtaaagaaagccggtccaatatgcaattaactctatctatattttgatcgatgtattgatatatcttgctctgtgttgatcagggaaggattactgaagatggaagagatagtcggttctgctatcgttcaagagacggtaaacaggatcatatctgggttgattgaccggtgtgagcgaaaatcaagtgcacgggatcacctggagaggctggagatggcacaaatcaagttggagttcgcacttgagacatccaataaatggcagatcactagtggcccgttgttacgttggcagaagaagctgaagcgtgctactgaagagtgtgatgacacactacggaagtgcaggcaacatatccaggaagaagatgaggtggaacaacaagtaaggaattcttcctttcctaggcgaattgcccatgccaccaagacactggtatcttccatctttcacagcaatagtgatgagctgggtagatcttctgtccaaagattcgagtggtttgcagatggagctaatgattttctaagatctgtggaatttggaggcacaccacgccgttacttgttctttgaccctcttatcgggcaccttatttcaggtgaaacgttagagtacaaatcaatacagggaaacaagcagcattggttttgggtacggcccaataactctgcagagcgaggaatagaagctaagttgttctttgctttcaatgatggcagtgcacctgaggacaacttttacattgatattattctacaactttcagagagtacaaacatagttggtactacaattaagtgcttgcagttgtttactccttattttgagtctacagctgaaactgttaggaaagaacttattcaactacctacacaagacttctccagggtgtcacattctcactcatacggttgggagaacattcatagtatagctactgaatggttccgcccaaatccactgtgttgcaagcatcatggtcagaaagtatgtggtagtgggaacttgcacaaggtagaattaacagatatttctctagaacccatcattgaagtgagtttactgtgccaagtttcacctcctgggttcagagaacagggaacaattgttgagggtaaatcttcacttaaagaatttccgcatctgaatgttatccttgtctatacgccccatggctcttcagaagacctattcccagcagttgatagtactgtgattgaggtgattaatggtaacgagcaacattgcttgcacacaaatgttcatgctgccaagggctgtagattgttttcgtcagaatgcaaaagcaacagcgtatcagatgctttggaagtctaaacatggtggtgcatttcttcaggctgtgaaggcaacaatgaacatgcggagcacacggagaaccattcgaggagccaggaaagcaaagatgttgcgacgacatgatcgccggacacacaatcacagacatgaggtcgctgacttcctcagcctttgggctgtgcatgcacctgtccggcttcagggctcactccttgactggattcggaaggagaagaaagtagcaggtcctctactgacattttagatgatgtaatagggactagaagggaaacagggataattaaaattaaaagaatgggggagaaaagtaacatgtagggagttggtttctaagtacttaggagtgtattcatctgaaatgttctacatatactgctgttgtttgtctcgtcagttatgttggcaaatggtgataacatgatgttcttgccctagaagtctaatgtaccagccttgctcattcgatgtgtctggtttcatttgaatttacatgagtctatcatgattgtgggctataagaaaattatcatttctcactcaattgcctgctttctcatattcccatgcactttctttttattttgttattttcatccagtatggcttatttactggaaattcccagtttgacagcgataacctctgggtggtttaaaattataatattttggataatttcaaaatgaaactagaaaacacatgaatatttattctaactttgtcatgtgctgaaacgcagatgcaaaggaagatgcaaaaaaagagcagcaaggtgaacaaactgattggtgacttggtgagcccgtggatggggtgagtggtggacatgccaagccaacacaagactattcatcaactagacagatattccattacagttgttcagaataatttccagtccatttgcaaagctttacggttagctgcggtgcaccttatttcttctgactgactagtctgctattgactgactagtctgctattgagactaatcagtttgtcaccagaatatatcgttcaatcttagacttttcttttgcttagttatttcattttatatatttgatggatccttccacagaggaagactaatcctttttttttaaacaactacagcaagcaattttcttggcctgaacatatgtattactcaaaagttgattcagtgatagagtatttggagaaatacaggcagtatgaagggaagacttgtcatcgctttcacgatcacattaattaattatcaaatgtctatgtcacaacgtgtgttctggtacaaatgttacttaaggacctttcactgtccaattgacattgtgaagaaaactgaacccccatattcaccaaacagatttatgctcttgacaagtcacaatattgcagtatgaccaaagcactagtttcaagcagcttattgaggtgagtacattttgtgctaattgctaagttcttataaacttccgtatctctggttctgtagtgaacaattataagttgtaacctgacctttccatccccttttataaccaggctggggtaatcaacagaacatcatgatgtctgaagtagttgcttctgcggtagttggcgaggctgtgagcagggtctccaccttcttcgtcgacaagcataaacggaaactaagtgaggaagatggcctggagaggctggagatggcacacatcagaatggaggccgctctggagatgtccggaaagtggccgccggtcacagatgcctcgctgctgcgttggaggaagaagctgaagtgcgcctccgaagagtgcagccaagtcatgaacagatgcaagcgtcgcgccatggaagacgatgagatggagcagcagatcaggcgatgctctttccccagacggatcgcccatgagacaagatcattcttctcctctttctccggcgacaagaatgttgatagcctaatcacaacctcgaccattcagaggtttgaaaggtttgctgatggcgccggtgagttcctgagattcttgcagttcggcagcataggcagcatcaactacatgctcgttgatcctctcacaggtccccttcttgccggcaaagctctgcagtttgaaaatcctcctggaataagtgggtactacctagcggcacggccactacgatttgcagagcgaggagtagtagcctgtgtgtttcttcagtacaagaaccatgagaggccagaggaaaacttcctcctcggaattttgatacgggtgacagcaagcacgaatgtggtcgggattatggccaggtgctcggagaagcttacctccaatttcaagcctgttactgaagctgtgaggcaagagctcgctcagttccaccagcgaggcttctactgcttcccgtttgttgcttctactgatccagagtactcgagaatccaccaatccgaaactcaccgtgctcgcccaaacccggcatgctgcgaagaagaacacgagcaccatggtcgccgcagaagcagtgacatggttgagccgttaggtgcattcccggagccggtgatcaaattggtcgtgcaacgccatgtctctgctacacgacacaagagaacatcgtcttcttcatcatattcatgttcatgtggtcatgccaacatgggttgctcggggccgactctgctgcaggtgacggccgtcttcgcgccgcacgcctcgccggaggagctgccgtccggagccaagagcgtcgccgtcgtggcgatcgacgggagggaggagcaagcggtgcgcactaacgttggatggcgtgagatggaggagctgctgccgaacgccgtcgatcgcctgtgccacgaggctgcggcgcatgaggtgttctggagatccggccatggcgtcgcctacctgtgcgtggagaagatgggcacggagatggcaaggtgcaggccgactcaatggcgggtgtaaaggtagacgacggtggcctcaagccctgaatgagtaacgtttttgcaacgacatgaccttgagctggagagccaagcagctgtgatctctgaatttctagagttgtgggttcagggtagtcctatcctgatgcaattctcagtggtggactggattcaggccctatttggctttttctcgaacgcgcaaaaggattgcacgttaatatattagaagataagaatattcgatacacaacgcattaagccagaccgacttatgccaagagaggagggaggccctacttggtggagattctgaaaagagcaattctacggtccttaaggaggtaccatgaggtaccaaaattttagtgtaaaatttggtacatcatagtacctagataccaagaggtaccaaatttataatagaaaaaatggtacctcatagtacctactcaagaaccataaaattgctctggtatgtaaatatgagctcaacatggtgttgaagctttgatgtgtaatcggtcattttgtctgaattttgcatgcctcaccctgtttccttttagtatttcagatctccaagcaacttgtctttttattatgctatttgttaggtgatgatcagacagcaatttcatgagaattcttcaagcacgacaaaggttttacatggtccagctagtctccatttgatcaaagagtttaagatactggagacttgattattcccatcatgatcatctgctggcaaatgaaccgaatcaaacagcctaacatagaactagcatctcgtaatgctgcttctgtaggatcgaggaaggctgtgttagttccgagaagaaaggggaagaaaaactttgttttttttttcatgttttccaaattgcttaatggtgtattttttaaaaaaaaatctatataaaagttgtttaaaaaatcatattaatatttttaaataattaatactcaattaatcaatcgctaatgacttgtatcatttggtgtatattttcctctcctgagacacatccgaaggaaggagacatatggtgtagacgaatgggttgtgcattcggcccaactggtagtgaaagtacatcctagggcggctcaagaagcccatgagttagtgggcttaaatttgggcttcagtggactgggccgagctatcactaattcactatcacttgggccgcaccaaagcccttcgtctctccactctccactccgaccaccacggcaaccaccgccgtccaccgcgcgagcaggcctccgccgccgccgcggacgaacgatccaggcgaggccatgccggcgcaaggtggtccgggggaatggcgttgccttcctcgatccgctgctgctgctgccagcctgccactgtgggggcggccatttgtgcgtgctcgtgcggcgagagcccggcgatgcggagaggaggaggccagcttcttcctcgcggcggccacggcgaggcgcgttgagatcgaggtacggctaggtttcatcgcatcccgcgatctgtttcgtccagcttaatttgttgctgttctgtttaggggataggttagtccactgcacaagcaacgtgtcgcagataattcgtagtcgccaataatgattttttcagaccaaaagacgacttcaagtcgccgataatatagttatcgaattcccagatccctaccagtcaacacaagtaagccggaactgatttcactaggatttttttttttaggaaaaggatcgcagtgacggcctgacggggacaatttttcttcaataactagccacgctgcaagattggacagtcaatgagagctttcttttaggaaaaggatcgcagtgacgaggacagtttttcttcaataactagccacgctgcaagattgaacagtcaatgagagcagtgtgctctcaactttcaacaggtgtggtattagaccatacattcaacaagacccgcctaacttccatgagagcccagctttgctttgctcgtattttctccccaaagtcatcaactttgatgctcaccattcattcaatctagttattatctgctgggtactctctggtcgcacctgcgtggcttcgatttacttgcgactaattcaactcagattctctgaaggttgtgctttacatatttcaacgatgcgatattgcgctttgctagttcttatcagaaattctctcatctatcttttgattttaatgggcatcatggttgatgtttcgatatatcttgctctatgcagatcagggaggctaatctcgcagctgaagatgggagagatagtcagttatgcggtcgttcatgagacagtgaacaaaatcatatctgggttggttgacaagtatgagcgaaaatcaagtgcggaggagcagatggagaggctggagatggcgcaaatcaagttggagattgctcttgagacatccaataagtggcagatcactagtgggccgttattacggtggcagaagaagctaaagcgtgctgctgaagagtgtgatgacacattacgcaagtgtaggcagcgtgtcgaggaagaagaggaggtggaacagcaagtaaggaattcatcctttcctaagcgaattgcccatgccaccaagtcaatgatatcatccatctttcacggcaatatcgacgagccaactgtatcttctgttcgaagattcgagtggtttgcagaaggagctaatgactttctgaggtctgtggagtttggagggacaccacatcgttactcattcttcgacccccttattgggcaccttcttgcaggtgaaactctagagtacaaatcggtgcagggaaacaagcagcatttgttttggatacggcccaacaacatttcagagcgaagagtagaagctaagttgatatttatttacaatgattgcagtgcacctgaggataacttttttcttggtatgatgctgcagctttcagagagtacaaacatagttggcactacaattaggtgcttgcagttgtttagcccttatttcagttcttctacaactgaagctgttaggaaagaacttactcagctacctacacaagacttctcctgggtgccacgttctcgttcagttcattgggacagcattcacagagtagctactgagtggttccgcccaaacccactgtgttgcaagcatggtcataaggtatgtagtagtggctacatggacaagatagaattttgtgatgtttctctagaaccagtcattgaagtgtatttggagagccaaatcttccaatatagttgcaacaaacagagggcagatgtacaaggaaaaatatgttctcccagaagaccatcatatctgaaacttggagtattccttttgcctcatgtttcttcaaccgaccttctgcctgccactgagagttttgcagtagaggtgatcaatggtgaggagcagctttactgtcacaaaaatgttacactggaaaagcttaacaggataatgctaccaaaagcaatagatagcttcaatcagaatgcagaagtgacagcgcatcagttgctgtggaagtcaaagcatgaagctgcattctttcatgtgtggaacacaagaatgaatatgtcaagcatattgagtactgctaggaaatcaacgttgttgcaacaacatgatcaccttgaactggagagccgagcagatgtgatctctgagtttctcaagctgtgggttgatcgtgctcctgtcatgatgcagttcgcagctgtggactggattcaggccctacttggggaagctggagattctaaaaagttgctgatgagcatgtagctgttgggaatctggaggaagttggtgaaacctagcttctggttactaggttcataaaatctagatttggtggctacttaatttcttaacctggaggaagaatataagctgtttaggcgagctggagatttgctagtgttgctataagctcattcaaacaaggccttgaagggaaatacagttgccaccaagattatggaatagagattgatcatggtaacaaggggaaatgaaagtaatggataggaaatattctactccctccggcctgctttgctgcttgttcgcataacctttggaaggcccgcaaccacagtaccttcaattcttctcagcaaagcacctccgcaacgttgaatctgatcaaggaaaatctgcaattatgggagcaccgcctcaagccttgccttcgagcacacattactgcttgggtggtcaaatttgattaaccaccctcttttctccacttttgtatttttgtattatttttgtattttttgtattttctcttcctgctttacatcttgtattttctcctgttttccttttttcttctttctcctttttatccttcttctccccctgtaatgctcctgttgttctcttatttggctttaccagatctcatctggtttgaccaccattaatacaatggttacaaggtagagtctctctaccttttgtgtaaaaaaaagtggatgtgtaatcaatatttttttatgtgaaatttgcacgtatatgctgcaaccaagattgaattttatctgaatttttcatgtctcaccctgtggacttctatttcagatttccatggtatatcaggtgatcagacagtcattggctcatttcatgaaaaattcttcaaatagacaaagttttacgtggtctaggttgctttcatttgatcaagattttaagataccgaaaccttggttagtcccatcatgatcatctactggtaaatgaaccgaattaaacaacctaacatagaactagcactccagtgttgcttctgccccaacttctgcagtaggccaaggttgttttcttcgctcaatgttcccaacctctgcctctcatgactcattttctgcgcgcacgcttcacaaattactaaacggtatttttttcaaaaataattctatagaaaagttgttgtaaaaaatcatattaatcatgttttcaattttttagctaatactaattaaccatgcgttaatacttgggccctccaaaagaacgcagtcgaaggccgctgtgcagcctaagcagcccatgggcctttacttgggcctctgtgggcttgtccgagttttcactgtcacatatgggccgcatcgacaccttcgtctccacgctgagtcgctgaccaccatggcaaccaccaccgtgcacgccactgacgccatggccggacggggcctctccgccgccagatggggattgctctgccgccgaagggtccgcagcgaggccgcgcccactcgtggatcggcggcgcaaggcggtgccataatggcgtttccttcctcgatccgatgccgctgttgcttccactgtgagccgccaccatacacgcgtgcttgtgcggcgacccggcgatgcggagagggaagaaggccgccgcttcctcgcggcggccacggcgcgctagatcaaggtacggctcggtttcctcgcctctcgcgaccagcttgattttagttactgctgttctattcaggggagaggcactcgcactacacaagcaacataacccgagattcccagctataattcgtagtcgccgataataattttctcagacccaacaaattaagtcgccgataatatagttttacagattcccagattccattcagtcaagagtcaagacaagaagctggagtttctaataagaaaaatgattacagtgacgagaggagaattttcttcagtagctagtccgcaagattgggacagtcagtgagagcagattttgattttaaaattgtctgtgtgtgacaaatcaacttgaaagtcaccgataatagttttctcaacaggtgccatattagaccagcctaacttccagaagaacccaactgtaatttgctatttttcctgcctgaagtcttatactttcgtgcaattcatgcaatccagttatcttctgccgggtactctctggtgcacctgtgtagctccattacttcctactagttcaactcagaaaggttgggctttgcatatgcttcaacaatgcacttcgttagtacttatcaggaattcactgatctatctcttgattttattaggcatcatgatcaatgtactgatacatctttgctctgtgctgatcagggaggcagctcttgcggattgatcactgaagatgggagagatagtcagttctgccattgttaccgagacagtgaacaaaatcatatctggcatgattgacaattatgagcaaaaattaagtgcagacgagctgatggagaggctggagatggcacaaatcaagttggagcttgcacttgagacatccagtaagtggcagatcacgagtgagccgttgctgcgttggcagaagaagctgaagcgtgctactgaagagtgtgatgacacactacgcaagtgcaggcagcatgtccaggaagaagaggagaaggaacagcaagtaaggaattcctcctttcctaggcgaattgcctgtgccaccaaatcactgatatcatccatctttcacggcaatatcgacgagccaagtagatcaactgttcaaagatttgagtggtttgctaagggagctgatgactttctgaaatctctggagtttggagggacacctcgccgttacttgttctttgaccctcttatcgggcaccttcttgctggtgaaacacttgagtacaaatttgtgcagggaaacaagcagcatttgttttggatacggcccaatgacattgcagatcgaggagtagaagctaagttgatctttgtttacaacgattgcagtgcacctgagaataactttttcctcggtatgatgctacaaatttcagagagtacaaacataattggcactataattaagtgcttgcaatggtttacccctcatttcaagtctacaactgaaactgttaggaaggaacttgctcagctccctacacaagacttctcctgggtgtcacattatcgttcataccattgggacaacattcatggtatagctactaagtggttccgcccaaacccaatatgctgcaaacatcaagatcagagcatgtgtgggagtggcagcatggacaaggcagaactgctagatgtttctcttcaaccaatcattgaagtgtatttggagcgtcaaatcacacaatttagatgcaacagtcagagggcagctatacaaggaaaaaacaataaacagagagcagctgtacgaggaaaaagatgttatccaagaaggccttcacatctgaaacttggggttctttttttgcctcatagctcttcaaatgaccttctgcctgcagctgagagttctgcagtagaggtgatcaatggcgaggagcagccttggtatcacagaaacattaccctggaacagctagacaaggtcatgctgccaaaggcaataggtagcatcaatcagaattctgaagcaacagcacaccagcttctctggaagtcaaaacatgaagctgcattctttcatttggggaagacgagaatgaatatgccgagcacattgagcactgctagggaagcaactgtgtcgagacgacaggaacttgatctggagagccgggcagatgtgatctctgagttcctcaagttgtgggttgagcgtgcgcctgtccagatgcagcgctcaattgtagactggattcagaaagagaaggaagtgcagttagcgccaacaccattctagaattctagatcatgtaagagagatcgatgagggtaacaaggggaatggataggaagttcttcatgatgagaaatgagccttgttcagtcttaatttctaagccagcaataacttggtatgtacaatagggtttcatgaaagtgaagcacagtctgttcagctcagcatataagcaagctggtaataacatggtgttgaaatattacgcaagaaatccgttcactggatgggtaatcgttctttttatctgaatttttcttgtctaatcttttgccatcattgaaagtgtgatgatgatattgatatatagtttatgtctctagtctcaacctgttggctgttactatttcgtactcaacctgttgcccggcatttcagatttccatgcacagtcaatggcatgaaaattctgaaaacaagtccaacgttttactggtctagctagtttcttctatcactgatatttcacggcccttctagaagaaaaaaaaaattctaaaccgaggtacgacttgatcaagagttcattaagataataaaagacttgattagtccctctcccatcatgatgattccctggaaaatgaaacaaattataactagcactttccagtaatgttgcttgtgcaggagaaggaaggttgccgttctttttctcgtgctccatgcagatcgaggaaggaaacgtcatgcccaggcgatctcgccggcgcagcttatc
